(12) United States Patent
Ando et al.

(10) Patent No.: US 11,730,764 B2
(45) Date of Patent: *Aug. 22, 2023

(54) COMPOSITIONS AND METHODS FOR TREATING HER2 POSITIVE CANCERS

(71) Applicant: A2 Biotherapeutics, Inc., Agoura Hills, CA (US)

(72) Inventors: Yuta Ando, Agoura Hills, CA (US); Julyun Oh, Agoura Hills, CA (US); Han Xu, Agoura Hills, CA (US); Carl Alexander Kamb, Agoura Hills, CA (US)

(73) Assignee: A2 Biotherapeutics, Inc., Agoura Hills, CA (US)

( * ) Notice: Subject to any disclaimer, the term of this patent is extended or adjusted under 35 U.S.C. 154(b) by 0 days.

This patent is subject to a terminal disclaimer.

(21) Appl. No.: 17/809,409

(22) Filed: Jun. 28, 2022

(65) Prior Publication Data

US 2022/0339194 A1 Oct. 27, 2022

Related U.S. Application Data

(63) Continuation of application No. PCT/US2022/016582, filed on Feb. 16, 2022.

(60) Provisional application No. 63/149,952, filed on Feb. 16, 2021.

(51) Int. Cl.
| | | |
|---|---|---|
| *A61K 35/17* | (2015.01) | |
| *C07K 14/725* | (2006.01) | |
| *C07K 16/28* | (2006.01) | |
| *C07K 16/30* | (2006.01) | |
| *A61K 39/00* | (2006.01) | |

(52) U.S. Cl.
CPC .......... *A61K 35/17* (2013.01); *C07K 14/7051* (2013.01); *C07K 16/2809* (2013.01); *C07K 16/2833* (2013.01); *C07K 16/2863* (2013.01); *C07K 16/30* (2013.01); *A61K 2039/507* (2013.01); *C07K 2317/622* (2013.01); *C07K 2319/03* (2013.01)

(58) Field of Classification Search
CPC ..................... A61K 35/17; C07K 14/7051
See application file for complete search history.

(56) References Cited

U.S. PATENT DOCUMENTS

| | | | |
|---|---|---|---|
| 4,690,915 A | 9/1987 | Rosenberg | |
| 5,350,674 A | 9/1994 | Boenisch et al. | |
| 5,585,362 A | 12/1996 | Wilson et al. | |
| 5,858,358 A | 1/1999 | June et al. | |
| 5,883,223 A | 3/1999 | Gray | |
| 6,326,193 B1 | 12/2001 | Liu et al. | |
| 6,352,694 B1 | 3/2002 | June et al. | |
| 6,534,055 B1 | 3/2003 | June et al. | |
| 6,692,964 B1 | 2/2004 | June et al. | |
| 6,797,514 B2 | 9/2004 | Berenson et al. | |
| 6,867,041 B2 | 3/2005 | Berenson et al. | |
| 6,887,466 B2 | 5/2005 | June et al. | |
| 6,905,680 B2 | 6/2005 | June et al. | |
| 6,905,681 B1 | 6/2005 | June et al. | |
| 6,905,874 B2 | 6/2005 | Berenson et al. | |
| 7,067,318 B2 | 6/2006 | June et al. | |
| 7,144,575 B2 | 12/2006 | June et al. | |
| 7,172,869 B2 | 2/2007 | June et al. | |
| 7,175,843 B2 | 2/2007 | June et al. | |
| 7,232,566 B2 | 6/2007 | June et al. | |
| 8,697,359 B1 | 4/2014 | Zhang | |
| 8,771,945 B1 | 7/2014 | Zhang | |
| 8,795,965 B2 | 8/2014 | Zhang | |
| 8,865,406 B2 | 10/2014 | Zhang et al. | |
| 8,871,445 B2 | 10/2014 | Cong et al. | |
| 10,040,846 B2 | 8/2018 | Frigault et al. | |
| 11,254,726 B2 * | 2/2022 | Kamb ................... | A61K 35/17 |
| 2003/0170238 A1 | 9/2003 | Gruenberg et al. | |
| 2004/0101519 A1 | 5/2004 | June et al. | |
| 2005/0244858 A1 | 11/2005 | Rossi et al. | |
| 2006/0034810 A1 | 2/2006 | Riley et al. | |
| 2006/0121005 A1 | 6/2006 | Berenson et al. | |
| 2014/0068797 A1 | 3/2014 | Doudna et al. | |
| 2015/0376296 A1 | 12/2015 | Fedorov et al. | |
| 2016/0289293 A1 | 10/2016 | Pulé et al. | |
| 2019/0185849 A1 | 6/2019 | Lundberg et al. | |
| 2019/0290691 A1 | 9/2019 | Jäckel et al. | |

(Continued)

FOREIGN PATENT DOCUMENTS

| | | | | |
|---|---|---|---|---|
| CN | 110484507 A | * | 11/2019 | ............. A61K 35/17 |
| WO | 0129058 A1 | | 4/2001 | |
| WO | 0196584 A2 | | 12/2001 | |

(Continued)

OTHER PUBLICATIONS

Sadelain et al., Cancer Disc 3:388-98 (Year: 2013).*
Hamburger et al., Mol. Immunol 128:298-310 (Year: 2020).*
Almagro et al., Front. Immunol., 8:1751, doi: 10.3389/fimmu.2017.01751 (Year: 2018).*
Rudikoff et al., Proc. Nat'l Acad. Sci. USA 1982; 79:1979-83 (Year: 1982).*
Brown et al., J. Immunol. 1996; 156(9):3285-91 (Year: 1996).*
Geneseq entry BGY93055, first entry Jan. 9, 2020 (Year: 2020).*
MO2R1_HUMAN, Cell surface glycoprotein CD200 receptor 1 • *Homo sapiens* (Human) • Gene: CD200R1 (CD200R, CRTR2, MOX2R, OX2R) • 325 amino acids • Evidence at protein level., Uniprot ref. Q8TD46, 8 pages, Release date Feb. 2022.

(Continued)

*Primary Examiner* — Jessica H Roark
(74) *Attorney, Agent, or Firm* — Mintz, Levin, Cohn, Ferris, Glovsky and Popeo, P.C.

(57) ABSTRACT

The disclosure relates to immune cells comprising a dual receptor system responsive to loss of heterozygosity in a target cell, and methods of making and using same. The first receptor comprises activator receptor specific to a HER2 antigen, and the second receptor comprises an inhibitory receptor specific to an antigen lost in cancer but not wild type cells, that inhibits activation of the immune cells by the first receptor.

22 Claims, 28 Drawing Sheets
(22 of 28 Drawing Sheet(s) Filed in Color)
Specification includes a Sequence Listing.

(56) References Cited

U.S. PATENT DOCUMENTS

| | | | |
|---|---|---|---|
| 2020/0316120 A1 | 10/2020 | Gross et al. | |
| 2022/0162287 A1* | 5/2022 | Kamb | A61K 35/17 |

FOREIGN PATENT DOCUMENTS

| | | | |
|---|---|---|---|
| WO | 2019068007 | A1 | 4/2019 |
| WO | 2020206248 | A1 | 10/2020 |
| WO | 2021030149 | A1 | 2/2021 |
| WO | 2021030153 | A2 | 2/2021 |
| WO | 2021035093 | A1 | 2/2021 |
| WO | 2021096868 | A1 | 5/2021 |
| WO | 2021119489 | A1 | 6/2021 |
| WO | 2021222576 | A1 | 11/2021 |

OTHER PUBLICATIONS

Altschul et al. (Oct. 5, 1990) "Basic Local Alignment Search Tool", Journal of Molecular Biology, 215 (3):403-410.

Altschul et al. (Sep. 1, 1997) "Gapped BLAST and PSI-BLAST: A New Generation of Protein Database Search Programs", Nucleic Acids Research, 25(17):3389-3402.

Arseneault et al. (Mar. 23, 2017) "Loss of Chromosome Y Leads to Down Regulation of KDM5D and KDM6C Epigenetic Modifiers in Clear Cell Renal Cell Carcinoma", Scientific Reports, Article No. 44876, 7:8 pages.

Berge et al. (Dec. 1998) "Selective Expansion of a Peripheral Blood Cd8+ Memory T Cell Subset Expressing Both Granzyme B and L-selectin During Primary Viral Infection in Renal Allograft Recipients", Transplantation Proceedings, 30(8):3975-3977.

Cong et al. (Feb. 15, 2013) "Multiplex Genome Engineering Using CRISPR/Cas Systems", Science, 339 (6121):819-823 (9 pages).

Database Genbank,"Collectin-12 [*Homo sapiens*]", NCBI Reference Sequence: NP_569057.2, 3 pages, May 22, 2022.

Database Genbank (Sep. 1, 2020) "C-X-C Motif Chemokine 16 Precursor [*Homo sapiens*]", NCBI Reference Sequence: NP_001094282. 1, 3 pages.

Database Genbank (Nov. 22, 2021) "*Homo sapiens* Chromosome 15, GRCh38.p14 Primary Assembly", NCBI Reference Sequence: NC_000015.10, 3 pages.

Doench et al. (Jan. 18, 2016) "Optimized sgRNA Design to Maximize Activity and Minimize Off-target Effects of CRISPR-Cas9", Nature Biotechnology, 34:184-191.

El-Naggar et al. (Jan. 2016) "Genotypic Analysis of Primary Head and Neck Squamous Carcinoma by Combined Fluorescence In Situ Hybridization and DNA Flow Cytometry", American Journal of Clinical Pathology, 105(1):102-108.

Garland et al. (Jul. 30, 1999) "The Use of Teflon Cell Culture Bags to Expand Functionally Active CD8+ Cytotoxic T Lymphocytes", Journal of Immunological Methods, 227(1-2):53-63.

GENBANK (May 22, 2022) "B2M beta-2-microglobulin [ *Homo sapiens* (human) ]", Gene ID: 567, 12 pages.

GENBANK (Jul. 3, 2022) "HLA-A major histocompatibility complex, class I, A [ *Homo sapiens* (human) ]", Gene ID: 3105, 15 pages.

GENBANK (Jul. 3, 2022) "HLA-B major histocompatibility complex, class I, B [ *Homo sapiens* (human) ]", Gene ID: 3106, 14 pages.

GENBANK (Jul. 3, 2022) "HLA-C Major Histocompatibility Complex, Class I, C [ *Homo sapiens* (human) ]", Gene ID: 3107, 13 pages.

Haanen et al. (Nov. 1, 1999) "Selective Expansion of Cross-Reactive Cd8+ Memory T Cells by Viral Variants", Journal of Experimental Medicine, 190(9):1319-1328.

Hofmann et al. (1993) "TMbase—A database of membrane spanning proteins segments", Journal of Biological Chemistry, 347:166(2 pages).

Kagoya et al. (Feb. 5, 2018) "A Novel Chimeric Antigen Receptor Containing a JAK-STAT Signaling Domain Mediates Superior Antitumor Effects", Nature medicine, 24(3):352-359.

Karlin et al. (Jun. 1993) "Applications and Statistics for Multiple High-Scoring Segments in Molecular Sequences", Proceedings of the National Academy of Sciences, 90(12):5873-5877.

Karlin et al. (Mar. 1990) "Methods for Assessing the Statistical Significance of Molecular Sequence Features by Using General Scoring Schemes", Proceedings of the National Academy of Sciences of the United States of America, 87(6):2264-2268.

Krogh et al. (Jan. 19, 2001) "Predicting Transmembrane Protein Topology with a Hidden Markov Model Application to Complete Genomes", Journal of Molecular Biology, 305(3):567-580.

Papathanasiou et al. (Nov. 2020) "Autologous CAR T-cell Therapies Supply Chain: Challenges and Opportunities?", Cancer Gene Therapy, 27(10-11):799-809.

Passerini et al. (Mar. 2008) "STAT5-signaling Cytokines Regulate the Expression of FOXP3 in CD4+CD25+ Regulatory T Cells and CD4+CD25-Effector T cells", International Immunology, 20(3):421-431.

Pennisi, Elizabeth (Aug. 23, 2013) "The CRISPR Craze", Science, 341(6148):833-836.

Ren et al. (May 1, 2017) "Multiplex Genome Editing to Generate Universal Car T Cells Resistant to PD1 Inhibition", Clinical Cancer Research, 23(9):2255-2266 (21 pages).

Saal et al. (1993) "Cytogenetic Differences Between Intestinal and Diffuse Types of Human Gastric Carcinoma", Virchows Archiv. B, Cell Pathology including Molecular Pathology, 64(3):145-150.

Tsai et al. (Jun. 2014) "Dimeric CRISPR RNA-Guided FokI Nucleases for Highly Specific Genome Editing", Nature Biotechnology, 32(6):569-576 (22 pages).

Ui-Tei et al. (2000) "Sensitive Assay of RNA Interference in *Drosophila* and Chinese Hamster Cultured Cells Using Firefly Luciferase Gene as Target", FEBS Letters, 479:79-82.

Wong et al. (Dec. 29, 2015) "TMSB4Y is a Candidate Tumor Suppressor on the Y Chromosome and is Deleted in Male Breast Cancer", Oncotarget, 6(42):44927-44940.

Zhang et al. (2021) "Targeting Loss of Heterozygosity: A Novel Paradigm for Cancer Therapy", Pharmaceuticals, 14 (1):57.

Wang et al. (Oct. 2015) "Targeted Disruption of the 32-Microglobulin Gene Minimizes the Immunogenicity of Human Embryonic Stem Cells", Stem Cells Translational Medicine, 4(10):1234-1245.

Alcover et al. (Apr. 26, 2018) "Cell Biology of T Cell Receptor Expression and Regulation", Annual Review of Immunology, 36:103-125.

Campoli et al. (Oct. 6, 2008) "HLA Antigen Changes in Malignant Cells: Epigenetic Mechanisms and Biologic Significance", Oncogene, 27(45):5869-5885.

Chen et al. (Mar. 21, 2012) "Structural and Functional Distinctiveness of HLA-A2 Allelic Variants", Immunologic Research, 53:182-190.

Ellis et al. (Mar. 2000) "Frequencies of HLA-A2 alleles in five U.S. population groups: Predominance of A?02011 and identification of HLA-A?0231", Human Immunology, 61(3):334-340.

Harrer et al. (May 2018) "Chimeric Antigen Receptors in Different Cell Types: New Vehicles Join the Race", Human Gene Therapy, 29(5):547-558.

Maleno et al. (2002) "Multiple mechanisms generate HLA class I altered phenotypes in laryngeal carcinomas: high frequency of HLA haplotype loss associated with loss of heterozygosity in chromosome region 6p21", Cancer Immunology, Immunotherapy, 51(7):389-396.

McEvoy et al. (2002) "Frequency and Genetic Basis of MHC, beta-2-microglobulin and MEMO-1 Loss of Heterozygosity in Sporadic Breast Cancer", Tissue Antigens, 60(3):235-243.

Morgan et al. (Apr. 2010) "Case Report of a Serious Adverse Event Following the Administration of T Cells Transduced With a Chimeric Antigen Receptor Recognizing ERBB2", Molecular Therapy, 18(4):843-851.

Natali et al. (Sep. 1, 1989) Selective Changes in Expression of HLA Class I Polymorphic Determinants in Human Solid Tumors, Proceedings of the National Academy of Sciences of the United States of America, 86 (17):6719-6723.

Norell et al. (Jun. 15, 2006) "Frequent Loss of HLA-A2 Expression in Metastasizing Ovarian Carcinomas Associated with Genomic

(56) References Cited

OTHER PUBLICATIONS

Haplotype Loss and HLA-A2-Restricted HER-2/neu-Specific Immunity", Cancer Research, 66(12):6387-6394.
Skuljec et al. (Sep. 12, 2017) "Chimeric Antigen Receptor-Redirected Regulatory T Cells Suppress Experimental Allergic Airway Inflammation, a Model of Asthma", Frontiers in Immunology, Article 1125, 8:12 pages.
Sun et al. (Jun. 11, 2014) "Construction and Evaluation of a Novel Humanized HER2-Specific Chimeric Receptor", Breast Cancer Research, R61 16(3):10 pages.
Dong et al. (Jul. 9, 2020) "Rewired signaling network in T cells expressing the chimeric antigen receptor (CAR)", The EMBO Journal, 39(16):e104730.
Hudecek et al. (Feb. 2015) "The Nonsignaling Extracellular Spacer Domain of Chimeric Antigen Receptors is Decisive for in Vivo Antitumor Activity", Cancer Immunology Research, 3(2):125-135.
MacDonald et al. (Mar. 21, 2016) "Alloantigen-specific Regulatory T Cells Generated with a Chimeric Antigen Receptor", Journal of Clinical Investigation, 126(4):1413-1424.
Saverino et al. (Oct. 1, 2000) "The CD85/LIR-1/ILT2 Inhibitory Receptor Is Expressed by All Human T Lymphocytes and Down-Regulates Their Functions", Journal of Immunology, 165(7):3742-3755.
Sergeeva et al. (Nov. 16, 2008) "Direct Visualization of PR1/HLA-A2 on the Membrane of HLAA2+ CD13 +CD33+ Myeloid Leukemia Blasts by a Novel Monoclonal Antibody", Blood, 112(11):2545(2 pages).
Staub et al. (May 2004) "Systematic Identification of Immunoreceptor Tyrosine-based Inhibitory Motifs in the Human Proteome", Cellular Signalling, 16(4):435-456.
Stein et al. (May 1994) "The Cytoplasmic Domain of CD28 is Both Necessary and Sufficient for Costimulation of Interleukin-2 Secretion and Association With Phosphatidylinositol 3'-kinase", Molecular and Cellular Biology, 14(5):3392-3402.
Tao et al. (Sep. 13, 2020) "CD19-CAR-T Cells Bearing a KIR/PD-1-Based Inhibitory CAR Eradicate CD19 +HLA-C1—Malignant B Cells While Sparing CD19+HLA-C1+ Healthy B Cells", Cancer Immunology, 12:2612, 18 pages.

\* cited by examiner

FIG. 1

| CAR | Constructs | Binding Domain | Binding Domain Format | Hinge | Transmembrane Domain | First Intracellular Domain | Second Intracellular Domain | Third Intracellular Domain | Activity |
|---|---|---|---|---|---|---|---|---|---|
| CAR1 | CT292 | 4D5* | VL-VH | CD8 | CD8 | CD28 | 4-1BB | CD3z | yes |
| CAR4 | CT298 | 4D5 | VL-VH | Linker | CD8 | 4-1BB | - | CD3z | low |
| CAR3 | CT299 | 4D5 | VL-VH | IgG4(EQ) | CD8 | 4-1BB | - | CD3z | yes |
| CAR2 | CT297 | FRP5 | VH-VL | CD28 | CD28 | CD28 | - | CD3z | no |
|  | CT1094 | FRP5 | VH-VL | IgG1 | CD28 | CD28 | - | CD3z | yes |
|  | CT1095 | FRP5* | VH-VL | IgG1 | CD28 | CD28 | - | CD3z | yes |

FIG. 13

| | HeLa | | HCT.116 | | MS751 | |
|---|---|---|---|---|---|---|
| | Antigen density | A:B ratio | Antigen density | A:B ratio | Antigen density | A:B ratio |
| HLA-A02 | 842,273 | | 44,173 | | 45,013 | |
| HER2 | 21,198 | 1:40 | 9,517 | 1:4 | 19,965 | 1:2 |
| EGFR | 53,080 | 1:15 | 22,321 | 1:2 | 247,051 | 5:1 |

COMPOSITIONS AND METHODS FOR TREATING HER2 POSITIVE CANCERS

CROSS REFERENCE TO RELATED APPLICATIONS

This application is a continuation of and claims priority to the International Patent Application No. PCT/US2022/016582, filed Feb. 16, 2022 and entitled "Compositions and Methods for Treating HER2 Positive Cancers," which claims priority to and benefit of U.S. Provisional Application No. 63/149,952, filed on Feb. 16, 2021, the content of which are incorporated herein by reference in their entireties.

INCORPORATION BY REFERENCE OF SEQUENCE LISTING

The present application is being filed with a Sequence Listing in electronic format. The Sequence Listing is provided as a file entitled A2BI_035_01WO_Seq_List_ST25.txt, created on Feb. 16, 2022, and is 5,413,164 bytes in size. The information in electronic format of the Sequence Listing is incorporated by reference in its entirety.

BACKGROUND

Cell therapy is a powerful tool for the treatment of various diseases, particularly cancers. In conventional adoptive cell therapies, immune cells are engineered to express specific receptors, for example chimeric antigen receptors (CARs) or T cell receptors (TCRs), which direct the activity of the immune cells to cellular targets via interaction of the receptor with a ligand expressed by the target cell. Identification of suitable target molecules remains challenging, as many targets are expressed in normal tissues. One example of such as target is erb-b2 receptor tyrosine kinase 2 (ERBB2, or HER2), which is expressed on the surface of many solid tumors, as well as normal epithelial cells. This expression can lead to toxicity when the transplanted cells target normal tissues expressing HER2 target molecules. Clinical trials with HER2 CAR have shown serious adverse effects, and the only current antibody treatments that target HER2 are only effect for breast cancers with very high HER2 levels. There is thus a need in the art for compositions and methods useful in the treatment of disease, particularly cancers, by adoptive cell therapy.

SUMMARY

The disclosure provides an immune cell responsive to loss of heterozygosity in a cancer cell, comprising: (a) an activator receptor comprising an extracellular ligand binding domain specific to an erb-b2 receptor tyrosine kinase 2 (HER2) antigen; and (b) an inhibitory receptor comprising an extracellular ligand binding domain specific to a non-target antigen that is not expressed by the cancer cell due to a loss of heterozygosity in the cancer cell.

In some embodiments of the immune cells of the disclosure, the non-target antigen is an HLA class I allele or a minor histocompatibility antigen (MiHA). In some embodiments, the HLA class I allele comprises HLA-A, HLA-B, HLA-C or HLA-E. In some embodiments, the HLA class I allele is HLA-A*02.

In some embodiments of the immune cells of the disclosure, the target antigen is HER2 or a peptide antigen of HER2 in a complex with a major histocompatibility class I complex (MHC I).

In some embodiments of the immune cells of the disclosure, the cancer cell expresses HER2. In some embodiments, the cancer cell is a breast cancer cell, bladder cancer cell, ovarian cancer cell, gastric cancer cell, a salivary duct carcinoma cell, a non-small cell lung cancer cell, a pancreatic cancer cell, or a colon cancer cell. In some embodiments, the cancer cell is a breast cancer cell or gastric cancer cell.

In some embodiments of the immune cells of the disclosure, the HLA-A*02 non-target antigen is expressed by healthy cells of a subject. In some embodiments, healthy cells of the subject express both the target antigen and the HLA-A*02 non-target antigen. In some embodiments, the activator receptor and the inhibitory receptor together specifically activate the immune cell in the presence of the cancer cell.

In some embodiments of the immune cells of the disclosure, the immune cell is a T cell. In some embodiments, the T cell is a CD8+ CD4− T cell.

In some embodiments of the immune cells of the disclosure, the HER2 antigen comprises a sequence or subsequence at least 95% identical to a sequence or subsequence of any one of SEQ ID NOs: 2-29.

In some embodiments of the immune cells of the disclosure, the activator receptor is a T cell receptor (TCR) or a chimeric antigen receptor (CAR). In some embodiments, the extracellular ligand binding domain of the activator receptor comprises an antibody fragment, a single chain Fv antibody fragment (scFv), a β chain variable domain (Vβ), or a TCR α chain variable domain and a TCR β chain variable domain. In some embodiments, the extracellular ligand binding domain of the activator receptor comprises a heavy chain variable (VH) region and a light chain variable (VL) region. In some embodiments, the VH and VL regions comprise complement determining regions (CDRs) selected from the group consisting of SEQ ID NOS: 30-42. In some embodiments, the VH region comprises one or more CDR sequences selected from the group consisting of GFNIKDTYIH (SEQ ID NO: 36), ARIYPTNGYTRYADSVKG (SEQ ID NO: 38), and SRWGGDGFYAMD[Y/V] (SEQ ID NO: 40) or (SEQ ID NO: 41); and the VL region comprises one or more CDR sequences selected from the group consisting of RASQDVNTAVA (SEQ ID NO: 30), SASFLY (SEQ ID NO: 32), and QQHYTTPP (SEQ ID NO: 34). In some embodiments, the VH region comprises one or more CDR sequences selected from the group consisting of NYGMN (SEQ ID NO: 37), WINTSTGESTFADDFKG (SEQ ID NO: 39) and WEVYHGYVPY (SEQ ID NO: 42); and the VL region comprises one or more CDR sequences selected from the group consisting of KASQDVYNAVA (SEQ ID NO: 31), SASSRYT (SEQ ID NO: 33), and QQHFRTPFT (SEQ ID NO: 35). In some embodiments, the VH region comprises CDR sequences of GFNIKDTYIH (SEQ ID NO: 36), ARIYPTNGYTRYADSVKG (SEQ ID NO: 38), and SRWGGDGFYAMD[Y/V] (SEQ ID NO: 40) or (SEQ ID NO: 41); and the VL region comprises CDR sequences of RASQDVNTAVA (SEQ ID NO: 30), SASFLY (SEQ ID NO: 32) and QQHYTTPP (SEQ ID NO: 34). In some embodiments, the VH region comprises CDR sequences of NYGMN (SEQ ID NO: 37), WINTSTGESTFADDFKG (SEQ ID NO: 39) and WEVYHGYVPY (SEQ ID NO: 42); and the VL region comprises CDR sequences of KASQDVYNAVA (SEQ ID NO: 31), SASSRYT (SEQ ID NO: 33), and QQHFRTPFT (SEQ ID NO: 35). In some embodiments, the VH region comprises CDR sequences of DTYIH (SEQ ID NO: 313), RIYPTNGYTRYADSVKG (SEQ ID NO: 314), and WGGDGFYAMDV (SEQ ID NO: 315); and the VL region comprises CDR sequences of RASQDVNTAVA (SEQ ID NO: 30), SASFLYS (SEQ ID NO: 311), QQHYTTPPT (SEQ ID NO: 312), and DTYIH (SEQ ID NO: 313). In some embodiments, the scFv comprises a sequence having at least 85%, at least 90%, at least 95%, at least 97%, at least 99% identity or is identical to a sequence selected from the group consisting of SEQ ID NOS: 51, 53, 55, 57. 59 and 61.

In some embodiments of the immune cells of the disclosure, the CAR comprises a hinge sequence isolated or derived from CD8, CD28, IgG1, or IgG4, or a synthetic hinge. In some embodiments, the CAR comprises a transmembrane domain isolated or derived from CD8 or CD28. In some embodiments, the CAR comprises an intracellular domain isolated or derived from CD28, 4-1BB or CD3z, or a combination thereof.

In some embodiments of the immune cells of the disclosure, the inhibitory receptor comprises a TCR or CAR. In some embodiments, the extracellular ligand binding domain of the inhibitory receptor comprises an antibody fragment, a single chain Fv antibody fragment (scFv), a β chain variable domain (Vβ), or a TCR α chain variable domain and a TCR β chain variable domain. In some embodiments, the extracellular ligand binding domain of the inhibitory receptor comprises a heavy chain variable (VH) region and a light chain variable (VL) region. In some embodiments, the VH and VL regions comprise CDRs selected from the group consisting of SEQ ID NOS: 87-102. In some embodiments, the VH region comprises one or more CDRs selected from the group consisting of ASGYTFTSYHIH (SEQ ID NO: 95), WIYPGNVNTEYNEKFKGK (SEQ ID NO: 98) and EEITYAMDY (SEQ ID NO: 101), and the VL region comprises one or more CDRs selected from the group consisting of RSSQSIVHSNGNTYLE (SEQ ID NO: 87), KVSNRFSGVP[D/A]R (SEQ ID NO: 90) OR (SEQ ID NO: 91), and FQGSHVPRT (SEQ ID NO: 92). In some embodiments, the VH region comprises one or more CDRs selected from the group consisting of SGYTFTSYHMH (SEQ ID NO: 97), WIYPGDGSTQYNEKFKG (SEQ ID NO: 100) and EGTYYAMDY (SEQ ID NO: 102); and the VL region comprises one or more CDRs selected from the group consisting of RSSQSIVHSNGNTYLD (SEQ ID NO: 89), KVSNRFSGVP[D/A]R (SEQ ID NO: 90) OR (SEQ ID NO: 91) and MQGSHVPRT (SEQ ID NO: 94). In some embodiments, the scFv comprises a sequence having at least 85%, at least 90%, at least 95%, at least 97%, at least 99% identity or is identical to a sequence selected from the group consisting of SEQ ID NOS: 63-74, 207, 209 and 211. In some embodiments, the VH region comprises CDR sequences of SYHIH (SEQ ID NO: 566), WIYPGNVNTEYNEKFKG (SEQ ID NO: 567), and EEITYAMDY (SEQ ID NO: 101); and the VL region comprises CDR sequences of RSSQSIVHSNGNTYLE (SEQ ID NO: 87), KVSNRFS (SEQ ID NO: 565), and FQGSHVPRT (SEQ ID NO: 92).

In some embodiments of the immune cells of the disclosure, the inhibitory receptor comprises a LILRB1 intracellular domain or a functional variant thereof. In some embodiments, the inhibitory receptor comprises LILRB1 hinge and transmembrane domains, or functional variants thereof. In some embodiments, the inhibitory receptor comprises a sequence having at least 85%, at least 90%, at least 95%, at least 97%, at least 99% identity or is identical to (SEQ ID NO: 254)
YGSQSSKPYLLTHPSDPLELVVSGPSGGPSSPTTGPTSTSGPEDQPLTP -continued

TGSDPQSGLGRHLGVVIGILVAVILLLLLLLLLFLILRHRRQGKHWTST

QRKADFQHPAGAVGPEPTDRGLQWRSSPAADAQEENLYAAVKHTQPEDG

VEMDTRSPHDEDPQAVTYAEVKHSRPRREMASPPSPLSGEFLDTKDRQA

EEDRQMDTEAAASEAPQDVTYAQLHSLTLRREATEPPPSQEGPSPAVPS

IYATLAIH.

The disclosure provides a pharmaceutical composition, comprising a therapeutically effective amount of the immune cells of the disclosure. In some embodiments, the pharmaceutical composition further comprises a pharmaceutically acceptable carrier, diluent or excipient.

The disclosure provides a pharmaceutical composition comprising the immune cells of the disclosure, for use as a medicament in the treatment of cancer.

The disclosure provides a polynucleotide system, comprising one or more polynucleotides comprising polynucleotide sequences encoding: (a) an activator receptor comprising an extracellular ligand binding domain specific to an erb-b2 receptor tyrosine kinase 2 (HER2) antigen; and (b) an inhibitory receptor comprising an extracellular ligand binding domain specific to a non-target antigen that is not expressed by the cancer cell due to a loss of heterozygosity in the cancer cell.

The disclosure provides a vector, comprising the polynucleotide system of the disclosure.

The disclosure provides a method of treating a HER2+ cancer in a subject identified as having or suspected of having a loss of heterozygosity at an allele encoding a non-target antigen in the HER2+ cancer, comprising administering to the subject the immune cells or pharmaceutical composition of the disclosure.

The disclosure provides a method of making an immune cell therapy, comprising transforming immune cells with the polynucleotide system or vector of the disclosure.

The disclosure provides a kit comprising the immune cells or pharmaceutical compositions of the disclosure. In some embodiments, the kit further comprises instructions for use.

The disclosure also provides a method of selectively killing HER2-positive tumor cells having loss of heterozygosity at an allele encoding a non-target antigen in the HER2-positive cancer, comprising contacting the HER2-positive tumor cells with a composition or an immune cell the tumor cell is in a mixed culture. In some embodiments, the non-target antigen is selected from the group consisting of HLA-A*02, HLA-A*01, HLA-A*03, HLA-A*11, HLA-B*07, and HLA-C*07.

The disclosure also provides an immune cell comprising (a) an activator receptor comprising an extracellular ligand binding domain specific to an erb-b2 receptor tyrosine kinase 2 (HER2) antigen, wherein the extracellular ligand binding domain of the activator receptor comprises (i) a VH region comprising CDR sequences of DTYIH (SEQ ID NO: 313), RIYPTNGYTRYADSVKG (SEQ ID NO: 314), and WGGDGFYAMDV (SEQ ID NO: 315); and (ii) a VL region comprising CDR sequences of RASQDVNTAVA (SEQ ID NO: 30), SASFLYS (SEQ ID NO: 311), QQHYTTPPT (SEQ ID NO: 312), and DTYIH (SEQ ID NO: 313) region and a light chain variable (VL) region; and (b) an inhibitory receptor comprising an extracellular ligand binding domain specific to a non-target antigen that is not expressed by the cancer cell due to a loss of heterozygosity in the cancer cell, wherein the extracellular ligand binding domain of the inhibitory receptor comprises (i) a heavy chain variable (VH) region comprising CDR sequences of SYHIH (SEQ ID NO: 566), WIYPGNVNTEYNEKFKG (SEQ ID NO: 567), and EEITYAMDY (SEQ ID NO: 101); and (ii) a light chain variable (VL) region comprising of RSSQSIVHSNGNTYLE (SEQ ID NO: 87), KVSNRFS (SEQ ID NO: 565), and FQGSHVPRT (SEQ ID NO: 92).

The disclosure also provides an immune cell comprising (a) an activator receptor comprising an extracellular ligand binding domain specific to an erb-b2 receptor tyrosine kinase 2 (HER2) antigen, wherein the extracellular ligand binding domain of the activator receptor is an scFv comprising the sequence of SEQ ID NO: 51; and (b) an inhibitory receptor comprising an extracellular ligand binding domain specific to a non-target antigen that is not expressed by the cancer cell due to a loss of heterozygosity in the cancer cell, wherein the extracellular ligand binding domain of the inhibitory receptor is an scFv comprising the sequence of SEQ ID NO: 209.

The disclosure also provides a method of treating a HER2+ cancer in a subject identified as having or suspected of having loss of heterozygosity at an allele encoding HLA-A*02, comprising administering to the subject an immune cell comprising (a) an activator receptor comprising an extracellular ligand binding domain specific to an erb-b2 receptor tyrosine kinase 2 (HER2) antigen, wherein the extracellular ligand binding domain of the activator receptor comprises (i) a VH region comprising CDR sequences of DTYIH (SEQ ID NO: 313), RIYPTNGYTRYADSVKG (SEQ ID NO: 314), and WGGDGFYAMDV (SEQ ID NO: 315); and (ii) a VL region comprising CDR sequences of RASQDVNTAVA (SEQ ID NO: 30), SASFLYS (SEQ ID NO: 311), QQHYTTPPT (SEQ ID NO: 312), and DTYIH (SEQ ID NO: 313) region and a light chain variable (VL) region; and (b) an inhibitory receptor comprising an extracellular ligand binding domain specific to a non-target antigen that is not expressed by the cancer cell due to a loss of heterozygosity in the cancer cell, wherein the extracellular ligand binding domain of the inhibitory receptor comprises (i) a heavy chain variable (VH) region comprising CDR sequences of SYHIH (SEQ ID NO: 566), WIYPGNVNTEYNEKFKG (SEQ ID NO: 567), and EEITYAMDY (SEQ ID NO: 101); and (ii) a light chain variable (VL) region comprising of RSSQSIVHSNGNTYLE (SEQ ID NO: 87), KVSNRFS (SEQ ID NO: 565), and FQGSHVPRT (SEQ ID NO: 92).

The disclosure also provides a method of treating a HER2+ cancer in a subject identified as having or suspected of having loss of heterozygosity at an allele encoding HLA-A*02, comprising administering to the subject an immune cell comprising (a) an activator receptor comprising an extracellular ligand binding domain specific to an erb-b2 receptor tyrosine kinase 2 (HER2) antigen, wherein the extracellular ligand binding domain of the activator receptor is an scFv comprising the sequence of SEQ ID NO: 51; and (b) an inhibitory receptor comprising an extracellular ligand binding domain specific to a non-target antigen that is not expressed by the cancer cell due to a loss of heterozygosity in the cancer cell, wherein the extracellular ligand binding domain of the inhibitory receptor is an scFv comprising the sequence of SEQ ID NO: 209.

The disclosure also provides a method of selectively killing HER2-positive tumor cells having loss of heterozygosity at an allele encoding HLA-A*02, comprising contacting the HER2-positive tumor cells with an immune cell comprising an immune cell comprising (a) an activator receptor comprising an extracellular ligand binding domain specific to an erb-b2 receptor tyrosine kinase 2 (HER2) antigen, wherein the extracellular ligand binding domain of the activator receptor comprises (i) a VH region comprising CDR sequences of DTYIH (SEQ ID NO: 313), RIYPTNGYTRYADSVKG (SEQ ID NO: 314), and WGGDGFYAMDV (SEQ ID NO: 315); and (ii) a VL region comprising CDR sequences of RASQDVNTAVA (SEQ ID NO: 30), SASFLYS (SEQ ID NO: 311), QQHYTTPPT (SEQ ID NO: 312), and DTYIH (SEQ ID NO: 313) region and a light chain variable (VL) region; and (b) an inhibitory receptor comprising an extracellular ligand binding domain specific to a non-target antigen that is not expressed by the cancer cell due to a loss of heterozygosity in the cancer cell, wherein the extracellular ligand binding domain of the inhibitory receptor comprises (i) a heavy chain variable (VH) region comprising CDR sequences of SYHIH (SEQ ID NO: 566), WIYPGNVNTEYNEKFKG (SEQ ID NO: 567), and EEITYAMDY (SEQ ID NO: 101); and (ii) a light chain variable (VL) region comprising of RSSQSIVHSNGNTYLE (SEQ ID NO: 87), KVSNRFS (SEQ ID NO: 565), and FQGSHVPRT (SEQ ID NO: 92).

The disclosure also provides a method of selectively killing HER2-positive tumor cells having loss of heterozygosity at an allele encoding HLA-A*02, comprising contacting the HER2-positive tumor cells with an immune cell comprising an immune cell comprising (a) an activator receptor comprising an extracellular ligand binding domain specific to an erb-b2 receptor tyrosine kinase 2 (HER2) antigen, wherein the extracellular ligand binding domain of the activator receptor is an scFv comprising the sequence of SEQ ID NO: 51; and (b) an inhibitory receptor comprising an extracellular ligand binding domain specific to a non-target antigen that is not expressed by the cancer cell due to a loss of heterozygosity in the cancer cell, wherein the extracellular ligand binding domain of the inhibitory receptor is an scFv comprising the sequence of SEQ ID NO: 209.

BRIEF DESCRIPTION OF THE DRAWINGS

The patent or application file contains at least one drawing executed in color. Copies of this patent or patent application publication with color drawing(s) will be provided by the Office upon request and payment of the necessary fee.

A better understanding of the features and advantages of the present invention will be obtained by reference to the following detailed description that sets forth illustrative embodiments, in which the principles of the invention are utilized, and the accompanying drawings of which:

FIG. 1 is a table comparing the activity of different chimeric antigen receptors with that target HER2. FRP5* and 4D5* each have a single amino acid change in the VH domain compared to FRP5 and 4D5, respectively. IgG4 (EQ) has a mutated CH2 region to avoid Fc receptor binding. Linker sequence: GGGSSGGGSG (SEQ ID NO: 1).

FIG. 13 is a table summarizing the antigen density, and ratio of activator to blocker antigen, on HeLa, HCT.116 and MS751 target cells. Cell surface antigens were quantified using the Agilent QIFI Kit.

DETAILED DESCRIPTION

Figure 2A:
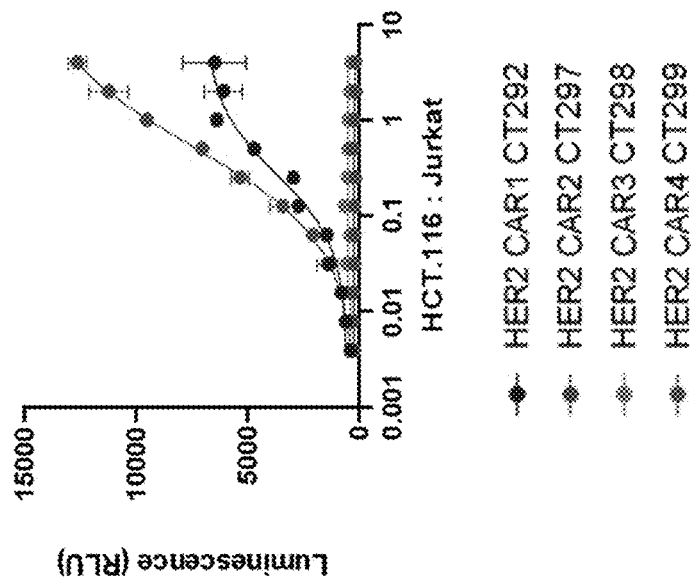
FIG. 2A is a plot showing HER2 activator EC50 in Jurkat cells, as measured by antigen titration on a solid substrate. HER2 CAR2 showed no activity.

The present disclosure describes engineered receptors, such as chimeric antigen receptors (CARs) and engineered T cell receptors (TCRs), adoptive cell therapies, and methods of use thereof. The engineered receptors can target the HER2 antigen and activate immune cells genetically altered to express the HER2 targeting receptor. Immune cells expressing the HER2 targeting activator receptors can be used in compositions as part of cell adoptive therapies in the treatment, for example, of cancers that are HER2 positive. The immune cells expressing the HER2 targeting activator receptors are also contemplated to further comprise a second inhibitory receptor. The second inhibitory receptor can prevent or inhibit the activation of an immune cell mediated by the activator receptor. For example, an immune cell expressing an activator receptor targeting HER2 and an inhibitory receptor that specifically binds a separate antigen, e.g. an MHC Class I antigen, will be activated in the presence of a cell expressing HER2, but will not be activated in the presence of a cell expressing both HER2 and the HLA Class I antigen that is the target of the inhibitory receptor. Selective activation and inhibition of the immune cell expressing both an activating and inhibitory receptors is useful for reducing toxicity in adoptive cell therapies. The inventors have found that this strategy can be employed using the HER2-targeting activator receptors and inhibitory receptors described herein. Both activating and inhibitory receptors can be, for example, chimeric antigen receptors (CARs) or T cell receptors (TCRs).

The term "chimeric antigen receptors" or "CARs" as used herein, may refer to artificial T-cell receptors, chimeric T-cell receptors, or chimeric immunoreceptors, for example, and encompass engineered receptors that graft an artificial specificity onto a particular immune effector cell, such as a helper T cell (CD4+), cytotoxic T cell (CD8+) or NK cell. CARs may be employed to impart the specificity of a monoclonal antibody onto a T cell, thereby allowing a large number of specific T cells to be generated, for example, for use in adoptive cell therapy. In specific embodiments, CARs direct specificity of the cell to a tumor associated antigen such as a HER2 antigen. In some embodiments, CARs comprise an intracellular signaling domain, a transmembrane domain, and an extracellular domain comprising an antigen-binding region. In some embodiments, CARs comprise fusions of single-chain variable fragments (scFvs) or scFabs derived from monoclonal antibodies, fused to a transmembrane domain and intracellular signaling domain(s). The fusion may also comprise a hinge. Either heavy-light (H-L) and light-heavy (L-H) scFvs may be used. The specificity of CAR designs may be derived from ligands of receptors (e.g., peptides). Depending on the type of intracellular domain, a CAR can be an activator receptor or an inhibitory receptor. In some embodiments, for example when the CAR is an activator receptor, the CAR comprises domains for additional co-stimulatory signaling, such as CD3, FcR, CD27, CD28, CD137, DAP10, and/or OX40. In some embodiments, molecules can be co-expressed with the CAR, including co-stimulatory molecules, reporter genes for imaging (e.g., for positron emission tomography), gene products that conditionally ablate the T cells upon addition of a pro-drug, homing receptors, cytokines, and cytokine receptors. As used herein, characteristics attributed to a chimeric antigen receptor may be understood to refer to the receptor itself or to a host cell comprising the receptor.

As used herein, a "TCR", sometimes also called a "TCR complex" or "TCR/CD3 complex" refers to a protein complex comprising a TCR alpha chain, a TCR beta chain, and one or more of the invariant CD3 chains (zeta, gamma, delta and epsilon), sometimes referred to as subunits. The TCR alpha and beta chains can be disulfide-linked to function as a heterodimer to bind to peptide-MHC complexes. Once the TCR alpha/beta heterodimer engages peptide-MHC, conformational changes in the TCR complex in the associated invariant CD3 subunits are induced, which leads to their phosphorylation and association with downstream proteins, thereby transducing a primary stimulatory signal. In an exemplary TCR complex, the TCR alpha and TCR beta polypeptides form a heterodimer, CD3 epsilon and CD3 delta form a heterodimer, CD3 epsilon and CD3 gamma for a heterodimer, and two CD3 zeta form a homodimer.

The term "stimulation" refers to a primary response induced by binding of a stimulatory domain or stimulatory molecule (e.g., a TCR/CD3 complex) with its cognate ligand thereby mediating a signal transduction event, such as, but not limited to, signal transduction via the TCR/CD3 complex. Stimulation can mediate altered expression of certain molecules, and/or reorganization of cytoskeletal structures, and the like.

The term "stimulatory molecule" or "stimulatory domain" refers to a molecule or portion thereof that, when natively expressed by a T-cell, provides the primary cytoplasmic signaling sequence(s) that regulate activation of the TCR complex in a stimulatory way for at least some aspect of the T-cell signaling pathway. TCR alpha and/or TCR beta chains of wild type TCR complexes do not contain stimulatory domains and require association with CD3 subunits such as CD3 zeta to initiate signaling. In one aspect, the primary stimulatory signal is initiated by, for instance, binding of a TCR/CD3 complex with an a major histocompatibility complex (MHC) bound to peptide, and which leads to mediation of a T-cell response, including, but not limited to, proliferation, activation, differentiation, and the like. One or more stimulatory domains, as described herein, can be fused to the intracellular portion of any one or more subunits of the TCR complex, including TCR alpha, TCR beta, CD3 delta, CD3 gamma and CD3 epsilon.

As used herein, a "domain capable of providing a stimulatory signal" refers to any domain that, either directly or indirectly, can provide a stimulatory signal that enhances or increases the effectiveness of signaling mediated by the TCR complex to enhance at least some aspect of T-cell signaling. The domain capable of providing a stimulatory signal can provide this signal directly, for example with the domain capable of providing the stimulatory signal is a primary stimulatory domain or co-stimulatory domain. Alternatively, or in addition, the domain capable of providing the stimulatory signal can act indirectly. For example, the domain can be a scaffold that recruits stimulatory proteins to the TCR, or provide an enzymatic activity, such as kinase activity, that acts through downstream targets to provide a stimulatory signal.

As used herein, a "domain capable of providing an inhibitory signal" refers to any domain that, either directly or indirectly, can provide an inhibitory signal that inhibits or decreases the effectiveness signaling mediated by the TCR complex. The domain capable of providing an inhibitory signal can reduce, or block, totally or partially, at least some aspect of T-cell signaling or function. The domain capable of providing an inhibitory signal can provide this signal directly, for example with the domain capable of providing the inhibitory signal provides a primary inhibitory signal. Alternatively, or in addition, the domain capable of providing the stimulatory signal can act indirectly. For example, the domain can recruit additional inhibitory proteins to the TCR, or can provide an enzymatic activity that acts through downstream targets to provide an inhibitory signal.

Ranges: throughout this disclosure, various aspects of the invention can be presented in a range format. It should be understood that the description in range format is merely for convenience and brevity and should not be construed as an inflexible limitation on the scope of the invention. Accordingly, the description of a range should be considered to have specifically disclosed all the possible subranges as well as individual numerical values within that range. For example, description of a range such as from 1 to 6 should be considered to have specifically disclosed subranges such as from 1 to 3, from 1 to 4, from 1 to 5, from 2 to 4, from 2 to 6, from 3 to 6 etc., as well as individual numbers within that range, for example, 1, 2, 2.7, 3, 4, 5, 5.3, and 6. As another example, a range such as 95-99% identity, includes something with 95%, 96%, 97%, 98% or 99% identity, and includes subranges such as 96-99%, 96-98%, 96-97%, 97-99%, 97-98% and 98-99% identity. This applies regardless of the breadth of the range.

In general, "sequence identity" or "sequence homology" refers to an exact nucleotide-to-nucleotide or amino acid-to-amino acid correspondence of two polynucleotides or polypeptide sequences, respectively. Typically, techniques for determining sequence identity include determining the nucleotide sequence of a polynucleotide and/or determining the amino acid sequence encoded thereby and comparing these sequences to a second nucleotide or amino acid sequence. Two or more sequences (polynucleotide or amino acid) can be compared by determining their "percent identity." The percent identity of two sequences, whether nucleic acid or amino acid sequences, is the number of exact matches between two aligned sequences divided by the length of the shorter sequences and multiplied by 100. Percent identity may also be determined, for example, by comparing sequence information using the advanced BLAST computer program, including version 2.2.9, available from the National Institutes of Health. The BLAST program is based on the alignment method of Karlin and Altschul, Proc. Natl. Acad. Sci. USA 87:2264-2268 (1990) and as discussed in Altschul, et al., J. Mol. Biol. 215:403-410 (1990); Karlin And Altschul, Proc. Natl. Acad. Sci. USA 90:5873-5877 (1993); and Altschul et al., Nucleic Acids Res. 25:3389-3402 (1997). Briefly, the BLAST program defines identity as the number of identical aligned symbols (generally nucleotides or amino acids), divided by the total number of symbols in the shorter of the two sequences. The program may be used to determine percent identity over the entire length of the proteins being compared. Default parameters are provided to optimize searches with short query sequences in, for example, with the blastp program. Ranges of desired degrees of sequence identity are approximately 80% to 100% and integer values therebetween. Typically, the percent identities between a disclosed sequence and a claimed sequence are at least 80%, at least 85%, at least 90%, at least 95%, or at least 98%.

As used herein, a "subsequence" refers to a length of contiguous amino acids or nucleotides that form a part of a sequence described herein. A subsequence may be identical to a part of a full length sequence when aligned to the full length sequence, or less than 100% identical to the part of the full length sequence to which it aligns (e.g., 90% identical to 50% of the full sequence, or the like).

The term "exogenous" is used herein to refer to any molecule, including nucleic acids, protein or peptides, small molecular compounds, and the like that originate from outside the organism. In contrast, the term "endogenous" refers to any molecule that originates from inside the organism (i.e., naturally produced by the organism).

A polynucleotide is "operably linked" to another polynucleotide when it is placed into a functional relationship with the other polynucleotide. For example, a promoter or enhancer is operably linked to a coding sequence if it affects the transcription of the sequence. A peptide is "operably linked" to another peptide when the polynucleotides encoding them are operably linked, preferably they are in the same open reading frame.

A "promoter" is a sequence of DNA needed to turn a gene on or off. Promoters are located immediately upstream and/or overlapping the transcription start site, and are usually between about one hundred to several hundred base pairs in length.

All publications and patents mentioned herein are hereby incorporated by reference in their entirety as if each individual publication or patent was specifically and individually indicated to be incorporated by reference. In case of conflict, the present application, including any definitions herein, will control. However, mention of any reference, article, publication, patent, patent publication, and patent application cited herein is not, and should not be taken as an acknowledgment, or any form of suggestion, that they constitute valid prior art or form part of the common general knowledge in any country in the world.

In the present description, any concentration range, percentage range, ratio range, or integer range is to be understood to include the value of any integer within the recited range and, when appropriate, fractions thereof (such as one tenth and one hundredth of an integer), unless otherwise indicated. The term "about", when immediately preceding a number or numeral, means that the number or numeral ranges plus or minus 10%.

Antigens

The activator receptors disclosed can specifically bind to an erb-b2 receptor tyrosine kinase 2 (HER2) antigen. The HER2 antigen, also known as Neu, ErbB2, and other aliases, is a receptor tyrosine kinase that, upon activation, forms homo- or heterodimers with other ErbB family members to promote intracellular signaling resulting in survival signals and proliferation. HER2 is overexpressed or has differential expression of splice variants and isoforms that contribute to the mechanisms driving various cancers, such as breast, lung, and other cancers.

In some embodiments, the target antigen is a peptide antigen of HER2 in a complex with a major histocompatibility class I complex (MHC I) or major histocompatibility class II complex (MHC II). In some embodiments, the HER2 peptide bound to MHC I comprises KIFGSLAFL (SEQ ID NO: 309). In some embodiments, the HER2 peptide bound to MHC II comprises GSPYVSRLLGICL (SEQ ID NO: 310). In some embodiments, the HER2 antigen comprises a sequence or subsequence at least 80%, at least 85%, at least 90%, at least 95%, at least 97%, at least 99% or is identical to a sequence or a subsequence of any one of SEQ ID NOs: 2-29. However, all HER2 isoforms, and sequences and subsequences thereof that act as HER2 antigens are envisaged as within the scope of the disclosure. In some embodiments, A HER2 antigen comprises a protein comprising a sequence any one of SEQ ID NOS: 2-29, or a peptide fragment of any one of SEQ ID NOS: 2-29. In some embodiments, the HER2 antigen comprises a peptide fragment of any one of SEQ ID NOS: 2-29 in a complex with a major histocompatibility class I complex (MHC-I).

Any cancer comprising a cancer cell that expresses a HER2 antigen is a HER2 positive (HER2+) cancer. In some embodiments, the cancer cell is a breast cancer cell, bladder cancer cell, ovarian cancer cell, gastric cancer cell, a salivary duct carcinoma cell, a non-small cell lung cancer cell, a pancreatic cancer cell, or a colon cancer cell. In some embodiments, the cancer cell is a breast cancer cell or gastric cancer cell.

Engineered Receptors

The disclosure provides an activator receptor and an inhibitory receptor, comprising an extracellular region, the extracellular region comprising a first ligand binding domain capable of specifically binding a first ligand that activates or promotes activation of the receptor, which promotes activation of effector cells expressing the receptor. The disclosure further provides an inhibitory receptor comprising a second ligand binding domain capable of binding a second ligand, wherein binding of the second ligand by the second ligand binding domain inhibits, reduces, or prevents activation of effector cells even in the presence of the first receptor bound to the first ligand. The first ligand may also be referred to as activator ligand. The second ligand may also be referred to as inhibitor ligand. The activator and inhibitory receptors that bind to these ligands may also be referred to generally herein as engineered receptors. Engineered receptors can refer to either chimeric antigen receptors (CARs) and T cell receptors (TCRs) described in the disclosure. Engineered receptor may also refer to any receptor designed using the binding domains, hinge regions, transmembrane domains, and/or cytoplasmic domains described herein. Engineered receptors are sometimes referred to herein as fusion proteins.

Activator Ligands

The disclosure provides a first ligand, an activator, and a first engineered receptor comprising the first ligand binding domain that binds to the first activator ligand. In some embodiments, the first engineered receptor is an activator receptor. In some embodiments, the activator receptor is a T cell receptor (TCR) or a chimeric antigen receptor (CAR). In some embodiments, the first activator ligand is a HER2 antigen. In some embodiments, the HER2 antigen comprises a sequence or subsequence that shares at least 80%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or is identical to a sequence or a subsequence of any one of SEQ ID NOs: 2-29. An Illustrative HER2 sequences is shown in Table 1.

TABLE 1

Illustrative HER2 sequence

| HER2 Antigen | Sequence |
|---|---|
| HER2 Isoform a | MELAALCRWGLLLALLPPGAASTQVCTGTDMKLRLPASPETHLDMLRHL YQGCQVVQGNLELTYLPTNASLSFLQDIQEVQGYVLIAHNQVRQVPLQRL RIVRGTQLFEDNYALAVLDNGDPLNNTTPVTGASPGGLRELQLRSLTEILK GGVLIQRNPQLCYQDTILWKDIFHKNNQLALTLIDTNRSRACHPCSPMCK GSRCWGESSEDCQSLTRTVCAGGCARCKGPLPTDCCHEQCAAGCTGPKH SDCLACLHFNHSGICELHCPALVTYNTDTFESMPNPEGRYTFGASCVTACP YNYLSTDVGSCTLVCPLHNQEVTAEDGTQRCEKCSKPCARVCYGLGMEH LREVRAVTSANIQEFAGCKKIFGSLAFLPESFDGDPASNTAPLQPEQLQVFE TLEEITGYLYISAWPDSLPDLSVFQNLQVIRGRILHNGAYSLTLQGLGISWL GLRSLRELGSGLALIHHNTHLCFVHTVPWDQLFRNPHQALLHTANRPEDE CVGEGLACHQLCARGHCWGPGPTQCVNCSQFLRGQECVEECRVLQGLPR EYVNARHCLPCHPECQPQNGSVTCFGPEADQCVACAHYKDPPFCVARCPS GVKPDLSYMPIWKFPDEEGACQPCPINCTHSCVDLDDKGCPAEQRASPLT SIISAVVGILLVVVLGVVFGILIKRRQQKIRKYTMRRLLQETELVEPLTPSG AMPNQAQMRILKETELRKVKVLGSGAFGTVYKGIWIPDGENVKIPVAIKV LRENTSPKANKEILDEAVVMAGVGSPYVSRLLGICLTSTVQLVTQLMPYG CLLDHVRENRGRLGSQDLLNWCMQIAKGMSYLEDVRLVHRDLAARNVL VKSPNHVKITDFGLARLLDIDETEYHADGGKVPIKWMALESILRRRFTHQS DVWSYGVTVWELMTFGAKPYDGIPAREIPDLLEKGERLPQPPICTIDVYMI MVKCWMIDSECRPRFRELVSEFSRMARDPQRFVVIQNEDLGPASPLDSTF YRSLLEDDDMGDLVDAEEYLVPQQGFFCPDPAPGAGGMVHHRHRSSSTR SGGGDLTLGLEPSEEEAPRSPLAPSEGAGSDVFDGDLGMGAAKGLQSLPT HDPSPLQRYSEDPTVPLPSETDGYVAPLTCSPQPEYVNQPDVRPQPPSPRE GPLPAARPAGATLERPKTLSPGKNGVVKDVFAFGGAVENPEYLTPQGGAA PQPHPPPAFSPAFDNLYYWDQDPPERGAPPSTFKGTPTAENPEYLGLDVPV (SEQ ID NO: 2) |

In some embodiments, the activator antigen is a peptide antigen of HER2 in a complex with a major histocompatibility class I complex (MHC I). In some embodiments, the activator antigen is a peptide antigen of HER2 that is not in a complex with a major histocompatibility class I complex (MHC I).

As used herein, an "activator" or "activator ligand" refers to a first ligand that binds to a first, activator ligand binding domain (LBD) of an engineered receptor of the disclosure, such as a CAR or TCR, thereby mediating activation of a T cell expressing the activator receptor. The activator ligand is expressed by target cells, for example cancer cells, and may also be expressed more broadly than just the target cells. For example the activator can be expressed on some, or all types of normal, non-target cells such as epithelial cells.

In some embodiments, the activator ligand is expressed by target cells and is not expressed by non-target cells (i.e. normal cells not targeted by the adoptive cell therapy). In some embodiments, the target cells are cancer cells and the non-target cells are non-cancerous cells.

In some embodiments, the activator ligand has high cell surface expression on the target cells. This high cell surface expression confers the ability to deliver large activation signals. Methods of measuring cell surface expression will be known to the person of ordinary skill in the art and include, but are not limited to, immunohistochemistry using an appropriate antibody against the activator ligand, followed by microscopy or fluorescence activated cell sorting (FACS).

The activator ligand is present on all target cells. In some embodiments, the target cells are cancer cells—such as HER2+ cancer cells, e.g., in HER2+ breast cancer.

In some embodiments, the activator ligand is present on a plurality of target cells. In some embodiments, the target cells are cancer cells. In some embodiments, the activator ligand is present on at least 50%, at least 60%, at least 70%, at least 80%, at least 85%, at least 90%, at least 95%, at least 96%, at least 97%, at least 98%, at least 99%, at least 99.5% or at least 99.9% of target cells. In some embodiments, the activator ligand is present on at least 95% target cells. In some embodiments, the activator ligand is present on at least 99% target cells.

In some embodiments, the first, activator ligand is expressed by a plurality of target cells and a plurality of non-target cells. In some embodiments, the plurality of non-target cells expresses both the first, activator ligand and the second inhibitor ligand.

In some embodiments, and the first, activator ligand and second, inhibitor ligand are present on the plurality of non-target target cells at a ratio of about 1:100 to about 100:1 of the first ligand to the second ligand. In some embodiments, and the first, activator ligand and second, inhibitor ligand are present on the plurality of non-target target cells at a ratio of about 1:50 to about 50:1 of the first ligand to the second ligand. In some embodiments, and the first, activator ligand and second, inhibitor ligand are present on the plurality of non-target target cells at a ratio of about 1:40 to about 40:1 of the first ligand to the second ligand. In some embodiments, and the first, activator ligand and second, inhibitor ligand are present on the plurality of non-target target cells at a ratio of about 1:30 to about 30:1 of the first ligand to the second ligand. In some embodiments, and the first, activator ligand and second, inhibitor ligand are present on the plurality of non-target target cells at a ratio of about 1:20 to about 2:1 of the first ligand to the second ligand. In some embodiments, and the first, activator ligand and second, inhibitor ligand are present on the plurality of non-target target cells at a ratio of about 1:10 to about 10:1 of the first ligand to the second ligand. In some embodiments, and the first, activator ligand and second, inhibitor ligand are present on the plurality of non-target target cells at a ratio of about 1:5 to about 5:1 of the first ligand to the second ligand. In some embodiments, and the first, activator ligand and second, inhibitor ligand are present on the plurality of non-target target cells at a ratio of about 1:3 to about 3:1 of the first ligand to the second ligand. In some embodiments, and the first, activator ligand and second, inhibitor ligand are present on the plurality of non-target target cells at a ratio of about 1:2 to about 2:1 of the first ligand to the second ligand. In some embodiments, and the first, activator ligand and second, inhibitor ligand are present on the plurality of non-target target cells at a ratio of about 1:1.

Extracellular Ligand Binding Domains

The disclosure provides chimeric antigen receptors (CARs) comprising a polypeptide. In some embodiments, the polypeptide comprises a ligand binding domain, such as an antigen-binding domain. Suitable antigen-binding domains include, but are not limited to antigen-binding domains from antibodies, antibody fragments, scFv, antigen-binding domains derived from T cell receptors, and the like. All forms of antigen-binding domains known in the art are envisaged as within the scope of the disclosure.

An "extracellular domain", as used herein, refers to the extracellular portion of a protein. For example, the TCR alpha and beta chains each comprise an extracellular domain, which comprise a constant and a variable region involved in peptide-MHC recognition. The "extracellular domain" can also comprise a fusion domain, for example of fusions between additional domains capable of binding to and targeting a specific antigen and the endogenous extracellular domain of the TCR subunit.

The term "antibody," as used herein, refers to a protein, or polypeptide sequences derived from an immunoglobulin molecule, which specifically binds to an antigen. Antibodies can be intact immunoglobulins of polyclonal or monoclonal origin, or fragments thereof and can be derived from natural or from recombinant sources.

The terms "antibody fragment" or "antibody binding domain" refer to at least one portion of an antibody, or recombinant variants thereof, that contains the antigen-binding domain, i.e., an antigenic determining variable region of an intact antibody, that is sufficient to confer recognition and specific binding of the antibody fragment to a target, such as an antigen and its defined epitope. Examples of antibody fragments include, but are not limited to, Fab, Fab', F(ab')2, and Fv fragments, single-chain (sc)Fv ("scFv") antibody fragments, linear antibodies, single domain antibodies (abbreviated "sdAb") (either VL or VH), camelid VHH domains, and multi-specific antibodies formed from antibody fragments.

The term "scFv" refers to a fusion protein comprising at least one antibody fragment comprising a variable region of a light chain and at least one antibody fragment comprising a variable region of a heavy chain, wherein the light and heavy chain variable regions are contiguously linked via a short flexible polypeptide linker, and capable of being expressed as a single polypeptide chain, and wherein the scFv retains the specificity of the intact antibody from which it is derived.

"Heavy chain variable region" or "VH" (or, in the case of single domain antibodies, e.g., nanobodies, "VHH") with regard to an antibody refers to the fragment of the heavy chain that contains three CDRs interposed between flanking stretches known as framework regions, these framework regions are generally more highly conserved than the CDRs and form a scaffold to support the CDRs.

Unless specified, as used herein a scFv may have the VL and VH variable regions in either order, e.g., with respect to the N-terminal and C-terminal ends of the polypeptide, the scFv may comprise VL-linker-VH or may comprise VH-linker-VL.

The term "antibody light chain," refers to the smaller of the two types of polypeptide chains present in antibody molecules in their naturally occurring conformations. Kappa ("κ") and lambda ("λ") light chains refer to the two major antibody light chain isotypes.

The term "recombinant antibody" refers to an antibody that is generated using recombinant DNA technology, such as, for example, an antibody expressed by a bacteriophage or yeast expression system. The term should also be construed to mean an antibody which has been generated by the synthesis of a DNA molecule encoding the antibody and which DNA molecule expresses an antibody protein, or an amino acid sequence specifying the antibody, wherein the DNA or amino acid sequence has been obtained using recombinant DNA or amino acid sequence technology which is available and well known in the art.

In some embodiments, for example those embodiments wherein the receptor comprises a first and a second polypeptide, the antigen-binding domain is isolated or derived from a T cell receptor (TCR) extracellular domain or an antibody.

In some embodiments, the extracellular ligand binding domain of the activator receptor comprises an antibody fragment, a single chain Fv antibody fragment (scFv), a β chain variable domain (Vβ), or a TCR α chain variable domain and a TCR β chain variable domain. In some embodiments, the extracellular ligand binding domain of the activator receptor comprises a heavy chain variable (VH) region and a light chain variable (VL) region. In some embodiments, the VH and VL regions comprise complement determining regions (CDRs) selected from the group of CDRs disclosed in Table 2.

In some embodiments, the VH region comprises CDR sequences of GFNIKDTYIH (SEQ ID NO: 36), ARIYPTNGYTRYADSVKG (SEQ ID NO: 38), and SRWGGDGFYAMDY (SEQ ID NO: 40) or SRWGGDGFYAMDV (SEQ ID NO: 41); and the VL region comprises CDR sequences of RASQDVNTAVA (SEQ ID NO: 30), SASFLY (SEQ ID NO: 32) and QQHYTTPP (SEQ ID NO: 34).

In some embodiments, the VH region comprises CDR sequences of NYGMN (SEQ ID NO: 37), WINTSTGESTFADDFKG (SEQ ID NO: 39) and WEVYHGYVPY (SEQ ID NO: 42); and the VL region comprises CDR sequences of KASQDVYNAVA (SEQ ID NO: 31), SASSRYT (SEQ ID NO: 33), and QQHFRTPFT (SEQ ID NO: 35).

In some embodiments, the VH region comprises CDR sequences DTYIH (SEQ ID NO: 313), RIYPTNGYTRYADSVKG (SEQ ID NO: 314), and WGGDGFYAMDV (SEQ ID NO: 315); and the VL region comprises CDR sequences of RASQDVNTAVA (SEQ ID NO: 30), SASFLYS (SEQ ID NO: 311), and QQHYTTPPT (SEQ ID NO: 312).

In some embodiments, the full length VH and VL regions comprise the sequences disclosed in Table 3. In some embodiments, the binding domain comprises the full length

TABLE 2

HER2 antigen binding domain complement determining regions (CDRs)

| CDR-L1 | CDR-L2 | CDR-L3 | CDR-H1 | CDR-H2 | CDR-H3 |
| --- | --- | --- | --- | --- | --- |
| RASQDVNTAVA (SEQ ID NO: 30) | SASFLY (SEQ ID NO: 32) | QQHYTTPP (SEQ ID NO: 34) | GFNIKDTYIH (SEQ ID NO: 36) | ARIYPTNGYTRYADSVKG (SEQ ID NO: 38) | SRWGGDGFYAMDY (SEQ ID NO: 40) |
| RASQDVNTAVA (SEQ ID NO: 30) | SASFLY (SEQ ID NO: 32) | QQHYTTPP (SEQ ID NO: 34) | GFNIKDTYIH (SEQ ID NO: 36) | ARIYPTNGYTRYADSVKG (SEQ ID NO: 38) | SRWGGDGFYAMDV (SEQ ID NO: 41) |
| KASQDVYNAVA (SEQ ID NO: 31) | SASSRYT (SEQ ID NO: 33) | QQHFRTPFT (SEQ ID NO: 35) | NYGMN (SEQ ID NO: 37) | WINTSTGESTFADDFKG (SEQ ID NO: 39) | WEVYHGYVPY (SEQ ID NO: 42) |
| RASQDVNTAVA (SEQ ID NO: 30) | SASFLYS (SEQ ID NO: 311) | QQHYTTPPT (SEQ ID NO: 312) | DTYIH (SEQ ID NO: 313) | RIYPTNGYTRYADSVKG (SEQ ID NO: 314) | WGGDGFYAMDV (SEQ ID NO: 315) |

In some embodiments, the VH region comprises one or more CDR sequences selected from the group consisting of GFNIKDTYIH (SEQ ID NO: 36), ARIYPTNGYTRYADSVKG (SEQ ID NO: 38), and SRWGGDGFYAMD[Y/V] (SEQ ID NO: 40) or (SEQ ID NO: 41); and the VL region comprises one or more CDR sequences selected from the group consisting of RASQDVNTAVA (SEQ ID NO: 30), SASFLY (SEQ ID NO: 32), and QQHYTTPP (SEQ ID NO: 34).

In some embodiments, the VH region comprises one or more CDR sequences selected from the group consisting of NYGMN (SEQ ID NO: 37), WINTSTGESTFADDFKG (SEQ ID NO: 39) and WEVYHGYVPY (SEQ ID NO: 42); and the VL region comprises one or more CDR sequences selected from the group consisting of KASQDVYNAVA (SEQ ID NO: 31), SASSRYT (SEQ ID NO: 33), and QQHFRTPFT (SEQ ID NO: 35).

VH region and VL regions on a single polypeptide. In some embodiments, the polypeptide comprises from N-terminal to C-terminal the full length VH regions and the full length VL region. In some embodiments, the polypeptide comprises from N-terminal to C-terminal the full length VL region and the full length VH region. In some embodiments, the full length VH and VL comprises the sequence selected from Table 3. In some embodiments, the binding domain comprises SEQ ID NO: 43 and SEQ ID NO: 44. In some embodiments, the binding domain comprises SEQ ID NO: 45 and SEQ ID NO: 46. In some embodiments, the binding domain comprises SEQ ID NO: 47 and SEQ ID NO: 48. In some embodiments, the binding domain comprises SEQ ID NO: 45 and SEQ ID NO: 49. In some embodiments, the binding domain comprises SEQ ID NO: 50 and SEQ ID NO: 49.

TABLE 3

VH and VL Domains for HER2 CAR Constructs

| Construct and Orientation | VH Full Length | VL Full Length |
|---|---|---|
| CT-292 (VL-VH) | EVQLVESGGGLVQPGGSLRLSCA ASGFNIKDTYIHWVRQAPGKGLE WVARIYPTNGYTRYADSVKGRF TISADTSKNTAYLQMNSLRAEDT AVYYCSRWGGDGFYAMDVWG QGTLVTVSSAAA (SEQ ID NO: 43) | DIQMTQSPSSLSASVGDRVTITCR ASQDVNTAVAWYQQKPGKAPK LLIYSASFLYSGVPSRFSGSRSGT DFTLTISSLQPEDFATYYCQQHY TTPPTFGQGTKVEIKRT (SEQ ID NO: 44) |
| CT-297 (VH-VL) | QVQLQQSGPELKKPGETVKISCK ASGYPFTNYGMNWVKQAPGQG LKWMGWINTSTGESTFADDFKG RFDFSLETSANTAYLQINNLKSE DSATYFCARWEVYHGYVPYWG QGTTVTVSS (SEQ ID NO: 45) | DIQLTQSHKFLSTSVGDRVSITCK ASQDVYNAVAWYQQKPGQSPK LLIYSASSRYTGVPSRFTGSGSGP DFTFTISSVQAEDLAVYFCQQHF RTPFTFGSGTKLEIK (SEQ ID NO: 49) |
| CT-298 (VL-VH) | EVQLVESGGGLVQPGGSLRLSCA ASGFNIKDTYIHWVRQAPGKGLE WVARIYPTNGYTRYADSVKGRF TISADTSKNTAYLQMNSLRAEDT AVYYCSRWGGDGFYAMDYWG QGTLVTVSS (SEQ ID NO: 47) | DIQMTQSPSSLSASVGDRVTITCR ASQDVNTAVAWYQQKPGKAPK LLIYSASFLYSGVPSRFSGSRSGT DFTLTISSLQPEDFATYYCQQHY TTPPTFGQGTKVEIK (SEQ ID NO: 48) |
| CT-299 (VL-VH) | EVQLVESGGGLVQPGGSLRLSCA ASGFNIKDTYIHWVRQAPGKGLE WVARIYPTNGYTRYADSVKGRF TISADTSKNTAYLQMNSLRAEDT AVYYCSRWGGDGFYAMDYWG QGTLVTVSS (SEQ ID NO: 47) | DIQMTQSPSSLSASVGDRVTITCR ASQDVNTAVAWYQQKPGKAPK LLIYSASFLYSGVPSRFSGSRSGT DFTLTISSLQPEDFATYYCQQHY TTPPTFGQGTKVEIK (SEQ ID NO: 48) |
| CT-1094 (VH-VL) | QVQLQQSGPELKKPGETVKISCK ASGYPFTNYGMNWVKQAPGQG LKWMGWINTSTGESTFADDFKG RFDFSLETSANTAYLQINNLKSE DSATYFCARWEVYHGYVPYWG QGTTVTVSS (SEQ ID NO: 45) | DIQLTQSHKFLSTSVGDRVSITCK ASQDVYNAVAWYQQKPGQSPK LLIYSASSRYTGVPSRFTGSGSGP DFTFTISSVQAEDLAVYFCQQHF RTPFTFGSGTKLEIK (SEQ ID NO: 49) |
| CT-1095 VH-VL | QVQLQQSGPELKKPGETVKISCK ASGYPFTNYGMNWVKQAPGQG LKWMGWINTSTGESTFADDFKG RFDFSLETSANTAYLQINNLKSE DMATYFCARWEVYHGYVPYWG QGTTVTVSS (SEQ ID NO: 50) | DIQLTQSHKFLSTSVGDRVSITCK ASQDVYNAVAWYQQKPGQSPK LLIYSASSRYTGVPSRFTGSGSGP DFTFTISSVQAEDLAVYFCQQHF RTPFTFGSGTKLEIK (SEQ ID NO: 49) |

In some embodiments, the binding domain is a HER2 scFv domain. In some embodiments, the HER2 scFv domain is selected from a sequence listed in Table 4. In some embodiments, the HER2 scFv domain comprises a polypeptide comprising SEQ ID NO: 51. In some embodiments, the HER2 scFv domain is encoded by a polynucleotide sequence comprising SEQ ID NO: 52. In some embodiments, the HER2 scFv domain comprises a polypeptide comprising SEQ ID NO: 53. In some embodiments, the HER2 scFv domain is encoded by a polynucleotide sequence comprising SEQ ID NO: 54. In some embodiments, the HER2 scFv domain comprises a polypeptide comprising SEQ ID NO: 55. In some embodiments, the HER2 scFv domain is encoded by a polynucleotide sequence comprising SEQ ID NO: 56. In some embodiments, the HER2 scFv domain comprises a polypeptide comprising SEQ ID NO: 57. In some embodiments, the HER2 scFv domain is encoded by a polynucleotide sequence comprising SEQ ID NO: 58. In some embodiments, the HER2 scFv domain comprises a polypeptide comprising SEQ ID NO: 59. In some embodiments, the HER2 scFv domain is encoded by a polynucleotide sequence comprising SEQ ID NO: 60. In some embodiments, the HER2 scFv domain comprises a polypeptide comprising SEQ ID NO: 61. In some embodiments, the HER2 scFv domain is encoded by a polynucleotide sequence comprising SEQ ID NO: 62. In some embodiments, the HER2 scFv domain is encoded by a polynucleotide sequence comprising SEQ ID NO: 21803.

TABLE 4

HER2 ScFv Domains for HER2 CAR Constructs

| HER2 CAR | Protein Sequence | DNA Sequence |
|---|---|---|
| CT292 (VL-VH) | MDFQVQIFSFLLI SASVIMSRGDIQ MTQSPSSLSASV | ATGGATTTTCAGGTGCAGATTTTCAGCTTCCTGCT AATCAGTGCCTCAGTCATAATGTCCAGAGGAGAT ATCCAGATGACCCAGTCCCCGAGCTCCCTGTCCGC |

TABLE 4-continued

HER2 ScFv Domains for HER2 CAR Constructs

| HER2 CAR | Protein Sequence | DNA Sequence |
|---|---|---|
| | GDRVTITC<u>RASQ</u> <u>DVNTAVA</u>WYQQ KPGKAPKLLIY<u>S</u> <u>ASFLYS</u>GVPSRFS GSRSGTDFTLTIS SLQPEDFATYYC <u>QQHYTTPPT</u>FGQ GTKVEIKRTGST SGSGKPGSGEGS EVQLVESGGGLV QPGGSLRLSCAA SGFNIK<u>DTYIH</u>W VRQAPGKGLEW VA<u>RIYPTNGYTR</u> <u>YADSVKG</u>RFTIS ADTSKNTAYLQ MNSLRAEDTAV YYCSR<u>WGGDGF</u> <u>YAMDV</u>WGQGTL VTVSSAAA (SEQ ID NO: 51) | CTCTGTGGGCGATAGGGTCACCATCACCTGCCGTG CCAGTCAGGATGTGAATACTGCTGTAGCCTGGTAT CAACAGAAACCAGGAAAAGCTCCGAAACTACTGA TTTACTCGGCATCCTTCCTTTATTCTGGAGTCCCTT CTCGCTTCTCTGGATCTAGATCTGGGACGGATTTC ACTCTGACCATCAGCAGTCTGCAGCCGGAAGACT TCGCAACTTATTACTGTCAGCAACATTATACTACT CCTCCCACGTTCGGACAGGGTACCAAGGTGGAGA TCAAACGCACTGGGTCTACATCTGGATCTGGGAA GCCGGGTTCTGGTGAGGGTTCTGAGGTTCAGCTG GTGGAGTCTGGCGGTGGCCTGGTGCAGCCAGGGG GCTCACTCCGTTGTCCTGTGCAGCTTCTGGCTTC AACATTAAAGACACCTATATACACTGGGTGCGTC AGGCCCCGGGTAAGGGCCTGGAATGGGTTGCAAG GATTTATCCTACGAATGGTTATACTAGATATGCCG ATAGCGTCAAGGGCCGTTTCACTATAAGCGCAGA CACATCCAAAAACACAGCCTACCTGCAGATGAAC AGCCTGCGTGCTGAGGACACTGCCGTCTATTATTG TTCTAGATGGGGAGGGGACGGCTTCTATGCTATG GACGTGTGGGGTCAAGGAACCCTGGTCACCGTCT CCTCGGCGGCCGCA (SEQ ID NO: 52) |
| CT297 (VH-VL) | MDMRVPAQLLG LLLLWLRGARC QVQLQQSGPELK KPGETVKISCKA SGYPFT<u>NYGMN</u> WVKQAPGQGLK WMGW<u>INTSTGE</u> <u>STFADDFKGR</u>FD FSLETSANTAYL QINNLKSEDSAT YFCAR<u>WEVYHG</u> <u>YVPY</u>WGQGTTV TVSSGGGGSGGG GSGGGGSDIQLT QSHKFLSTSVGD RVSITC<u>KASQDV</u> <u>YNAVA</u>WYQQKP GQSPKLLIY<u>SASS</u> <u>RYT</u>GVPSRFTGS GSGPDFTFTISSV QAEDLAVYFCQ <u>QHFRTPFT</u>FGSG TKLEIK (SEQ ID NO: 53) | ATGGACATGAGGGTCCCCGCTCAGCTCCTGGGGC TCCTGCTACTCTGGCTCCGAGGTGCCAGATGTCAG GTACAACTGCAGCAGTCAGGACCTGAACTGAAGA AGCCTGGAGAGACAGTCAAGATCTCCTGCAAGGC CTCTGGGTATCCTTTCACAAACTATGGAATGAACT GGGTGAAGCAGGCTCCAGGACAGGGTTTAAAGTG GATGGGCTGGATTAACACCTCCACTGGAGAGTCA ACATTTGCTGATGACTTCAAGGGACGGTTTGACTT CTCTTTGGAAACCTCTGCCAACACTGCCTATTTGC AGATCAACAACTCAAAAGTGAAGACTCGGCTAC ATATTTCTGTGCAAGATGGGAGGTTTACCACGGCT ACGTTCCTTACTGGGGCCAAGGGACCACGGTCAC CGTTTCCTCTGGCGGTGGCGGTTCTGGTGGCGGTG GCTCCGGCGGTGGCGGTTCTGACATCCAGCTGAC CCAGTCTCACAAATTCCTGTCCACTTCAGTAGGAG ACAGGGTCAGCATCACCTGCAAGGCCAGTCAGGA TGTGTATAATGCTGTTGCCTGGTATCAACAGAAAC CAGGACAATCTCCTAAACTTCTGATTTACTCGGCA TCCTCCCGGTACACTGGAGTCCCTTCTCGCTTCAC TGGCAGTGGCTCTGGGCCGGATTTCACTTTCACCA TCAGCAGTGTGCAGGCTGAAGACCTGGCAGTTTA TTTCTGTCAGCAACATTTTCGTACTCCATTCACGTT CGGCTCGGGGACAAAATTGGAGATCAAA (SEQ ID NO: 54) |
| CT298 (VL-VH) | MLLLVTSLLLCE LPHPAFLLIPDIQ MTQSPSSLSASV GDRVTITC<u>RASQ</u> <u>DVNTAVA</u>WYQQ KPGKAPKLLIY<u>S</u> <u>ASFLYS</u>GVPSRFS GSRSGTDFTLTIS SLQPEDFATYYC <u>QQHYTTPPT</u>FGQ GTKVEIKGSTSG GGSGGGSGGGG SSEVQLVESGGG LVQPGGSLRLSC AAS<u>GFNIKDTYI</u> <u>H</u>WVRQAPGKGL EWVA<u>RIYPTNGY</u> <u>TRYADSVKG</u>RFT ISADTSKNTAYL QMNSLRAEDTA VYYC<u>SRWGGDG</u> <u>FYAMDY</u>WGQGT LVTVSS (SEQ ID NO: 55) | ATGCTGCTACTGGTCACCAGTCTACTGCTGTGCGA ACTGCCACATCCGGCCTTCCTGCTAATACCGGATA TCCAGATGACCCAGTCCCCGAGCTCCCTGTCCGCC TCTGTGGGCGATAGGGTCACCATCACCTGCCGTGC CAGTCAGGATGTGAATACTGCTGTAGCCTGGTATC AACAGAAACCAGGAAAAGCTCCGAAACTACTGAT TTACTCGGCATCCTTCCTTTATTCTGGAGTCCCTTC TCGCTTCTCTGGATCTAGATCTGGGACGGATTTCA CTCTGACCATCAGCAGTCTGCAGCCGGAAGACTT CGCAACTTATTACTGTCAGCAACATTATACTACTC CTCCCACGTTCGGACAGGGTACCAAGGTGGAGAT CAAAGGGTCTACATCTGGCTGGCTCTGGTGGC GGTTCCGGCGGTGGCGGTTCTTCCGAGGTTCAGCT GGTGGAGTCTGGCGGTGGCCTGGTGCAGCCAGGG GGCTCACTCCGTTTGTCCTGTGCAGCTTCTGGCTT CAACATTAAAGACACCTATATACACTGGGTGCGT CAGGCCCCGGGTAAGGGCCTGGAATGGGTTGCAA GGATTTATCCTACGAATGGTTATACTAGATATGCC GATAGCGTCAAGGGCCGTTTCACTATAAGCGCAG ACACATCCAAAAACACAGCCTACCTGCAGATGAA CAGCCTGCGTGCTGAGGACACTGCCGTCTATTATT GTTCTAGATGGGGAGGGGACGGCTTCTATGCTAT GGACTATTGGGGTCAAGGAACCCTGGTCACCGTC TCCTCG (SEQ ID NO: 56) |
| CT299 (VL-VH) | MLLLVTSLLLCE LPHPAFLLIPDIQ MTQSPSSLSASV | ATGCTGCTACTGGTCACCAGTCTACTGCTGTGCGA ACTGCCACATCCGGCCTTCCTGCTAATACCGGATA TCCAGATGACCCAGTCCCCGAGCTCCCTGTCCGCC |

TABLE 4-continued

HER2 ScFv Domains for HER2 CAR Constructs

| HER2 CAR | Protein Sequence | DNA Sequence |
|---|---|---|
| | GDRVTITCRASQ DVNTAVAWYQQ KPGKAPKLLIYS ASFLYSGVPSRFS GSRSGTDFTLTIS SLQPEDFATYYC QQHYTTPPTFGQ GTKVEIKGSTSG GGSGGGSGGGG SSEVQLVESGGG LVQPGGSLRLSC AASGFNIKDTYI HWVRQAPGKGL EWVARIYPTNGY TRYADSVKGRFT ISADTSKNTAYL QMNSLRAEDTA VYYCSRWGGDG FYAMDYWGQGT LVTVSS (SEQ ID NO: 57) | TCTGTGGGCGATAGGGTCACCATCACCTGCCGTGC CAGTCAGGATGTGAATACTGCTGTAGCCTGGTATC AACAGAAACCAGGAAAAGCTCCGAAACTACTGAT TTACTCGGCATCCTTCCTTTATTCTGGAGTCCCTTC TCGCTTCTCTGGATCTAGATCTGGGACGGATTTCA CTCTGACCATCAGCAGTCTGCAGCCGGAAGACTT CGCAACTTATTACTGTCAGCAACATTATACTACTC CTCCCACGTTCGGACAGGGTACCAAGGTGGAGAT CAAAGGGTCTACATCTGGCGGTGGCTCTGGTGGC GGTTCCGGCGGTGGCGGTTCTTCCGAGGTTCAGCT GGTGGAGTCTGGCGGTGGCCTGGTGCAGCCAGGG GGCTCACTCCGTTTGTCCTGTGCAGCTTCTGGCTT CAACATTAAAGACACCTATATACACTGGGTGCGT CAGGCCCCGGGTAAGGGCCTGGAATGGGTTGCAA GGATTTATCCTACGAATGGTTATACTAGATATGCC GATAGCGTCAAGGGCCGTTTCACTATAAGCGCAG ACACATCCAAAAACACAGCCTACCTGCAGATGAA CAGCCTGCGTGCTGAGGACACTGCCGTCTATTATT GTTCTAGATGGGGAGGGGACGGCTTCTATGCTAT GGACTATTGGGGTCAAGGAACCCTGGTCACCGTC TCCTCG (SEQ ID NO: 58) |
| CT1094 (VH-VL) | MDMRVPAQLLG LLLLWLRGARC QVQLQQSGPELK KPGETVKISCKA SGYPFTNYGMN WVKQAPGQGLK WMGWINTSTGE STFADDFKGRFD FSLETSANTAYL QINNLKSEDSAT YFCARWEVYHG YVPYWGQGTTV TVSSGGGGSGGG GSGGGGSDIQLT QSHKFLSTSVGD RVSITCKASQDV YNAVAWYQQKP GQSPKLLIYSASS RYTGVPSRFTGS GSGPDFTFTISSV QAEDLAVYFCQ QHFRTPFTFGSG TKLEIK (SEQ ID NO: 59) | ATGGACATGAGGGTCCCCGCTCAGCTCCTGGGGC TCCTGCTACTCTGGCTCCGAGGTGCCAGATGTCAG GTACAACTGCAGCAGTCAGGACCTGAACTGAAGA AGCCTGGAGAGACAGTCAAGATCTCCTGCAAGGC CTCTGGGTATCCTTTCACAAACTATGGAATGAACT GGGTGAAGCAGGCTCCAGGACAGGGTTTAAAGTG GATGGGCTGGATTAACACCTCCACTGGAGAGTCA ACATTTGCTGATGACTTCAAGGGACGGTTTGACTT CTCTTTGGAAACCTCTGCCAACACTGCCTATTTGC AGATCAACAACCTCAAAAGTGAAGACTCGGCTAC ATATTTCTGTGCAAGATGGGAGGTTTACCACGGCT ACGTTCCTTACTGGGGCCAAGGGACCACGGTCAC CGTTTCCTCTGGCGGTGGCGGTTCTGGTGGCGGTG GCTCCGGCGGTGGCGGTTCTGACATCCAGCTGAC CCAGTCTCACAAATTCCTGTCCACTTCAGTAGGAG ACAGGGTCAGCATCACCTGCAAGGCCAGTCAGGA TGTGTATAATGCTGTTGCCTGGTATCAACAGAAAC CAGGACAATCTCCTAAACTTCTGATTTACTCGGCA TCCTCCCGGTACACTGGAGTCCCTTCTCGCTTCAC TGGCAGTGGCTCTGGGCCGGATTTCACTTTCACCA TCAGCAGTGTGCAGGCTGAAGACCTGGCAGTTTA TTTCTGTCAGCAACATTTTCGTACTCCATTCACGTT CGGCTCGGGGACAAAATTGGAGATCAAA (SEQ ID NO: 60) |
| CT1095 (VH-VL) | MDMRVPAQLLG LLLLWLRGARC QVQLQQSGPELK KPGETVKISCKA SGYPFTNYGMN WVKQAPGQGLK WMGWINTSTGE STFADDFKGRFD FSLETSANTAYL QINNLKSEDMAT YFCARWEVYHG YVPYWGQGTTV TVSSGGGGSGGG GSGGGGSDIQLT QSHKFLSTSVGD RVSITCKASQDV YNAVAWYQQKP GQSPKLLIYSASS RYTGVPSRFTGS GSGPDFTFTISSV QAEDLAVYFCQ QHFRTPFTFGSG TKLEIK (SEQ ID NO: 61) | ATGGACATGAGGGTCCCCGCTCAGCTCCTGGGGC TCCTGCTACTCTGGCTCCGAGGTGCCAGATGTCAG GTACAACTGCAGCAGTCAGGACCTGAACTGAAGA AGCCTGGAGAGACAGTCAAGATCTCCTGCAAGGC CTCTGGGTATCCTTTCACAAACTATGGAATGAACT GGGTGAAGCAGGCTCCAGGACAGGGTTTAAAGTG GATGGGCTGGATTAACACCTCCACTGGAGAGTCA ACATTTGCTGATGACTTCAAGGGACGGTTTGACTT CTCTTTGGAAACCTCTGCCAACACTGCCTATTTGC AGATCAACAACCTCAAAAGTGAAGACATGGCTAC ATATTTCTGTGCAAGATGGGAGGTTTACCACGGCT ACGTTCCTTACTGGGGCCAAGGGACCACGGTCAC CGTTTCCTCTGGCGGTGGCGGTTCTGGTGGCGGTG GCTCCGGCGGTGGCGGTTCTGACATCCAGCTGAC CCAGTCTCACAAATTCCTGTCCACTTCAGTAGGAG ACAGGGTCAGCATCACCTGCAAGGCCAGTCAGGA TGTGTATAATGCTGTTGCCTGGTATCAACAGAAAC CAGGACAATCTCCTAAACTTCTGATTTACTCGGCA TCCTCCCGGTACACTGGAGTCCCTTCTCGCTTCAC TGGCAGTGGCTCTGGGCCGGATTTCACTTTCACCA TCAGCAGTGTGCAGGCTGAAGACCTGGCAGTTTA TTTCTGTCAGCAACATTTTCGTACTCCATTCACGTT CGGCTCGGGGACAAAATTGGAGATCAAA (SEQ ID NO: 62) |

In some embodiments, the HER2 scFv domain comprises a sequence of any one of SEQ ID NOS: 51, 53, 55, 57, 59 or 61, or a sequence having at least 90%, at least 95%, at least 97%, at least 99% or is identical thereto.

Inhibitory Receptors

The disclosure provides a second ligand, an inhibitor, and a second inhibitory receptor comprising a second ligand binding domain that binds to the inhibitor ligand. In some embodiments, the second, inhibitory ligand is an antigen, and the second inhibitory receptor comprises an antigen binding domain that specifically recognizes the second, inhibitory antigen.

The disclosure provides a second inhibitory receptor comprising an extracellular region, the extracellular region comprising a second ligand binding domain capable of specifically binding to a second ligand that inhibits activation of effector cells expressing the first and second receptors, wherein the effector cells are activated by binding of the first ligand to the first activator receptor.

As used herein an "inhibitor" or "inhibitor ligand" refers to a second ligand that binds to a second, ligand binding domain (inhibitor LBD) of an engineered receptor of the disclosure, but inhibits activation of an immune cell expressing the engineered receptor. The inhibitor is not expressed by the target cells. The inhibitor ligand is also expressed in a plurality of normal, non-target cells, including normal, non-target cells that express the activator ligand, thereby protecting these cells from the cytotoxic effects of the adoptive cell therapy. Without wishing to be bound by theory, inhibitor ligands can block activation of the effector cells through a variety of mechanisms. For example, binding of the inhibitor ligand to the inhibitor LBD can block transmission of a signal that occurs upon binding of the activator ligand to the activator LBD that would, in the absence of the inhibitor, lead to activation of the immune cell expressing the engineered receptors described herein.

Alternatively, or in addition, binding of the inhibitor ligand to the second engineered receptor can cause loss of cell surface expression the first, activator receptor from the surface of the immune cells comprising the two receptor system described herein. Without wishing to be bound by theory, it is thought that immune cell engagement of activator and inhibitor ligands on normal cells causes the inhibitory receptor to cause removal of nearby activator receptor molecules from the immune cell surface. This process locally desensitizes the immune cell, reversibly raising its activation threshold. Immune cells that engage only the activator ligand on a target cell cause local activation signals which are unimpeded by signals from the second, inhibitory receptor. This local activation increases until release of cytotoxic granules leads to target cell selective cell death. However, modulation of surface receptor expression levels may not be the only mechanism by which inhibitory receptors inhibit activation of immune cells by the first activator receptor. Without wishing to be bound by theory, other mechanisms may come into play, including, but not limited to, cross-talk between activator and inhibitory receptor signaling pathways.

In some embodiments, the second ligand is not expressed by the target cells, and is expressed by the non-target cells. In some embodiments, the target cells are cancer cells and the non-target cells are non-cancerous cells.

In some embodiments, the second, inhibitor ligand is an antigen and the second ligand binding domain comprises an scFv domain.

In some embodiments, the second, inhibitor ligand binding domain comprises a Vβ-only ligand binding domain.

In some embodiments, the second, inhibitor ligand binding domain comprises an antigen binding domain isolated or derived from a T cell receptor (TCR). For example, the second, inhibitor ligand binding domain comprises TCR α and β chain variable domains.

In some embodiments, the second, inhibitor ligand binding domain is an antigen binding domain. Suitable antigen-binding domains include, but are not limited to antigen-binding domains from antibodies, antibody fragments, scFv, antigen-binding domains derived from T cell receptors, and the like.

Inhibitor Targets

The disclosure provides an inhibitory receptor. In some embodiments, the inhibitory receptor comprises an extracellular ligand binding domain specific to a non-target antigen that is not expressed by the cancer cell due to a loss of heterozygosity in the cancer cell. In some embodiments, the non-target antigen is an HLA class I allele or a minor histocompatibility antigen (MiHA). In some embodiments, the HLA Class I allele comprises HLA-A, HLA-B, HLA-C, or HLA-E. In some embodiments, the HLA class I allele is HLA-A*02. In some embodiments, the HLA-A*02 non-target antigen is expressed by healthy cells of a subject.

In some embodiments, the inhibitory receptor comprises an extracellular antigen binding domain specific to a non-target antigen that is not expressed by the cancer cell due to a loss of heterozygosity in the cancer cell.

Alternatively, or in addition, expression of activator and inhibitor targets may be correlated, i.e. the two are expressed at similar levels on non-target cells.

In some embodiments, the second, inhibitor ligand is a peptide ligand. In some embodiments, the second, inhibitor ligand is a peptide antigen complexed with a major histocompatibility (MHC) class I complex (peptide MHC, or pMHC). Inhibitor ligands comprising peptide antigens complexed with pMHC comprising any of HLA-A, HLA-B, HLA-C, or HLA-E are envisaged as within the scope of the disclosure.

In some embodiment, the inhibitor ligand is encoded by a gene that is absent or polymorphic in many tumors.

Methods of distinguishing the differential expression of inhibitor ligands between target and non-target cells will be readily apparent to the person or ordinary skill in the art. For example, the presence or absence of inhibitor ligands in non-target and target cells can be assayed by immunohistochemistry with an antibody that binds to the inhibitor ligand, followed by microscopy or FACS, RNA expression profiling of target cells and non-target cells, or DNA sequencing of non-target and target cells to determine if the genomic locus of the inhibitor ligand comprises mutations in either the target or non-target cells.

Alleles Lost Due to Loss of Heterozygosity (LOH)

Homozygous deletions in primary tumors are rare and small, and therefore unlikely to yield target B candidates. For example, in an analysis of 2218 primary tumors across 21 human cancer types, the top four candidates were cyclin dependent kinase inhibitor 2A (CDKN2A), RB transcriptional corepressor 1 (RB1), phosphatase and tensin homolog (PTEN) and N3PB2. However, CDKN2A (P16) was deleted in only 5% homozygous deletion across all cancers. Homozygous HLA-A deletions were found in less than 0.2% of cancers (Cheng et al., Nature Comm. 8:1221 (2017)). In contrast, deletion of a single copy of a gene in cancer cells due to loss of hemizygosity occurs far more frequently.

In some embodiments, the second, inhibitor ligand comprises an allele of a gene that is lost in target cells due to loss of heterozygosity. In some embodiments, the target cells comprises cancer cells. Cancer cells undergo frequent genome rearrangements, including duplication and deletions. These deletions can lead to the deletion of one copy of one or more genes in the cancer cells.

As used herein, "loss of heterozygosity (LOH)" refers to a genetic change that occurs at high frequency in cancers, whereby one of the two alleles is deleted, leaving a single mono-allelic (hemizygous) locus.

HLA Class I Alleles

In some embodiments, the second, inhibitor ligand comprises an HLA class I allele. The major histocompatibility complex (MHC) class I is a protein complex that displays antigens to cells of the immune system, triggering immune response. The Human Leukocyte Antigens (HLAs) corresponding to MHC class I are HLA-A, HLA-B, HLA-C, and HLA-E.

In some embodiments, the second, inhibitor ligand comprises an HLA class I allele. In some embodiments, the second, inhibitor ligand comprises an allele of HLA class I that is lost in a target cell through LOH. HLA-A is a group of human leukocyte antigens (HLA) of the major histocompatibility complex (MHC) that are encoded by the HLA-A locus. HLA-A is one of three major types of human MHC class I cell surface receptors. The receptor is a heterodimer comprising a heavy a chain and smaller β chain. The α chain is encoded by a variant of HLA-A, while the β chain (β2-microglobulin) is invariant. There are several thousand HLA-A variants, all of which fall within the scope of the instant disclosure.

In some embodiments, the second, inhibitor ligand comprises an HLA-B allele. The HLA-B gene has many possible variations (alleles). Hundreds of versions (alleles) of the HLA-B gene are known, each of which is given a particular number (such as HLA-B27).

In some embodiments, the second, inhibitor ligand comprises an HLA-C allele. HLA-C belongs to the HLA class I heavy chain paralogues. This class I molecule is a heterodimer consisting of a heavy chain and a light chain (beta-2 microglobulin). Over one hundred HLA-C alleles have been described.

In some embodiments, the HLA class I allele has broad or ubiquitous RNA expression.

In some embodiments, the HLA class I allele has a known, or generally high minor allele frequency.

In some embodiments, the HLA class I allele does not require a peptide-MHC antigen, for example when the HLA class I allele is recognized by a pan-HLA ligand binding domain.

In some embodiments, the second inhibitor ligand comprises an HLA-A allele. In some embodiments the HLA-A allele comprises HLA-A*02. Various single variable domains known in the art or disclosed herein that bind to and recognize HLA-A*02 are suitable for use in embodiments. Such scFvs include, for example and without limitation, the following mouse and humanized scFv antibodies that bind HLA-A*02 in a peptide-independent way shown in Table 5 and Table 6 below (complementarity determining regions underlined):

TABLE 5

HLA-A*02 ScFv Sequences and Inhibitory receptor Constructs

| Construct | Protein Sequence | DNA Sequence |
|---|---|---|
| C-1765 (PA2.1, VL-VH) | MDMRVPAQLLGL LLLWLRGARCDV LMTQTPLSLPVSL GDQASISC<u>RSSQSI VHSNGNTYLE</u>WY LQKPGQSPKLLIY <u>KVSNRFS</u>GVPDRF SGSGSGTDFTLKI SRVEAEDLGVYY C<u>FQGSHVPRT</u>SGG GTKLEIKGGGGSG GGGSGGGGSGGQ VQLQQSGPELVK PGASVRISCK<u>ASG YTFTSYHIH</u>WVK QRPGQGLEWIG<u>W IYPGNVNTEYNEK FKGK</u>ATLTADKS SSTAYMHLSSLTS EDSAVYFCA<u>REEI TYAMDY</u>WGQGT SVTVSS (SEQ ID NO: 207) | ATGGACATGAGGGTCCCCGCTCAGCTCCTGGGGCTC CTGCTACTCTGGCTCCGAGGTGCCAGATGTGATGTT TTGATGACCCAAACTCCACTCTCCCTGCCTGTCAGT CTTGGAGATCAAGCCTCCATCTCTTGCAGATCTAGT CAGAGCATTGTACATAGTAATGGAAACACCTATTTA GAATGGTACCTGCAGAAACCAGGCCAGTCTCCAAA GCTCCTGATCTACAAAGTTTCCAACCGATTTTCTGG GGTCCCAGACAGGTTCAGTGGCAGTGGATCAGGGA CAGATTTCACACTCAAGATCAGTAGAGTGGAGGCT GAGGATCTGGGAGTTTATTACTGCTTTCAAGGTTCA CATGTTCCTCGGACGTCCGGTGGAGGCACCAAGCTG GAAATCAAAGGCGGAGGTGGAAGCGGAGGGGGAG GATCTGGCGGCGGAGGAAGCGGAGGCCAGGTCCAG CTGCAGCAGTCTGGACCTGAGCTGGTGAAGCCTGG GGCTTCAGTGAGGATATCCTGCAAGGCTTCTGGCTA CACCTTCACAAGTTACCATATACATTGGGTGAAGCA GAGGCCTGGACAGGGACTTGAGTGGATTGGATGGA TTTATCCTGGAAATGTTAATACTGAGTACAATGAGA AGTTCAAGGGCAAGGCCACACTGACTGCAGACAAA TCGTCCAGCACAGCCTACATGCACCTCAGCAGCCTG ACCTCTGAGGACTCTGCGGTCTATTTCTGTGCCAGA GAGGAGATTACCTATGCTATGGACTACTGGGGTCA AGGAACCTCAGTCACCGTGTCCTCA (SEQ ID NO: 208) |
| C-2162 (huPA2.1, VH-VL) | MDMRVPAQLLGL LLLWLRGARCQV QLVQSGAEVKKP GSSVKVSCK<u>ASG YTFTSYHIH</u>WVR QAPGQGLEWIG<u>W IYPGNVNTEYNEK FKGK</u>ATITADEST NTAYMELSSLRSE DTAVYYCA<u>REEIT YAMDY</u>WGQGTL VTVSSGGGGSGG GGSGGGGSGGDI QMTQSPSTLSASV GDRVTITC<u>RSSQSI VHSNGNTYLE</u>WY | ATGGACATGAGGGTCCCCGCTCAGCTCCTGGGGCTC CTGCTACTCTGGCTCCGAGGTGCCAGATGTCAGGTG CAGCTGGTGCAGTCTGGGGCTGAGGTGAAGAAGCC TGGGTCCTCAGTGAAGGTTTCCTGCAAGGCTTCTGG ATACACCTTCACTAGCTATCATATACATTGGGTGCG CCAGGCCCCCGGACAAGGGCTTGAGTGGATCGGAT GGATCTACCCTGGCAATGTTAACACAGAATATAATG AGAAGTTCAAGGGCAAAGCCACCATTACCGCGGAC GAATCCACGAACACAGCCTACATGGAGCTGAGCAG CCTGAGATCTGAAGACACGGCTGTGTATTACTGTGC GAGGGAGGAAATTACCTACGCTATGGACTACTGGG GCCAGGGAACCCTGGTCACCGTGTCCTCAGGCGGA GGTGGAAGCGGAGGGGGAGGATCTGGCGGCGGAG GAAGCGGAGGCGACATTCAAATGACCCAGAGCCCA TCCACCCTGAGCGCATCTGTAGGTGACCGGGTCACC ATCACTTGTAGATCCAGTCAGAGTATTGTACACAGT |

TABLE 5-continued

HLA-A*02 ScFv Sequences and Inhibitory receptor Constructs

| Construct | Protein Sequence | DNA Sequence |
|---|---|---|
|  | QQKPGKAPKLLIY<br>KVSNRFSGVPARF<br>SGSGSGTEFTLTIS<br>SLQPDDFATYYCF<br>QGSHVPRTFGQG<br>TKVEVK (SEQ ID<br>NO: 209) | AATGGGAACACCTATTTGGAATGGTATCAGCAGAA<br>ACCAGGTAAAGCCCCAAAATTGCTCATCTACAAAG<br>TCTCTAACAGATTTAGTGGTGTACCAGCCAGGTTCA<br>GCGGTTCCGGAAGTGGTACTGAATTCACCCTCACGA<br>TCTCCTCTCTCCAGCCAGATGATTTCGCCACTTATTA<br>CTGTTTTCAAGGTTCACATGTGCCGCGCACATTCGG<br>TCAGGGTACTAAAGTAGAAGTCAAA (SEQ ID NO:<br>210) |
| C-2163<br>(huPA2.1,<br>VH-VL) | MDMRVPAQLLGL<br>LLLWLRGARCQV<br>QLVQSGAEVKKP<br>GSSVKVSCKASG<br>YTFTSYHMHWVR<br>QAPGQGLEWIGYI<br>YPGNVNTEYNEK<br>FKGKATLTADKS<br>TNTAYMELSSLRS<br>EDTAVYFCAREEI<br>TYAMDYWGQGT<br>LVTVSSGGGGSG<br>GGGSGGGGSGGD<br>VQMTQSPSTLSAS<br>VGDRVTITCSSSQ<br>SIVHSNGNTYME<br>WYQQKPGKAPKL<br>LIYKVSNRFSGVP<br>DRFSGSGSGTEFT<br>LTISSLQPDDFAT<br>YYCHQGSHVPRT<br>FGQGTKVEVK<br>(SEQ ID NO: 211) | ATGGACATGAGGGTCCCCGCTCAGCTCCTGGGGCTC<br>CTGCTACTCTGGCTCCGAGGTGCCAGATGTCAGGTG<br>CAGCTGGTGCAGTCTGGGGCTGAGGTGAAGAAGCC<br>TGGGTCCTCAGTGAAGGTTTCCTGCAAGGCTTCTGG<br>ATACACCTTCACTAGCTATCATATGCATTGGGTGCG<br>CCAGGCCCCCGGACAAGGGCTTGAGTGGATCGGAT<br>ACATCTACCCTGGCAATGTTAACACAGAATATAATG<br>AGAAGTTCAAGGGCAAAGCCACCCTTACCGCGGAC<br>AAATCCACGAACACAGCCTACATGGAGCTGAGCAG<br>CCTGAGATCTGAAGACACGGCTGTGTATTTCTGTGC<br>GAGGGAGGAAATTACCTACGCTATGGACTACTGGG<br>GCCAGGGAACCCTGGTCACCGTGTCCTCAGGCGGA<br>GGTGGAAGCGGAGGGGGAGGATCTGGCGGCGGAG<br>GAAGCGGAGGCGACGTTCAAATGACCCAGAGCCCA<br>TCCACCCTGAGCGCATCTGTAGGTGACCGGGTCACC<br>ATCACTTGTAGCTCCAGTCAGAGTATTGTACACAGT<br>AATGGGAACACCTATATGGAATGGTATCAGCAGAA<br>ACCAGGTAAAGCCCCAAAATTGCTCATCTACAAAG<br>TCTCTAACAGATTTAGTGGTGTACCAGACAGGTTCA<br>GCGGTTCCGGAAGTGGTACTGAATTCACCCTCACGA<br>TCTCCTCTCTCCAGCCAGATGATTTCGCCACTTATTA<br>CTGTCATCAAGGTTCACATGTGCCGCGCACATTCGG<br>TCAGGGTACTAAAGTAGAAGTCAAA (SEQ ID NO:<br>212) |

In some embodiments, the second antigen binding domain comprises an scFv domain that binds to HLA-A*02 antigen. In some embodiments, the scFv domain comprises a sequence of SEQ ID NO: 207, 209 or 211, or sequences having at least 90%, at least 95%, at least 97%, at least 99% or is identical thereto. In some embodiments, the scFv domain comprises a sequence of SEQ ID NO: 207, 209 or 211.

TABLE 6

Additional HLA-A*02 scFv binding domains

HLA-A*02 antigen binding domains derived from PA2.1 mAb

C-001765 PA2.1 scFv (mouse):
DVLMTQTPLSLPVSLGDQASISCRSSQSIVHSNGNTYLEWYLQKPG
QSPKWYKVSNRFSGVPDRFSGSGSGTDFTLKISRVEAEDLGVYYC
FQGSHVPRTSGGGTKLEIKGGGGSGGGGSGGGGSGGQVQLQQSGP
ELVKPGASVRISCKASGYTFTSYHIHWVKQRPGQGLEWIGWIYPGN
VNTEYNEKFKGKATLTADKSSSTAYMHLSSLTSEDSAVYFCAREEI
TYAMDYWGQGTSVTVSS (SEQ ID NO: 63)

C-001765 PA2.1
scFv (mouse)
DNA Sequence:
SEQ ID NO: 75

C-002159 PA2.1.8 scFv (humanized):
QVQLVQSGAEVKKPGSSVKVSCKASGYTFTSYHIHWVRQAPGQGL
EWMGWIYPGNVNTEYNEKFKGKATITADKSTSTAYMELSSLRSED
TAVYYCAREEITYAMDYWGQGTTVTVSSGGGGSGGGGSGGGGSG
GEIVLTQSPGTLSLSPGERATLSCRSSQSIVHSNGNTYLEWYQQKPG
QAPRLLIYKVSNRFSGIPDRFSGSGSGTDFTLTISRLEPEDFAVYYCF
QGSHVPRTFGGGTKVEIK (SEQ ID NO: 64)

C-002159 PA2.1.8
scFv (humanized)
DNA Sequence:
SEQ ID NO: 76

C-002160 PA2.1.9 scFv (humanized):
QVQLVQSGAEVKKPGSSVKVSCKASGYTFTSYHIHWVRQAPGQGL
EWMGWIYPGNVNTEYNEKFKGKATITADKSTSTAYMELSSLRSED
TAVYYCAREEITYAMDYWGQGTTVTVSSGGGGSGGGGSGGGGSG
GDIVMTQTPLSLPVTPGEPASISCRSSQSIVHSNGNTYLEWYLQKPG
QSPQLLIYKVSNRFSGVPDRFSGSGSGTDFTLKISRVEAEDVGVYYC
FQGSHVPRTFGGGTKVEIK
(SEQ ID NO: 65)

C-002160 PA2.1.9
scFv (humanized)
DNA Sequence:
SEQ ID NO: 77

C-002161 PA2.1.10 scFv (humanized):
EVQLVESGGGLVKPGGSLRLSCAASGYTFTSYHIHWVRQAPGKGL
EWVGWIYPGNVNTEYNEKFKGRFTISRDDSKNTLYLQMNSLKTED C-002161
PA2.1.10 scFv
(humanized) DNA TABLE 6-continued Additional HLA-A*02 scFv binding domains TAVYYCAR<u>EEITYAMDY</u>WGQGTTVTVSSGGGGSGGGGSGGGGSG
GDIQMTQSPSSLSASVGDRVTITC<u>RSSQSIVHSNGNTYLE</u>WYQQKP
GKAPKLLIY<u>KVSNRFSGVPSR</u>FSGSGSGTDFTLTISSLQPEDFATYY
C<u>FQGSHVPRT</u>FGGGTKVEIK
(SEQ ID NO: 66)

Sequence: SEQ ID NO: 78

C-002162 PA2.1.14 scFv (humanized):
QVQLVQSGAEVKKPGSSVKVSCKA<u>SGYTFTSYHIH</u>WVRQAPGQGL
EWIG<u>WIYPGNVNTEYNEKFKG</u>KATITADESTNTAYMELSSLRSEDT
AVYYCAR<u>EEITYAMDY</u>WGQGTLVTVSSGGGGSGGGGSGGGGSGG
DIQMTQSPSTLSASVGDRVTITC<u>RSSQSIVHSNGNTYLE</u>WYQQKPG
KAPKLLIY<u>KVSNRFSGVPAR</u>FSGSGSGTEFTLTISSLQPDDFATYYC
<u>FQGSHVPRT</u>FGQGTKVEVK (SEQ ID NO: 67)

C-002162 PA2.1.14 scFv (humanized) DNA Sequence: SEQ ID NO: 79

C-002163 PA2.1.18 scFv (humanized):
QVQLVQSGAEVKKPGSSVKVSCKA<u>SGYTFTSYHMH</u>WVRQAPGQG
LEWIG<u>YIYPGNVNTEYNEKFKG</u>KATLTADKSTNTAYMELSSLRSE
DTAVYFCAR<u>EEITYAMDY</u>WGQGTLVTVSSGGGGSGGGGSGGGGS
GGDVQMTQSPSTLSASVGDRVTITC<u>SSSQSIVHSNGNTYME</u>WYQQ
KPGKAPKLLIY<u>KVSNRFSGVPDR</u>FSGSGSGTEFTLTISSLQPDDFAT
YYC<u>HQGSHVPRT</u>FGQGTKVEVK (SEQ ID NO: 68)

C-002163 PA2.1.18 scFv (humanized) DNA Sequence: SEQ ID NO: 80

HLA-A*02 antigen binding domains derived from BB7.2 mAb

C-002164 BB7.2 scFv (mouse):
QVQLQQSGPELVKPGASVKMSCKA<u>SGYTFTSYHIQ</u>WVKQRPGQG
LEWIG<u>WIYPGDGSTQYNEKFKG</u>KTTLTADKSSSTAYMLLSSLTSED
SAIYFCAR<u>EGTYYAMDY</u>WGQGTSVTVSSGGGGSGGGGSGGGGSG
GDVLMTQTPLSLPVSLGDQVSISC<u>RSSQSIVHSNGNTYLE</u>WYLQKP
GQSPKLLIY<u>KVSNRFSGVPDR</u>FSGSGSGTDFTLKISRVEAEDLGVYY
C<u>FQGSHVPRT</u>FGGGTKLEIK (SEQ ID NO: 69)

C-002164 BB7.2 scFv (mouse) DNA Sequence: SEQ ID NO: 81

C-002165 BB7.2.1 scFv (humanized):
QLQLQESGPGLVKPSETLSLTCTV<u>SGYTFTSYHIQ</u>WIRQPPGKGLE
WIG<u>WIYPGDGSTQYNEKFKG</u>RATISVDTSKNQFSLNLDSVSAADTA
IYYCA<u>REGTYYAMDY</u>WGKGSTVTVSSGGGGSGGGGSGGGGSGG
DIQMTQSPSSLSASVGDRVTITC<u>RSSQSIVHSNGNTYLE</u>WYQQKPG
KAPKLLIY<u>KVSNRFSGVPSR</u>FSGSGSGTDFTFTISSLQPEDIATYYC<u>F</u>
<u>QGSHVPRT</u>FGPGTKVDIK (SEQ ID NO: 70)

C-002165 BB7.2.1 scFv (humanized) DNA Sequence: SEQ ID NO: 82

C-002166 BB7.2.2 scFv (humanized):
EVQLVQSGAELKKPGSSVKVSCKA<u>SGYTFTSYHIQ</u>WVKQAPGQGL
EWIG<u>WIYPGDGSTQYNEKFKG</u>KATLTVDKSTNTAYMELSSLRSED
TAVYYCAR<u>EGTYYAMDY</u>WGQGTLVTVSSGGGGSGGGGSGGGGS
GGDIQMTQSPSTLSASVGDRVTITC<u>RSSQSIVHSNGNTYLE</u>WYQQK
PGKAPKLLIY<u>KVSNRFSGVPSR</u>FSGSGSGTDFTLTISSLQPDDFATY
YC<u>FQGSHVPRT</u>FGQGTKVEVK (SEQ ID NO: 71)

C-002166 BB7.2.2 scFv (humanized) DNA Sequence: SEQ ID NO: 83

C-002167 BB7.2.3 scFv (humanized):
QVQLVQSGAEVKKPGSSVKVSCKA<u>SGYTFTSYHIQ</u>WVRQAPGQGL
EWMG<u>WIYPGDGSTQYNEKFKG</u>RVTITADKSTSTAYMELSSLRSED
TAVYYCAR<u>EGTYYAMDY</u>WGQGTTVTVSSGGGGSGGGGSGGGGS
GGEIVLTQSPGTLSLSPGERATLSC<u>RSSQSIVHSNGNTYLE</u>WYQQKP
GQAPRLLIY<u>KVSNRFSGIPDR</u>FSGSGSGTDFTLTISRLEPEDFAVYYC
<u>FQGSHVPRT</u>FGGGTKVEIK (SEQ ID NO: 72)

C-002167 BB7.2.3 scFv (humanized) DNA Sequence: SEQ ID NO: 84

C-002168 BB7.2.5 scFv (humanized):
QVTLKQSGAEVKKPGSSVKVSCTA<u>SGYTFTSYHVS</u>WVRQAPGQGL
EWLG<u>RIYPGDGSTQYNEKFKG</u>KVTITADKSMDTSFMELTSLTSEDT
AVYYCAR<u>EGTYYAMDL</u>WGQGTLVTVSSGGGGSGGGGSGGGGSG
GEIVLTQSPGTLSLSPGERATLSC<u>RSSQSIVHSNGNTYLA</u>WYQQKPG
QAPRLLIS<u>KVSNRFSGVPDR</u>FSGSGSGTDFTLTISRLEPEDFAVYYC
<u>QQGSHVPRT</u>FGGGTKVEIK (SEQ ID NO: 73)

C-002168 BB7.2.5 scFv (humanized) DNA Sequence: SEQ ID NO: 85

C-002169 BB7.2.6 scFv (humanized):
QVQLVQSGAEVKKPGASVKVSCKA<u>SGYTFTSYHMH</u>WVRQAPGQ
RLEWMG<u>WIYPGDGSTQYNEKFKG</u>KVTITRDTSASTAYMELSSLRS
EDTAVYYCAR<u>EGTYYAMDY</u>WGQGTLVTVSSGGGGSGGGGSGGG
GSGGDIVMTQTPLSLPVTPGEPASISC<u>RSSQSIVHSNGNTYLDW</u>YLQ
KPGQSPQLLIY<u>KVSNRFSGVPDR</u>FSGSGSGTDFTLKISRVEAEDVGV
YYC<u>MQGSHVPRT</u>FGGGTKVEIK (SEQ ID NO: 74)

C-002169 BB7.2.6 scFv (humanized) DNA Sequence: SEQ ID NO: 86

In some embodiments, the non-target antigen comprises HLA-B*07. Various single variable domains known in the art or disclosed herein that bind to and recognize HLA-B*07 are suitable for use in embodiments.

In some embodiments, the non-target antigen comprises HLA-A*11. Various single variable domains known in the art or disclosed herein that bind to and recognize HLA-A*11 are suitable for use in embodiments.

In some embodiments, the non-target antigen comprises HLA-A*01. Various single variable domains known in the art or disclosed herein that bind to and recognize HLA-A*01 are suitable for use in embodiments.

In some embodiments, the non-target antigen comprises HLA-A*03. Various single variable domains known in the art or disclosed herein that bind to and recognize HLA-A*03 are suitable for use in embodiments.

In some embodiments, the non-target antigen comprises HLA-C*07. Various single variable domains known in the art or disclosed herein that bind to and recognize HLA-C*07 are suitable for use in embodiments.

Such scFvs include, for example and without limitation, the following mouse and humanized scFv antibodies that bind non-target antigens (e.g. HLA-A*02, HLA-A*01, HLA-A*03, HLA-A*11, HLA-B*07, or HLA-C*07) in a peptide-independent way shown in Table 7 below (where indicated, complementarity determining regions underlined):

TABLE 7

Exemplary HLA-A*02, HLA-A 01, HLA-A*03, HLA-A*11, HLA-B*07, or HLA-C*07 Binding Domains

| | HLA-B*07 antigen binding domains |
|---|---|
| BB7.1.10_ scFv | QVQLQESGPGLVKPSQTLSLTCTVSGYSITSGYSWHWIRQPPGKGLEWIG YIHFSGSTHYHPSLKSRVTISVDTSKNQFSLKLSSVTAADTAVYYCARGG VVSHYAMDCWGQGTTVTVSSGGGGSGGGGSGGGGSGGDIQMTQSPSS LSASVGDRVTITCRASENIYSNLAWYQQKPGKAPKLLIYAATYLPDGVP SRFSGSGSGTDFTLTISSLQPEDFATYYCQHFWVTPYTFGGGTKVEIK (SEQ ID NO: 330) |
| BB 7.1.9_ scFv | EVQLVESGGGLVKPGGSLRLSCAASGYSITSGYSWHWVRQAPGKGLEW VSYIHFSGSTHYHPSLKSRFTISRDNAKNSLYLQMNSLRAEDTAVYYCA RGGVVSHYAMDCWGQGTTVTVSSGGGGSGGGGSGGGGSGGDIQMTQS PSSVSASVGDRVTITCRASENIYSNLAWYQQKPGKAPKLLIYAATYLPDG VPSRFSGSGSGTDFTLTISSLQPEDFATYYCQHFWVTPYTFGGGTKVEIK (SEQ ID NO: 331) |
| BB7.1.8_ scFv | EVQLVESGGGLVKPGGSLRLSCAASGYSITSGYSWHWVRQAPGKGLEW VGYIHFSGSTHYHPSLKSRFTISRDDSKNTLYLQMNSLKTEDTAVYYCA RGGVVSHYAMDCWGQGTTVTVSSGGGGSGGGGSGGGGSGGEIVLTQS PATLSLSPGERATLSCRASENIYSNLAWYQQKPGQAPRLLIYAATYLPDG IPARFSGSGSGTDFTLTISSLEPEDFAVYYCQHFWVTPYTFGGGTKVEIK (SEQ ID NO: 332) |
| BB7.1.7_ scFv | QVQLQQSGPGLVKPSQTLSLTCAISGYSITSGYSWHWIRQSPSRGLEWLG YIHFSGSTHYHPSLKSRITINPDTSKNQFSLQLNSVTPEDTAVYYCARGG VVSHYAMDCWGQGTTVTVSSGGGGSGGGGSGGGGSGGEIVLTQSPATL SLSPGERATLSCRASENIYSNLAWYQQKPGQAPRLLIYAATYLPDGIPAR FSGSGSGTDFTLTISRLEPEDFAVYYCQHFWVTPYTFGGGTKVEIK (SEQ ID NO: 333) |
| BB7.1.6_ scFv | EVQLVESGGGLVKPGGSLRLSCAASGYSITSGYSWHWVRQAPGKGLEW VGYIHFSGSTHYHPSLKSRFTISRDDSKNTLYLQMNSLKTEDTAVYYCA RGGVVSHYAMDCWGQGTTVTVSSGGGGSGGGGSGGGGSGGDIQMTQS PSSVSASVGDRVTITCRASENIYSNLAWYQQKPGKAPKLLIYAATYLPDG VPSRFSGSGSGTDFTLTISSLQPEDFATYYCQHFWVTPYTFGGGTKVEIK (SEQ ID NO: 334) |
| BB7.1.5_ scFv | EVQLVESGGGLVQPGGSLRLSCAASGYSITSGYSWHWVRQAPGKGLEW VSYIHFSGSTHYHPSLKSRFTISRDNSKNTLYLQMNSLRAEDTAVYYCAR GGVVSHYAMDCWGQGTTVTVSSGGGGSGGGGSGGGGSGGDIQMTQSP SSLSASVGDRVTITCRASENIYSNLAWYQQKPGKAPKLLIYAATYLPDG VPSRFSGSGSGTDFTLTISSLQPEDFATYYCQHFWVTPYTFGGGTKVEIK (SEQ ID NO: 335) |
| BB 7.1.4_ scFv | EVQLVESGGGLVKPGGSLRLSCAASGYSITSGYSWHWVRQAPGKGLEW VGYIHFSGSTHYHPSLKSRFTISRDDSKNTLYLQMNSLKTEDTAVYYCA RGGVVSHYAMDCWGQGTTVTVSSGGGGSGGGGSGGGGSGGDIQMTQS PSSLSASVGDRVTITCRASENIYSNLAWYQQKPGKAPKLLIYAATYLPDG VPSRFSGSGSGTDFTLTISSLQPEDFATYYCQHFWVTPYTFGGGTKVEIK (SEQ ID NO: 336) |
| BB7.1.3_ scFv | QVQLQQWGAGLLKPSETLSLTCAVYGYSITSGYSWHWIRQPPGKGLEWI GYIHFSGSTHYHPSLKSRVTISVDTSKNQFSLKLSSVTAADTAVYYCARG GVVSHYAMDCWGQGTTVTVSSGGGGSGGGGSGGGGSGGDIQMTQSPS SLSASVGDRVTITCRASENIYSNLAWYQQKPGKAPKLLIYAATYLPDGV PSRFSGSGSGTDFTLTISSLQPEDFATYYCQHFWVTPYTFGGGTKVEIK (SEQ ID NO: 337) |
| BB 7.1.2_ scFv | QVQLQESGPGLVKPSQTLSLTCTVSGYSITSGYSWHWIRQHPGKGLEWI GYIHFSGSTHYHPSLKSRVTISVDTSKNQFSLKLSSVTAADTAVYYCARG GVVSHYAMDCWGQGTTVTVSSGGGGSGGGGSGGGGSGGDIQMTQSPS SLSASVGDRVTITCRASENIYSNLAWYQQKPGKAPKLLIYAATYLPDGV PSRFSGSGSGTDFTLTISSLQPEDFATYYCQHFWVTPYTFGGGTKVEIK (SEQ ID NO: 338) |

TABLE 7-continued

Exemplary HLA-A*02, HLA-A 01, HLA-A*03, HLA-A*11, HLA-B*07, or HLA-C*07 Binding Domains

| | |
|---|---|
| BB7.1.1_<br>scFv | QVQLQQSGPGLVKPSQTLSLTCAISGYSITSGYSWHWIRQSPSRGLEWLG<br>YIHFSGSTHYHPSLKSRITINPDTSKNQFSLQLNSVTPEDTAVYYCARGG<br>VVSHYAMDCWGQGTTVTVSSGGGGSGGGGSGGGGSGGDIQMTQSPSS<br>LSASVGDRVTITCRASENIYSNLAWYQQKPGKAPKLLIYAATYLPDGVP<br>SRFSGSGSGTDFTLTISSLQPEDFATYYCQHFWVTPYTFGGGTKVEIK<br>(SEQ ID NO: 339) |
| BB7.1<br>scFv | VQLQESGPDLVKPSQSLSLTCTVTGYSITSGYSWHWIRQFPRNKLEWMG<br>YIHFSGSTHYHPSLKSRISITRDTSKNQFFLQLNSVTTEDTATYYCARGGV<br>VSHYAMDCWGQGTSVTVSSGGGGSGGGGSGGGGSGGDIQMTQSPASL<br>SVSVGETVTITCRASENIYSNLAWYQQKQGKSPHLLVYAATYLPDGVPS<br>RFSGSGSGTQYSLKINSLQSEDFGSYYCQHFWVTPYTFGGGTKVEIK<br>(SEQ ID NO: 21806) |

HLA-A*11 antigen binding domains

| | |
|---|---|
| 9 | QVQLQESGPGLVKPSQTLSLTCTVSGGSISSGGYYWSWIRQPPGKGLEWI<br>GYIYYSGSTYYNPSLKSRVTISVDTSKNQFSLKLSSVTAADTAVYYCARH<br>YYYYSMDVWGKGTTVTVSSGGGGSGGGGSGGGGSGGDIQMTQSPSSLS<br>ASVGDRVTITCRASQSISSYLNWYQQKPGKAPKLLIYAASSLQSGVPSRF<br>SGSGSGTDFTLTISSLQPEDFATYYCQQSYSTPLTFGGGTKVEIK (SEQ ID<br>NO: 340) |
| 8 | QITLKESGPTLVKPTQTLTLTCTFSGFSLSTSGVGVGWIRQPPGKALEWL<br>ALIYWNDDKRYSPSLKSRLTITKDTSKNQVVLTMTNMDPVDTATYYCA<br>HRHMRLSCFDYWGQGTLVTVSSGGGGSGGGGSGGGGSGGDIQMTQSPS<br>SLSASVGDRVTITCRASQSISSYLNWYQQKPGKAPKLLIYAASSLQSGVP<br>SRFSGSGSGTDFTLTISSLQPEDFATYYCQQSYSTPLTFGGGTKVEIK<br>(SEQ ID NO: 341) |
| 7 | QVQLVQSGAEVKKPGASVKVSCKASGYTFTSYAMHWVRQAPGQRLEW<br>MGWINAGNGNTKYSQKFQGRVTITRDTSASTAYMELSSLRSEDTAVYY<br>CAREGNGANPDAFDIWGQGTMVTVSSGGGGSGGGGSGGGGSGGDIQM<br>TQSPSSLSASVGDRVTITCRASQSISSYLNWYQQKPGKAPKLLIYAASSL<br>QSGVPSRFSGSGSGTDFTLTISSLQPEDFATYYCQQSYSTPLTFGGGTKVE<br>IK (SEQ ID NO: 342) |
| 6 | EVQLVESGGGLVQPGGSLRLSCAASGFTFSSYDMHWVRQATGKGLEW<br>VSAIGTAGDTYYPGSVKGRFTISRENAKNSLYLQMNSLRAGDTAVYYC<br>ARDLPGSYWYFDLWGRGTLVTVSSGGGGSGGGGSGGGGSGGDIQMTQ<br>SPSSLSASVGDRVTITCRASQSISSYLNWYQQKPGKAPKLLIYAASSLQSG<br>VPSRFSGSGSGTDFTLTISSLQPEDFATYYCQQSYSTPLTFGGGTKVEIK<br>(SEQ ID NO: 343) |
| 5 | QVQLQESGPGLVKPSQTLSLTCTVSGGSISSGGYYWSWIRQPPGKGLEWI<br>GYIYYSGSTYYNPSLKSRVTISVDTSKNQFSLKLSSVTAADTAVYYCARH<br>YYYYYLDVWGKGTTVTVSSGGGGSGGGGSGGGGSGGDIQMTQSPSSLS<br>ASVGDRVTITCRASQSISSYLNWYQQKPGKAPKLLIYAASSLQSGVPSRF<br>SGSGSGTDFTLTISSLQPEDFATYYCQQSYSTPLTFGGGTKVEIK (SEQ ID<br>NO: 344) |
| 4 | EVQLVESGGGLVQPGGSLRLSCAASGFTFSSYWMHWVRQAPGKGLVW<br>VSRINSDGSSTSYADSVKGRFTISRDNAKNTLYLQMNSLRAEDTAVYYC<br>CLGVLLYNWFDPWGQGTLVTVSSGGGGSGGGGSGGGGSGGDIQMTQS<br>PSSLSASVGDRVTITCRASQSISSYLNWYQQKPGKAPKLLIYAASSLQSG<br>VPSRFSGSGSGTDFTLTISSLQPEDFATYYCQQSYSTPLTFGGGTKVEIK<br>(SEQ ID NO: 345) |
| 3 | QVQLQESGPGLVKPSQTLSLTCTVSGGSISSGGYYWSWIRQPPGKGLEWI<br>GYIYYSGSTYYNPSLKSRVTISVDTSKNQFSLKLSSVTAADTAVYYCARH<br>YYYYMDVWGKGTTVTVSSGGGGSGGGGSGGGGSGGDIQMTQSPSSLS<br>ASVGDRVTITCRASQSISSYLNWYQQKPGKAPKLLIYAASSLQSGVPSRF<br>SGSGSGTDFTLTISSLQPEDFATYYCQQSYSTPLTFGGGTKVEIK (SEQ ID<br>NO: 346) |
| 2 | QITLKESGPTLVKPTQTLTLTCTFSGFSLSTSGVGVGWIRQPPGKALEWL<br>ALIYWNDDKRYSPSLKSRLTITKDTSKNQVVLTMTNMDPVDTATYYCA<br>HKTTSFYFDYWGQGTLVTVSSGGGGSGGGGSGGGGSGGDIQMTQSPSS<br>LSASVGDRVTITCRASQSISSYLNWYQQKPGKAPKLLIYAASSLQSGVPS<br>RFSGSGSGTDFTLTISSLQPEDFATYYCQQSYSTPLTFGGGTKVEIK (SEQ<br>ID NO: 347) |
| 1 | QVQLQESGPGLVKPSQTLSLTCTVSGGSISSGGYYWSWIRQPPGKGLEWI<br>GYIYYSGSTYYNPSLKSRVTISVDTSKNQFSLKLSSVTAADTAVYYCARH<br>YYYYMDVWGKGTTVTVSSGGGGSGGGGSGGGGSGGDIQMTQSPSSL<br>SASVGDRVTITCRASQSISSYLNWYQQKPGKAPKLLIYAASSLQSGVPSR |

TABLE 7-continued

Exemplary HLA-A*02, HLA-A 01, HLA-A*03, HLA-A*11, HLA-B*07, or HLA-C*07 Binding Domains

FSGSGSGTDFTLTISSLQPEDFATYYCQQSYSTPLTFGGGTKVEIK (SEQ
ID NO: 348)

HLA-C*07 antigen binding domains

C7-45
EVQLLESGGGLVQPGGSLRLSCAASGFTFSSYAMSWVRQAPGKGLEWV
SAISGSGGSTYYADSVKGRFTISRDNSKNTLYLQMNSLRAEDTAVYYCA
VSFDWFDPWGQGTLVTVSSGGGGSGGGGSGGGGSGGDIQMTQSPSSLS
ASVGDRVTITCRASQSISSYLNWYQQKPGKAPKLLIYAASSLQSGVPSRF
SGSGSGTDFTLTISSLQPEDFATYYCQQSYSTPLTFGGGTKVEIK (SEQ ID
NO: 349)

C7-44
QVQLQESGPGLVKPSQTLSLTCTVSGGSISSGGYYWSWIRQPPGKGLEWI
GYIYYSGSTYYNPSLKSRVTISVDTSKNQFSLKLSSVTAADTAVYYCARE
RSISPYYYYYMDVWGKGTTVTVSSGGGGSGGGGSGGGGSGGDIQMTQS
PSSLSASVGDRVTITCRASQSISSYLNWYQQKPGKAPKLLIYAASSLQSG
VPSRFSGSGSGTDFTLTISSLQPEDFATYYCQQSYSTPLTFGGGTKVEIK
(SEQ ID NO: 350)

C7-43
QLQLQESGPGLVKPSETLSLTCTVSGGSISSSSYYWGWIRQPPGKGLEWI
GSIYYSGSTYYNPSLKSRVTISVDTSKNQFSLKLSSVTAADTAVYYCARD
SVIWYWFDPWGQGTLVTVSSGGGGSGGGGSGGGGSGGQSVLTQPPSAS
GTPGQRVTISCSGSSSNIGSNTVNWYQQLPGTAPKLLIYSNNQRPSGVPD
RFSGSKSGTSASLAISGLQSEDEADYYCAAWDDSLNGWVFGGGTKLTV
L (SEQ ID NO: 351)

C7-42
QVQLQESGPGLVKPSQTLSLTCTVSGGSISSGGYYWSWIRQPPGKGLEWI
GYIYYSGSTYYNPSLKSRVTISVDTSKNQFSLKLSSVTAADTAVYYCARE
EILPRLSYYYYMDVWGKGTTVTVSSGGGGSGGGGSGGGGSGGDIQMTQ
SPSSLSASVGDRVTITCRASQSISSYLNWYQQKPGKAPKLLIYAASSLQSG
VPSRFSGSGSGTDFTLTISSLQPEDFATYYCQQSYSTPLTFGGGTKVEIK
(SEQ ID NO: 352)

C7-41
QVQLVQSGSELKKPGASVKVSCKASGYTFTSYAMNWVRQAPGQGLEW
MGWINTNTGNPTYAQGFTGRFVFSFDTSVSTAYLQICSLKAEDTAVYYC
ARGGRAHSSWYFDLWGRGTLVTVSSGGGGSGGGGSGGGGSGGDIQMT
QSPSSLSASVGDRVTITCRASQSISSYLNWYQQKPGKAPKLLIYAASSLQS
GVPSRFSGSGSGTDFTLTISSLQPEDFATYYCQQSYSTPLTFGGGTKVEIK
(SEQ ID NO: 353)

C7-40
QVQLQESGPGLVKPSQTLSLTCTVSGGSISSGGYYWSWIRQPPGKGLEWI
GYIYYSGSTYYNPSLKSRVTISVDTSKNQFSLKLSSVTAADTAVYYCARD
RIKILPRLGYYYYMDVWGKGTTVTVSSGGGGSGGGGSGGGGSGGDIQM
TQSPSSLSASVGDRVTITCRASQSISSYLNWYQQKPGKAPKLLIYAASSL
QSGVPSRFSGSGSGTDFTLTISSLQPEDFATYYCQQSYSTPLTFGGGTKVE
IK (SEQ ID NO: 354)

C7-39
QVQLQESGPGLVKPSQTLSLTCTVSGGSISSGGYYWSWIRQPPGKGLEWI
GYIYYSGSTYYNPSLKSRVTISVDTSKNQFSLKLSSVTAADTAVYYCARD
TVIHYYYYMDVWGKGTTVTVSSGGGGSGGGGSGGGGSGGDIQMTQSP
SSLSASVGDRVTITCRASQSISSYLNWYQQKPGKAPKLLIYAASSLQSGV
PSRFSGSGSGTDFTLTISSLQPEDFATYYCQQSYSTPLTFGGGTKVEIK
(SEQ ID NO: 355)

C7-38
QVQLQESGPGLVKPSQTLSLTCTVSGGSISSGGYYWSWIRQPPGKGLEWI
GYIYYSGSTYYNPSLKSRVTISVDTSKNQFSLKLSSVTAADTAVYYCARD
VIVEVFLSYYYYMDVWGKGTTVTVSSGGGGSGGGGSGGGGSGGDIQM
TQSPSSLSASVGDRVTITCRASQSISSYLNWYQQKPGKAPKLLIYAASSL
QSGVPSRFSGSGSGTDFTLTISSLQPEDFATYYCQQSYSTPLTFGGGTKVE
IK (SEQ ID NO: 356)

C7-37
QVQLQESGPGLVKPSQTLSLTCTVSGGSISSGGYYWSWIRQPPGKGLEWI
GYIYYSGSTYYNPSLKSRVTISVDTSKNQFSLKLSSVTAADTAVYYCARD
IFIHYYYYMDVWGKGTTVTVSSGGGGSGGGGSGGGGSGGDIQMTQSPS
SLSASVGDRVTITCRASQSISSYLNWYQQKPGKAPKLLIYAASSLQSGVP
SRFSGSGSGTDFTLTISSLQPEDFATYYCQQSYSTPLTFGGGTKVEIK
(SEQ ID NO: 357)

C7-36
EVQLVESGGGLVQPGGSLRLSCAASGFTFSSYSMNWVRQAPGKGLEWV
SYISSSSSTIYYADSVKGRFTISRDNAKNSLYLQMNSLRAEDTAVYYCAR
DGTFYSYSPYYFDYWGQGTLVTVSSGGGGSGGGGSGGGGSGGDIQMTQ
SPSSLSASVGDRVTITCRASQSISSYLNWYQQKPGKAPKLLIYAASSLQSG
VPSRFSGSGSGTDFTLTISSLQPEDFATYYCQQSYSTPLTFGGGTKVEIK
(SEQ ID NO: 358)

C7-35
QVQLQESGPGLVKPSQTLSLTCTVSGGSISSGGYYWSWIRQPPGKGLEWI
GYIYYSGSTYYNPSLKSRVTISVDTSKNQFSLKLSSVTAADTAVYYCARE
WIKILPRLGYYYYMDVWGKGTTVTVSSGGGGSGGGGSGGGGSGGDIQ

TABLE 7-continued

Exemplary HLA-A*02, HLA-A 01, HLA-A*03, HLA-A*11, HLA-B*07, or HLA-C*07 Binding Domains

| | |
|---|---|
| | MTQSPSSLSASVGDRVTITCRASQSISSYLNWYQQKPGKAPKLLIYAASS<br>LQSGVPSRFSGSGSGTDFTLTISSLQPEDFATYYCQQSYSTPLTFGGGTKV<br>EIK (SEQ ID NO: 359) |
| C7-34 | QVQLQESGPGLVKPSQTLSLTCTVSGGSISSGGYYWSWIRQPPGKGLEWI<br>GYIYYSGSTYYNPSLKSRVTISVDTSKNQFSLKLSSVTAADTAVYYCARD<br>RSLYYYYYMDVWGKGTTVTVSSGGGGSGGGGSGGGGSGGDIQMTQSP<br>SSLSASVGDRVTITCRASQSISSYLNWYQQKPGKAPKLLIYAASSLQSGV<br>PSRFSGSGSGTDFTLTISSLQPEDFATYYCQQSYSTPLTFGGGTKVEIK<br>(SEQ ID NO: 360) |
| C7-33 | QVQLQESGPGLVKPSQTLSLTCTVSGGSISSGGYYWSWIRQPPGKGLEWI<br>GYIYYSGSTYYNPSLKSRVTISVDTSKNQFSLKLSSVTAADTAVYYCARD<br>KILAPNYYYYYMDVWGKGTTVTVSSGGGGSGGGGSGGGGSGGDIQMTQ<br>SPSSLSASVGDRVTITCRASQSISSYLNWYQQKPGKAPKLLIYAASSLQSG<br>VPSRFSGSGSGTDFTLTISSLQPEDFATYYCQQSYSTPLTFGGGTKVEIK<br>(SEQ ID NO: 361) |
| C7-32 | QVQLQESGPGLVKPSQTLSLTCTVSGGSISSGGYYWSWIRQPPGKGLEWI<br>GYIYYSGSTYYNPSLKSRVTISVDTSKNQFSLKLSSVTAADTAVYYCARE<br>KSWKYFYYYYYMDVWGKGTTVTVSSGGGGSGGGGSGGGGSGGDIQ<br>MTQSPSSLSASVGDRVTITCRASQSISSYLNWYQQKPGKAPKLLIYAASS<br>LQSGVPSRFSGSGSGTDFTLTISSLQPEDFATYYCQQSYSTPLTFGGGTKV<br>EIK (SEQ ID NO: 362) |
| C7-31 | QVQLQESGPGLVKPSQTLSLTCTVSGGSISSGGYYWSWIRQPPGKGLEWI<br>GYIYYSGSTYYNPSLKSRVTISVDTSKNQFSLKLSSVTAADTAVYYCARE<br>NTSTIPYYYYYMDVWGKGTTVTVSSGGGGSGGGGSGGGGSGGDIQMT<br>QSPSSLSASVGDRVTITCRASQSISSYLNWYQQKPGKAPKLLIYAASSLQS<br>GVPSRFSGSGSGTDFTLTISSLQPEDFATYYCQQSYSTPLTFGGGTKVEIK<br>(SEQ ID NO: 363) |
| C7-30 | QVQLQESGPGLVKPSQTLSLTCTVSGGSISSGGYYWSWIRQPPGKGLEWI<br>GYIYYSGSTYYNPSLKSRVTISVDTSKNQFSLKLSSVTAADTAVYYCARE<br>DVDKNTSTIYYYYYYMDVWGKGTTVTVSSGGGGSGGGGSGGGGSGGD<br>IQMTQSPSSLSASVGDRVTITCRASQSISSYLNWYQQKPGKAPKLLIYAA<br>SSLQSGVPSRFSGSGSGTDFTLTISSLQPEDFATYYCQQSYSTPLTFGGGT<br>KVEIK (SEQ ID NO: 364) |
| C7-29 | QVQLVESGGGLVKPGGSLRLSCAASGFTFSDYYMSWIRQAPGKGLEWV<br>SYISSSSGSTIYYADSVKGRFTISRDNAKNSLYLQMNSLRAEDTAVYYCAR<br>DGGDIVSSSAIYWYFDLWGRGTLVTVSSGGGGSGGGGSGGGGSGGAIQ<br>LTQSPSSLSASVGDRVTITCRASQGISSALAWYQQKPGKAPKLLIYDASS<br>LESGVPSRFSGSGSGTDFTLTISSLQPEDFATYYCQQFNSYPLTFGGGTKV<br>EIK (SEQ ID NO: 365) |
| C7-28 | QVQLQESGPGLVKPSQTLSLTCTVSGGSISSGGYYWSWIRQPPGKGLEWI<br>GYIYYSGSTYYNPSLKSRVTISVDTSKNQFSLKLSSVTAADTAVYYCARD<br>LILPPYYYYYMDVWGKGTTVTVSSGGGGSGGGGSGGGGSGGDIQMTQS<br>PSSLSASVGDRVTITCRASQSISSYLNWYQQKPGKAPKLLIYAASSLQSG<br>VPSRFSGSGSGTDFTLTISSLQPEDFATYYCQQSYSTPLTFGGGTKVEIK<br>(SEQ ID NO: 366) |
| C7-27 | QVQLQESGPGLVKPSQTLSLTCTVSGGSISSGGYYWSWIRQPPGKGLEWI<br>GYIYYSGSTYYNPSLKSRVTISVDTSKNQFSLKLSSVTAADTAVYYCARE<br>TWIKILPRYYYYYYMDVWGKGTTVTVSSGGGGSGGGGSGGGGSGGD<br>IQMTQSPSSLSASVGDRVTITCRASQSISSYLNWYQQKPGKAPKLLIYAA<br>SSLQSGVPSRFSGSGSGTDFTLTISSLQPEDFATYYCQQSYSTPLTFGGGT<br>KVEIK (SEQ ID NO: 367) |
| C7-26 | QVQLQESGPGLVKPSQTLSLTCTVSGGSISSGGYYWSWIRQPPGKGLEWI<br>GYIYYSGSTYYNPSLKSRVTISVDTSKNQFSLKLSSVTAADTAVYYCARD<br>LSRYYYYYMDVWGKGTTVTVSSGGGGSGGGGSGGGGSGGDIQMTQSP<br>SSLSASVGDRVTITCRASQSISSYLNWYQQKPGKAPKLLIYAASSLQSGV<br>PSRFSGSGSGTDFTLTISSLQPEDFATYYCQQSYSTPLTFGGGTKVEIK<br>(SEQ ID NO: 368) |
| C7-25 | EVQLVESGGGLVQPGGSLRLSCAASGFTFSSYSMNWVRQAPGKGLEWV<br>SYISSSSSTIYYADSVKGRFTISRDNAKNSLYLQMNSLRAEDTAVYYCAR<br>EHIVLCFDYWGQGTLVTVSSGGGGSGGGGSGGGGSGGDIQMTQSPSSLS<br>ASVGDRVTITCRASQGISSWLAWYQQKPEKAPKSLIYAASSLQSGVPSRF<br>SGSGSGTDFTLTISSLQPEDFATYYCQQYNSYPLTFGGGTKVEIK (SEQ ID<br>NO: 369) |
| C7-24 | QVQLQESGPGLVKPSQTLSLTCTVSGGSISSGGYYWSWIRQPPGKGLEWI<br>GYIYYSGSTYYNPSLKSRVTISVDTSKNQFSLKLSSVTAADTAVYYCARD<br>KILPRPYYYYYMDVWGKGTTVTVSSGGGGSGGGGSGGGGSGGDIQMT |

TABLE 7-continued

Exemplary HLA-A*02, HLA-A 01, HLA-A*03, HLA-A*11, HLA-B*07, or HLA-C*07 Binding Domains

| | |
|---|---|
| | QSPSSLSASVGDRVTITCRASQSISSYLNWYQQKPGKAPKLLIYAASSLQS<br>GVPSRFSGSGSGTDFTLTISSLQPEDFATYYCQQSYSTPLTFGGGTKVEIK<br>(SEQ ID NO: 370) |
| C7-23 | QVQLVQSGAEVKKPGASVKVSCKASGYTFTSYGISWVRQAPGQGLEW<br>MGWISAYNGNTNYAQKLQGRVTMTTDTSTSTAYMELRSLRSDDTAVY<br>YCARGSNEYFQHWGQGTLVTVSSGGGGSGGGGSGGGGSGGQSALTQPP<br>SASGSPGQSVTISCTGTSSDVGGYNYVSWYQQHPGKAPKLMIYEVSKRP<br>SGVPDRFSGSKSGNTASLTVSGLQAEDEADYYCSSYAGSNNWVFGGGT<br>KLTVL (SEQ ID NO: 371) |
| C7-22 | QVQLVQSGSELKKPGASVKVSCKASGYTFTSYAMNWVRQAPGQGLEW<br>MGWINTNTGNPTYAQGFTGRFVFSFDTSVSTAYLQICSLKAEDTAVYYC<br>ARGTSYWYFDLWGRGTLVTVSSGGGGSGGGGSGGGGSGGDIQMTQSPS<br>SLSASVGDRVTITCRASQSISSYLNWYQQKPGKAPKLLIYAASSLQSGVP<br>SRFSGSGSGTDFTLTISSLQPEDFATYYCQQSYSTPLTFGGGTKVEIK<br>(SEQ ID NO: 372) |
| C7-21 | QVQLQESGPGLVKPSQTLSLTCTVSGGSISSGGYYWSWIRQPPGKGLEWI<br>GYIYYSGSTYYNPSLKSRVTISVDTSKNQFSLKLSSVTAADTAVYYCARE<br>EIVEVFYYYYMDVWGKGTTVTVSSGGGGSGGGGSGGGGSGGDIQMTQ<br>SPSSLSASVGDRVTITCRASQSISSYLNWYQQKPGKAPKLLIYAASSLQSG<br>VPSRFSGSGSGTDFTLTISSLQPEDFATYYCQQSYSTPLTFGGGTKVEIK<br>(SEQ ID NO: 373) |
| C7-20 | EVQLLESGGGLVQPGGSLRLSCAASGFTFSSYAMSWVRQAPGKGLEWV<br>SAISGSGGSTYYADSVKGRFTISRDNSKNTLYLQMNSLRAEDTAVYYCA<br>KVDDYYFDYWGQGTLVTVSSGGGGSGGGGSGGGGSGGDIQMTQSPSSL<br>SASVGDRVTITCRASQSISSYLNWYQQKPGKAPKLLIYAASSLQSGVPSR<br>FSGSGSGTDFTLTISSLQPEDFATYYCQQSYSTPLTFGGGTKVEIK (SEQ<br>ID NO: 374) |
| C7-19 | EVQLVESGGGLVQPGGSLRLSCAASGFTFSSYWMHWVRQAPGKGLVW<br>VSRINSDGSSTSYADSVKGRFTISRDNAKNTLYLQMNSLRAEDTAVYYC<br>AWSTNILLSYTKAFDIWGQGTMVTVSSGGGGSGGGGSGGGGSGGDIQM<br>TQSPSSLSASVGDRVTITCRASQSISSYLNWYQQKPGKAPKLLIYAASSL<br>QSGVPSRFSGSGSGTDFTLTISSLQPEDFATYYCQQSYSTPLTFGGGTKVE<br>IK (SEQ ID NO: 375) |
| C7-18 | QVQLQESGPGLVKPSQTLSLTCTVSGGSISSGGYYWSWIRQPPGKGLEWI<br>GYIYYSGSTYYNPSLKSRVTISVDTSKNQFSLKLSSVTAADTAVYYCARD<br>KTYYYYYYMDVWGKGTTVTVSSGGGGSGGGGSGGGGSGGDIQMTQSP<br>SSLSASVGDRVTITCRASQSISSYLNWYQQKPGKAPKLLIYAASSLQSGV<br>PSRFSGSGSGTDFTLTISSLQPEDFATYYCQQSYSTPLTFGGGTKVEIK<br>(SEQ ID NO: 376) |
| C7-17 | QVQLQESGPGLVKPSQTLSLTCTVSGGSISSGGYYWSWIRQPPGKGLEWI<br>GYIYYSGSTYYNPSLKSRVTISVDTSKNQFSLKLSSVTAADTAVYYCARE<br>KYFHDKYFHDYYYYYMDVWGKGTTVTVSSGGGGSGGGGSGGGGSGG<br>DIQMTQSPSSLSASVGDRVTITCRASQSISSYLNWYQQKPGKAPKLLIYA<br>ASSLQSGVPSRFSGSGSGTDFTLTISSLQPEDFATYYCQQSYSTPLTFGGG<br>TKVEIK (SEQ ID NO: 377) |
| C7-16 | QVQLQESGPGLVKPSQTLSLTCTVSGGSISSGGYYWSWIRQPPGKGLEWI<br>GYIYYSGSTYYNPSLKSRVTISVDTSKNQFSLKLSSVTAADTAVYYCARD<br>TSVYYYYYMDVWGKGTTVTVSSGGGGSGGGGSGGGGSGGDIQMTQSP<br>SSLSASVGDRVTITCRASQSISSYLNWYQQKPGKAPKLLIYAASSLQSGV<br>PSRFSGSGSGTDFTLTISSLQPEDFATYYCQQSYSTPLTFGGGTKVEIK<br>(SEQ ID NO: 378) |
| C7-15 | QVQLQESGPGLVKPSQTLSLTCTVSGGSISSGGYYWSWIRQPPGKGLEWI<br>GYIYYSGSTYYNPSLKSRVTISVDTSKNQFSLKLSSVTAADTAVYYCARE<br>KILPYYYYYYMDVWGKGTTVTVSSGGGGSGGGGSGGGGSGGDIQMTQ<br>SPSSLSASVGDRVTITCRASQSISSYLNWYQQKPGKAPKLLIYAASSLQSG<br>VPSRFSGSGSGTDFTLTISSLQPEDFATYYCQQSYSTPLTFGGGTKVEIK<br>(SEQ ID NO: 379) |
| C7-14 | EVQLVESGGGLVQPGGSLRLSCAASGFTFSSYSMNWVRQAPGKGLEWV<br>SYISSSSSTIYYADSVKGRFTISRDNAKNSLYLQMNSLRAEDTAVYYCAI<br>QWIYIYINPRGFIFLHDAFDIWGQGTMVTVSSGGGGSGGGGSGGGGSGG<br>QSVLTQPPSASGTPGQRVTISCSGSSSNIGSNTVNWYQQLPGTAPKLLIYS<br>NNQRPSGVPDRFSGSKSGTSASLAISGLQSEDEADYYCAAWDDSLNGW<br>VFGGGTKLTVL (SEQ ID NO: 380) |
| C7-13 | QVQLQQSGPGLVKPSQTLSLTCAISGDSVSSNSAAWNWIRQSPSRGLEW<br>LGRTYYRSKWYNDYAVSVKSRITINPDTSKNQFSLQLNSVTPEDTAVYY<br>CAKEDVDFHHDAFDIWGQGTMVTVSSGGGGSGGGGSGGGGSGGDIQM |

TABLE 7-continued

Exemplary HLA-A*02, HLA-A 01, HLA-A*03, HLA-A*11, HLA-B*07, or HLA-C*07 Binding Domains

| | |
|---|---|
| | TQSPSSLSASVGDRVTITCRASQSISSYLNWYQQKPGKAPKLLIYAASSL<br>QSGVPSRFSGSGSGTDFTLTISSLQPEDFATYYCQQSYSTPLTFGGGTKVE<br>IK (SEQ ID NO: 381) |
| C7-12 | QVQLQESGPGLVKPSQTLSLTCTVSGGSISSGGYYWSWIRQPPGKGLEWI<br>GYIYYSGSTYYNPSLKSRVTISVDTSKNQFSLKLSSVTAADTAVYYCARE<br>GVDKNTSTIYYYYYMDVWGKGTTVTVSSGGGGSGGGGSGGGGSGGD<br>IQMTQSPSSLSASVGDRVTITCRASQSISSYLNWYQQKPGKAPKLLIYAA<br>SSLQSGVPSRFSGSGSGTDFTLTISSLQPEDFATYYCQQSYSTPLTFGGGT<br>KVEIK (SEQ ID NO: 382) |
| C7-11 | EVQLVESGGGLVQPGGSLRLSCAASGFTFSSYSMNWVRQAPGKGLEWV<br>SYISSSSSTIYYADSVKGRFTISRDNAKNSLYLQMNSLRAEDTAVYYCAR<br>DRRGYFDLWGRGTLVTVSSGGGGSGGGGSGGGGSGGDIQMTQSPSSLS<br>ASVGDRVTITCRASQGISSWLAWYQQKPEKAPKSLIYAASSLQSGVPSRF<br>SGSGSGTDFTLTISSLQPEDFATYYCQQYNSYPLTFGGGTKVEIK (SEQ ID<br>NO: 383) |
| C7-10 | EVQLVQSGAEVKKPGATVKISCKVSGYTFTDYYMHWVQQAPGKGLEW<br>MGLVDPEDGETIYAEKFQGRVTITADTSTDTAYMELSSLRSEDTAVYYC<br>ATGIHVDIRSMEDWFDPWGQGTLVTVSSGGGGSGGGGSGGGGSGGDIQ<br>MTQSPSSLSASVGDRVTITCRASQSISSYLNWYQQKPGKAPKLLIYAASS<br>LQSGVPSRFSGSGSGTDFTLTISSLQPEDFATYYCQQSYSTPLTFGGGTKV<br>EIK (SEQ ID NO: 384) |
| C7-9 | QVQLQESGPGLVKPSQTLSLTCTVSGGSISSGGYYWSWIRQPPGKGLEWI<br>GYIYYSGSTYYNPSLKSRVTISVDTSKNQFSLKLSSVTAADTAVYYCARD<br>IGTSYYYYMDVWGKGTTVTVSSGGGGSGGGGSGGGGSGGDIQMTQSPS<br>SLSASVGDRVTITCRASQSISSYLNWYQQKPGKAPKLLIYAASSLQSGVP<br>SRFSGSGSGTDFTLTISSLQPEDFATYYCQQSYSTPLTFGGGTKVEIK<br>(SEQ ID NO: 385) |
| C7-8 | QVQLQESGPGLVKPSQTLSLTCTVSGGSISSGGYYWSWIRQPPGKGLEWI<br>GYIYYSGSTYYNPSLKSRVTISVDTSKNQFSLKLSSVTAADTAVYYCARE<br>VVEVFLYYYYYMDVWGKGTTVTVSSGGGGSGGGGSGGGGSGGDIQMT<br>QSPSSLSASVGDRVTITCRASQSISSYLNWYQQKPGKAPKLLIYAASSLQS<br>GVPSRFSGSGSGTDFTLTISSLQPEDFATYYCQQSYSTPLTFGGGTKVEIK<br>(SEQ ID NO: 386) |
| C7-7 | QVQLQESGPGLVKPSQTLSLTCTVSGGSISSGGYYWSWIRQPPGKGLEWI<br>GYIYYSGSTYYNPSLKSRVTISVDTSKNQFSLKLSSVTAADTAVYYCARD<br>LYYYYYYYMDVWGKGTTVTVSSGGGGSGGGGSGGGGSGGDIQMTQSP<br>SSLSASVGDRVTITCRASQSISSYLNWYQQKPGKAPKLLIYAASSLQSGV<br>PSRFSGSGSGTDFTLTISSLQPEDFATYYCQQSYSTPLTFGGGTKVEIK<br>(SEQ ID NO: 387) |
| C7-6 | QVQLQESGPGLVKPSQTLSLTCTVSGGSISSGGYYWSWIRQPPGKGLEWI<br>GYIYYSGSTYYNPSLKSRVTISVDTSKNQFSLKLSSVTAADTAVYYCARE<br>SWKYFYPRGSIFIHYYYYMDVWGKGTTVTVSSGGGGSGGGGSGGGGSG<br>GDIQMTQSPSSLSASVGDRVTITCRASQSISSYLNWYQQKPGKAPKLLIY<br>AASSLQSGVPSRFSGSGSGTDFTLTISSLQPEDFATYYCQQSYSTPLTFGG<br>GTKVEIK (SEQ ID NO: 388) |
| C7-5 | QVQLQESGPGLVKPSQTLSLTCTVSGGSISSGGYYWSWIRQPPGKGLEWI<br>GYIYYSGSTYYNPSLKSRVTISVDTSKNQFSLKLSSVTAADTAVYYCARD<br>RIVEVFYYYYMDVWGKGTTVTVSSGGGGSGGGGSGGGGSGGDIQMTQ<br>SPSSLSASVGDRVTITCRASQSISSYLNWYQQKPGKAPKLLIYAASSLQSG<br>VPSRFSGSGSGTDFTLTISSLQPEDFATYYCQQSYSTPLTFGGGTKVEIK<br>(SEQ ID NO: 389) |
| C7-4 | QVQLQESGPGLVKPSQTLSLTCTVSGGSISSGGYYWSWIRQPPGKGLEWI<br>GYIYYSGSTYYNPSLKSRVTISVDTSKNQFSLKLSSVTAADTAVYYCARE<br>KYFHDWLYYYYYMDVWGKGTTVTVSSGGGGSGGGGSGGGGSGGDIQ<br>MTQSPSSLSASVGDRVTITCRASQSISSYLNWYQQKPGKAPKLLIYAASS<br>LQSGVPSRFSGSGSGTDFTLTISSLQPEDFATYYCQQSYSTPLTFGGGTKV<br>EIK (SEQ ID NO: 390) |
| C7-3 | QVQLQESGPGLVKPSQTLSLTCTVSGGSISSGGYYWSWIRQPPGKGLEWI<br>GYIYYSGSTYYNPSLKSRVTISVDTSKNQFSLKLSSVTAADTAVYYCARD<br>LVDKNTSYYYYYMDVWGKGTTVTVSSGGGGSGGGGSGGGGSGGDIQ<br>MTQSPSSLSASVGDRVTITCRASQSISSYLNWYQQKPGKAPKLLIYAASS<br>LQSGVPSRFSGSGSGTDFTLTISSLQPEDFATYYCQQSYSTPLTFGGGTKV<br>EIK (SEQ ID NO: 391) |
| C7-2 | QVQLVQSGAEVKKPGASVKVSCKASGYTFTSYGISWVRQAPGQGLEW<br>MGWISAYNGNTNYAQKLQGRVTMTTDTSTSTAYMELRSLRSDDTAVY<br>YCARVQNEYFQHWGQGTLVTVSSGGGGSGGGGSGGGGSGGQSALTQP |

TABLE 7-continued

Exemplary HLA-A*02, HLA-A 01, HLA-A*03, HLA-A*11, HLA-B*07, or HLA-C*07 Binding Domains

| | |
|---|---|
| | PSASGSPGQSVTISCTGTSSDVGGYNYVSWYQQHPGKAPKLMIYEVSKR PSGVPDRFSGSKSGNTASLTVSGLQAEDEADYYCSSYAGSNNWVFGGG TKLTVL (SEQ ID NO: 392) |
| C7-1 | QVQLVESGGGLVKPGGSLRLSCAASGFTFSDYYMSWIRQAPGKGLEWV SYISSSGSTIYYADSVKGRFTISRDNAKNSLYLQMNSLRAEDTAVYYCAT ANWFDPWGQGTLVTVSSGGGGSGGGGSGGGGSGGDIQMTQSPSSVSAS VGDRVTITCRASQGISSWLAWYQQKPGKAPKLLIYAASSLQSGVPSRFS GSGSGTDFTLTISSLQPEDFATYYCQQANSFPLTFGGGTKVEIK (SEQ ID NO: 393) |

HLA-A*03 scFv Sequences

| | |
|---|---|
| 15 | QVQLVQSGAEVKKPGASVKVSCKASGYTFTSYGISWVRQAPGQGLEW MGWISAYNGNTNYAQKLQGRVTMTTDTSTSTAYMELRSLRSDDTAVY YCARERVSQRGAFDIWGQGTMVTVSSGGGGSGGGGSGGGGSGGDIQM TQSPSSLSASVGDRVTITCRASQSISSYLNWYQQKPGKAPKLLIYAASSL QSGVPSRFSGSGSGTDFTLTISSLQPEDFATYYCQQSYSTPLTFGGGTKVE IK (SEQ ID NO: 394) |
| 16 | EVQLVESGGGLVQPGGSLRLSCAASGFTFSSYSMNWVRQAPGKGLEWV SYISSSSSTIYYADSVKGRFTISRDNAKNSLYLQMNSLRAEDTAVYYCAR GNPDKDPFDYWGQGTLVTVSSGGGGSGGGGSGGGGSGGDIQMTQSPSS LSASVGDRVTITCRASQSISSYLNWYQQKPGKAPKLLIYAASSLQSGVPS RFSGSGSGTDFTLTISSLQPEDFATYYCQQSYSTPLTFGGGTKVEIK (SEQ ID NO: 395) |
| 17 | QVQLQESGPGLVKPSETLSLTCTVSGGSVSSGSYYWSWIRQPPGKGLEW IGYIYYSGSTNYNPSLKSRVTISVDTSKNQFSLKLSSVTAADTAVYYCAR DFYCTNWYFDLWGRGTLVTVSSGGGGSGGGGSGGGGSGGDIQMTQSPS SLSASVGDRVTITCRASQSISSYLNWYQQKPGKAPKLLIYAASSLQSGVP SRFSGSGSGTDFTLTISSLQPEDFATYYCQQSYSTPLTFGGGTKVEIK (SEQ ID NO: 396) |
| 18 | QVQLQESGPGLVKPSETLSLTCTVSGGSISSYYWSWIRQPPGKGLEWIGY IYYSGSTNYNPSLKSRVTISVDTSKNQFSLKLSSVTAADTAVYYCARESS SGSYWYFDLWGRGTLVTVSSGGGGSGGGGSGGGGSGGDIQMTQSPSSL SASVGDRVTITCRASQSISSYLNWYQQKPGKAPKLLIYAASSLQSGVPSR FSGSGSGTDFTLTISSLQPEDFATYYCQQSYSTPLTFGGGTKVEIK (SEQ ID NO: 397) |
| 19 | EVQLVQSGAEVKKPGESLKISCKGSGYSFTSYWIGWVRQMPGKGLEWM GIIYPGDSDTRYSPSFQGQVTISADKSISTAYLQWSSLKASDTAMYYCAR DSGYKYNLYYYYYYMDVWGKGTTVTVSSGGGGSGGGGSGGGGSGGD IQMTQSPSSLSASVGDRVTITCRASQSISSYLNWYQQKPGKAPKLLIYAA SSLQSGVPSRFSGSGSGTDFTLTISSLQPEDFATYYCQQSYSTPLTFGGGT KVEIK (SEQ ID NO: 398) |
| 20 | QVQLVQSGAEVKKPGASVKVSCKASGYTFTSYGISWVRQAPGQGLEW MGWISAYNGNTNYAQKLQGRVTMTTDTSTSTAYMELRSLRSDDTAVY YCARGGDLSHYYYYMDVWGKGTTVTVSSGGGGSGGGGSGGGGSGGQ TVVTQEPSLTVSPGGTVTLTCASSTGAVTSGYYPNWFQQKPGQAPRALI YSTSNKHSWTPARFSGSLLGGKAALTLSGVQPEDEAEYYCLLYYGGAQ WVFGGGTKLTVL (SEQ ID NO: 399) |
| 21 | QVQLVQSGAEVKKPGASVKVSCKASGYTFTSYGISWVRQAPGQGLEW MGWISAYNGNTNYAQKLQGRVTMTTDTSTSTAYMELRSLRSDDTAVY YCARENRRYNSCYYFDYWGQGTLVTVSSGGGGSGGGGSGGGGSGGDI QMTQSPSSLSASVGDRVTITCRASQSISSYLNWYQQKPGKAPKLLIYAAS SLQSGVPSRFSGSGSGTDFTLTISSLQPEDFATYYCQQSYSTPLTFGGGTK VEIK (SEQ ID NO: 400) |
| 22 | QVQLVQSGAEVKKPGASVKVSCKASGYTFTSYGISWVRQAPGQGLEW MGWISAYNGNTNYAQKLQGRVTMTTDTSTSTAYMELRSLRSDDTAVY YCARGGDLSHYYYYLDVWGKGTTVTVSSGGGGSGGGGSGGGGSGGQT VVTQEPSLTVSPGGTVTLTCASSTGAVTSGYYPNWFQQKPGQAPRALIY STSNKHSWTPARFSGSLLGGKAALTLSGVQPEDEAEYYCLLYYGGAQW VFGGGTKLTVL (SEQ ID NO: 401) |
| 23 | EVQLVESGGGLVQPGGSLRLSCAASGFTVSSNYMSWVRQAPGKGLEWV SVIYSGGSTYYADSVKGRFTISRDNSKNTLYLQMNSLRAEDTAVYYCAR ATLLSLSYDAFDIWGQGTMVTVSSGGGGSGGGGSGGGGSGGDIQMTQS PSSLSASVGDRVTITCRASQSISSYLNWYQQKPGKAPKLLIYAASSLQSG VPSRFSGSGSGTDFTLTISSLQPEDFATYYCQQSYSTPLTFGGGTKVEIK (SEQ ID NO: 402) |

TABLE 7-continued

Exemplary HLA-A*02, HLA-A 01, HLA-A*03, HLA-A*11, HLA-B*07, or HLA-C*07 Binding Domains

| | |
|---|---|
| 24 | QVQLVQSGAEVKKPGASVKVSCKASGYTFTSYGISWVRQAPGQGLEW<br>MGWISAYNGNTNYAQKLQGRVTMTTDTSTSTAYMELRSLRSDDTAVY<br>YCARGGDLSHYYYMDVWGKGTTVTVSSGGGGSGGGGSGGGGSGGQT<br>VVTQEPSLTVSPGGTVTLTCASSTGAVTSGYYPNWFQQKPGQAPRALIY<br>STSNKHSWTPARFSGSLLGGKAALTLSGVQPEDEAEYYCLLYYGGAQW<br>VFGGGTKLTVL(SEQ ID NO: 403) |
| 25 | EVQLVQSGAEVKKPGESLKISCKGSGYSFTSYWIGWVRQMPGKGLEWM<br>GIIYPGDSDTRYSPSFQGQVTISADKSISTAYLQWSSLKASDTAMYYCAR<br>ERDRWFDPWGQGTLVTVSSGGGGSGGGGSGGGGSGGDIQMTQSPSSLS<br>ASVGDRVTITCRASQSISSYLNWYQQKPGKAPKLLIYAASSLQSGVPSRF<br>SGSGSGTDFTLTISSLQPEDFATYYCQQSYSTPLTFGGGTKVEIK (SEQ ID<br>NO: 404) |
| 26 | QVQLVQSGAEVKKPGASVKVSCKASGYTFTSYGISWVRQAPGQGLEW<br>MGWISAYNGNTNYAQKLQGRVTMTTDTSTSTAYMELRSLRSDDTAVY<br>YCARETPPSLGAFDIWGQGTMVTVSSGGGGSGGGGSGGGGSGGQSALT<br>QPPSASGSPGQSVTISCTGTSSDVGGYNYVSWYQQHPGKAPKLMIYEVS<br>KRPSGVPDRFSGSKSGNTASLTVSGLQAEDEADYYCSSYAGSNNWVFG<br>GGTKLTVL (SEQ ID NO: 405) |
| 27 | QLQLQESGPGLVKPSETLSLTCTVSGGSISSSSYYWGWIRQPPGKGLEWI<br>GSIYYSGSTYYNPSLKSRVTISVDTSKNQFSLKLSSVTAADTAVYYCARE<br>AYCLSDSYWYFDLWGRGTLVTVSSGGGGSGGGGSGGGGSGGQSVLTQ<br>PPSASGTPGQRVTISCSGSSSNIGSNTVNWYQQLPGTAPKLLIYSNNQRPS<br>GVPDRFSGSKSGTSASLAISGLQSEDEADYYCAAWDDSLNGWVFGGGT<br>KLTVL (SEQ ID NO: 406) |
| 28 | QVQLQESGPGLVKPSQTLSLTCTVSGGSISSGGYYWSWIRQPPGKGLEWI<br>GYIYYSGSTYYNPSLKSRVTISVDTSKNQFSLKLSSVTAADTAVYYCARE<br>SWKYFYPRGYMDVWGKGTTVTVSSGGGGSGGGGSGGGGSGGDIQMT<br>QSPSSLSASVGDRVTITCRASQSISSYLNWYQQKPGKAPKLLIYAASSLQS<br>GVPSRFSGSGSGTDFTLTISSLQPEDFATYYCQQSYSTPLTFGGGTKVEIK<br>(SEQ ID NO: 407) |
| HLA-A*01 scFv Sequences | |
| A1-9 | QVQLVQSGAEVKKPGASVKVSCKASGYTFTSYGISWVRQAPGQGLEW<br>MGWISAYNGNTNYAQKLQGRVTMTTDTSTSTAYMELRSLRSDDTAVY<br>YCARGGWTAWYYYMDVWGKGTTVTVSSGGGGSGGGGSGGGGSGGQ<br>TVVTQEPSLTVSPGGTVTLTCASSTGAVTSGYYPNWFQQKPGQAPRALI<br>YSTSNKHSWTPARFSGSLLGGKAALTLSGVQPEDEAEYYCLLYYGGAQ<br>WVFGGGTKLTVL (SEQ ID NO: 408) |
| A1-8 | EVQLVESGGGLVQPGGSLRLSCAASGFTFSSYSMNWVRQAPGKGLEWV<br>SYISSSSSTIYYADSVKGRFTISRDNAKNSLYLQMNSLRAEDTAVYYCAR<br>AKYYYMDVWGKGTTVTVSSGGGGSGGGGSGGGGSGGQSVLTQPPSAS<br>GTPGQRVTISCSGSSSNIGSNTVNWYQQLPGTAPKLLIYSNNQRPSGVPD<br>RFSGSKSGTSASLAISGLQSEDEADYYCAAWDDSLNGWVFGGGTKLTV<br>L (SEQ ID NO: 409) |
| A1-7 | QVQLQESGPGLVKPSQTLSLTCTVSGGSISSGGYYWSWIRQPPGKGLEWI<br>GYIYYSGSTYYNPSLKSRVTISVDTSKNQFSLKLSSVTAADTAVYYCARD<br>QVDKNTYYYYMDVWGKGTTVTVSSGGGGSGGGGSGGGGSGGDIQMT<br>QSPSSLSASVGDRVTITCRASQSISSYLNWYQQKPGKAPKLLIYAASSLQS<br>GVPSRFSGSGSGTDFTLTISSLQPEDFATYYCQQSYSTPLTFGGGTKVEIK<br>(SEQ ID NO: 410) |
| A1-6 | QVQLVESGGGLVKPGGSLRLSCAASGFTFSDYYMSWIRQAPGKGLEWV<br>SYISSSGSTIYYADSVKGRFTISRDNAKNSLYLQMNSLRAEDTAVYYCAR<br>ACQLAEYFQHWGQGTLVTVSSGGGGSGGGGSGGGGSGGDIQMTQSPSS<br>VSASVGDRVTITCRASQGISSWLAWYQQKPGKAPKLLIYAASSLQSGVP<br>SRFSGSGSGTDFTLTISSLQPEDFATYYCQQANSFPLTFGGGTKVEIK<br>(SEQ ID NO: 411) |
| A1-5 | QVQLQESGPGLVKPSQTLSLTCTVSGGSISSGGYYWSWIRQPPGKGLEWI<br>GYIYYSGSTYYNPSLKSRVTISVDTSKNQFSLKLSSVTAADTAVYYCARD<br>RVDKNTSYYYMDVWGKGTTVTVSSGGGGSGGGGSGGGGSGGDIQMT<br>QSPSSLSASVGDRVTITCRASQSISSYLNWYQQKPGKAPKLLIYAASSLQS<br>GVPSRFSGSGSGTDFTLTISSLQPEDFATYYCQQSYSTPLTFGGGTKVEIK<br>(SEQ ID NO: 412) |
| A1-4 | QVQLQESGPGLVKPSDTLSLTCAVSGYSISSSNWWGWIRQPPGKGLEWI<br>GYIYYSGSTYYNPSLKSRVTMSVDTSKNQFSLKLSSVTAVDTAVYYCAR<br>RVQLKLVHWFDPWGQGTLVTVSSGGGGSGGGGSGGGGSGGDIQMTQS<br>PSSLSASVGDRVTITCRASQSISSYLNWYQQKPGKAPKLLIYAASSLQSG |

TABLE 7-continued

Exemplary HLA-A*02, HLA-A 01, HLA-A*03, HLA-A*11, HLA-B*07, or HLA-C*07 Binding Domains

|  | |
|---|---|
| | VPSRFSGSGSGTDFTLTISSLQPEDFATYYCQQSYSTPLTFGGGTKVEIK (SEQ ID NO: 413) |
| A1-3 | QVQLVQSGAEVKKPGASVKVSCKASGYTFTSYDINWVRQATGQGLEW MGWMNPNSGNTGYAQKFQGRVTMTRNTSISTAYMELSSLRSEDTAVY YCATYYDYVTVPYFQHWGQGTLVTVSSGGGGSGGGGSGGGGSGGDIQ MTQSPSSLSASVGDRVTITCRASQSISSYLNWYQQKPGKAPKLLIYAASS LQSGVPSRFSGSGSGTDFTLTISSLQPEDFATYYCQQSYSTPLTFGGGTKV EIK (SEQ ID NO: 414) |
| A1-2 | QLQLQESGSGLVKPSQTLSLTCAVSGGSISSGGYSWSWIRQPPGKGLEWI GYIYHSGSTYYNPSLKSRVTISVDRSKNQFSLKLSSVTAADTAVYYCARE SYPSFYAFDIWGQGTMVTVSSGGGGSGGGGSGGGGSGGDIQMTQSPSSL SASVGDRVTITCRASQSISSYLNWYQQKPGKAPKLLIYAASSLQSGVPSR FSGSGSGTDFTLTISSLQPEDFATYYCQQSYSTPLTFGGGTKVEIK (SEQ ID NO: 415) |
| A1-1 | QITLKESGPTLVKPTQTLTLTCTFSGFSLSTSGVGVGWIRQPPGKALEWL ALIYWNDDKRYSPSLKSRLTITKDTSKNQVVLTMTNMDPVDTATYYCA HSNMWSYSLNDYYFDYWGQGTLVTVSSGGGGSGGGGSGGGGSGGDIQ MTQSPSSLSASVGDRVTITCRASQSISSYLNWYQQKPGKAPKLLIYAASS LQSGVPSRFSGSGSGTDFTLTISSLQPEDFATYYCQQSYSTPLTFGGGTKV EIK (SEQ ID NO: 416) |

Exemplary heavy chain and light chain CDRs (CDR-H1, CDR-H2 and CDR-H3, or CDR-L1, CDR-L2 and CDR-L3, respectively) for HLA-A*02 antigen binding domains are shown in Table 8 below.

TABLE 8

HLA-A*02 CDR Sequences

| CDR-L1 | CDR-L2 | CDR-L3 | CDR-H1 | CDR-H2 | CDR-H3 |
|---|---|---|---|---|---|
| RSSQSIVHSNGNTYLE (SEQ ID NO: 87) | KVSNRFSGVPDR (SEQ ID NO: 90) | FQGSHVPRT (SEQ ID NO: 92) | ASGYTFTSYHIH (SEQ ID NO: 95) | WIYPGNVNTEYNEKFKGK (SEQ ID NO: 98) | EEITYAMDY (SEQ ID NO: 101) |
| RSSQSIVHSNGNTYLE (SEQ ID NO: 87) | KVSNRFSGVPAR (SEQ ID NO: 91) | FQGSHVPRT (SEQ ID NO: 92) | ASGYTFTSYHIH (SEQ ID NO: 95) | WIYPGNVNTEYNEKFKGK (SEQ ID NO: 98) | EEITYAMDY (SEQ ID NO: 101) |
| SSSQSIVHSNGNTYME (SEQ ID NO: 88) | KVSNRFSGVPDR (SEQ ID NO: 90) | HQGSHVPRT (SEQ ID NO: 93) | ASGYTFTSYHMH (SEQ ID NO: 96) | YIYPGNVNTEYNEKFKGK (SEQ ID NO: 99) | EEITYAMDY (SEQ ID NO: 101) |
| RSSQSIVHSNGNTYLD (SEQ ID NO: 89) | KVSNRFSGVPDR (SEQ ID NO: 90) | MQGSHVPRT (SEQ ID NO: 94) | SGYTFTSYHMH (SEQ ID NO: 97) | WIYPGDGSTQYNEKFKG (SEQ ID NO: 100) | EGTYYAMDY (SEQ ID NO: 102) |
| RSSQSIVHSNGNTYLE (SEQ ID NO: 87 | KVSNRFS (SEQ ID NO: 565) | FQGSHVPRT (SEQ ID NO: 92) | SYHIH (SEQ ID NO: 566) | WIYPGNVNTEYNEKFKG (SEQ ID NO: 567) | EEITYAMDY (SEQ ID NO: 101) |

In some embodiments, the scFv comprises the complementarity determined regions (CDRs) of any one of SEQ ID NOS: 87-102. In some embodiments, the scFv comprises a sequence at least 95% identical to any one of SEQ ID NOS: 87-102. In some embodiments, the scFv comprises a sequence identical to any one of SEQ ID NOS: 87-102. In some embodiments, the heavy chain of the antibody comprises the heavy chain CDRs of any one of SEQ ID NOS: 95-102, and wherein the light chain of the antibody comprises the light chain CDRs of any one of SEQ ID NOS: 87-94. In some embodiments, the heavy chain of the antibody comprises a sequence at least 95% identical to the heavy chain portion of any one of SEQ ID NOS: 95-102, and wherein the light chain of the antibody comprises a sequence at least 95% identical to the light chain portion of any one of SEQ ID NOS: 87-94.

Additional exemplary heavy chain and light chain CDRs (CDR-H1, CDR-H2 and CDR-H3, or CDR-L1, CDR-L2 and CDR-L3, respectively) for HLA-A*03, HLA-B*07, HLA-A*11, HLA-C*07 and HLA-A*01 Ligand Binding Domains binding domains are shown in Table 9 below.

TABLE 9

CDRs Of HLA-A*03, HLA-B*07, HLA-A*11, HLA-C*07 and HLA-A*01 Ligand Binding Domains

| CDR-L1 | CDR-L2 | CDR-L3 | CDR-H1 | CDR-H2 | CDR-H3 |
|---|---|---|---|---|---|
| HLA-A*03 CDRs | | | | | |
| RASQSISSYLN (SEQ ID NO: 417) | AASSLQS (SEQ ID NO: 424) | QQSYSTPLT (SEQ ID NO: 430) | SYGIS (SEQ ID NO: 438) | WISAYNGNTNYAQKLQG (SEQ ID NO: 459) | ERVSQRGAFDI (SEQ ID NO: 478) |
| RASQSISSYLN (SEQ ID NO: 417) | AASSLQS (SEQ ID NO: 424) | QQSYSTPLT (SEQ ID NO: 430) | SYSMN (SEQ ID NO: 439) | YISSSSSTIYYADSVKG (SEQ ID NO: 460) | GNPDKDPFDY (SEQ ID NO: 479) |
| RASQSISSYLN (SEQ ID NO: 417) | AASSLQS (SEQ ID NO: 424) | QQSYSTPLT (SEQ ID NO: 430) | SGSYYWS (SEQ ID NO: 440) | YIYYSGSTNYNPSLKS (SEQ ID NO: 461) | DFYCTNWYFDL (SEQ ID NO: 480) |
| RASQSISSYLN (SEQ ID NO: 417) | AASSLQS (SEQ ID NO: 424) | QQSYSTPLT (SEQ ID NO: 430) | SYYWS (SEQ ID NO: 441) | YIYYSGSTNYNPSLKS (SEQ ID NO: 461) | ESSSGSYWYFDL (SEQ ID NO: 481) |
| RASQSISSYLN (SEQ ID NO: 417) | AASSLQS (SEQ ID NO: 424) | QQSYSTPLT (SEQ ID NO: 430) | SYWIG (SEQ ID NO: 442) | IIYPGDSDTRYSPSFQG (SEQ ID NO: 462) | DSGYKYNLYYYYYMDV (SEQ ID NO: 482) |
| ASSTGAVTSGYYPN (SEQ ID NO: 418) | STSNKHS (SEQ ID NO: 425) | LLYYGAQWV (SEQ ID NO: 431) | SYGIS (SEQ ID NO: 438) | WISAYNGNTNYAQKLQG (SEQ ID NO: 459) | GGDLSHYYYYMDV (SEQ ID NO: 483) |
| RASQSISSYLN (SEQ ID NO: 417) | AASSLQS (SEQ ID NO: 424) | QQSYSTPLT (SEQ ID NO: 430) | SYGIS (SEQ ID NO: 438) | WISAYNGNTNYAQKLQG (SEQ ID NO: 459) | ENRRYNSCYYFDY (SEQ ID NO: 484) |
| ASSTGAVTSGYYPN (SEQ ID NO: 418) | STSNKHS (SEQ ID NO: 425) | LLYYGAQWV (SEQ ID NO: 431) | SYGIS (SEQ ID NO: 438) | WISAYNGNTNYAQKLQG (SEQ ID NO: 459) | GGDLSHYYYLDV (SEQ ID NO: 485) |
| RASQSISSYLN (SEQ ID NO: 417) | AASSLQS (SEQ ID NO: 424) | QQSYSTPLT (SEQ ID NO: 430) | SNYMS (SEQ ID NO: 443) | VIYSGGSTYYADSVKG (SEQ ID NO: 463) | ATLLSLSYDAFDI (SEQ ID NO: 486) |
| ASSTGAVTSGYYPN (SEQ ID NO: 418) | STSNKHS (SEQ ID NO: 425) | LLYYGAQWV (SEQ ID NO: 431) | SYGIS (SEQ ID NO: 438) | WISAYNGNTNYAQKLQG (SEQ ID NO: 459) | GGDLSHYYYMDV (SEQ ID NO: 487) |
| RASQSISSYLN (SEQ ID NO: 417) | AASSLQS (SEQ ID NO: 424) | QQSYSTPLT (SEQ ID NO: 430) | SYWIG (SEQ ID NO: 442) | IIYPGDSDTRYSPSFQG (SEQ ID NO: 462) | ERDRWFDP (SEQ ID NO: 488) |
| TGTSSDVGGYNYVS (SEQ ID NO: 419) | EVSKRPS (SEQ ID NO: 426) | SSYAGSNNWV (SEQ ID NO: 432) | SYGIS (SEQ ID NO: 438) | WISAYNGNTNYAQKLQG (SEQ ID NO: 459) | ETPPSLGAFDI (SEQ ID NO: 489) |
| SGSSSNIGSNTVN (SEQ ID NO: 420) | SNNQRPS (SEQ ID NO: 427) | AAWDDSLNGWV (SEQ ID NO: 433) | SSSYYWG (SEQ ID NO: 444) | SIYYSGSTYYNPSLKS (SEQ ID NO: 464) | EAYCLSDSYWYFDL (SEQ ID NO: 490) |
| RASQSISSYLN (SEQ ID NO: 417) | AASSLQS (SEQ ID NO: 424) | QQSYSTPLT (SEQ ID NO: 430) | SGGYYWS (SEQ ID NO: 445) | YIYYSGSTYYNPSLKS (SEQ ID NO: 465) | ESWKYFYPRGYMDV (SEQ ID NO: 491) |

TABLE 9-continued

CDRs Of HLA-A*03, HLA-B*07, HLA-A*11, HLA-C*07 and HLA-A*01 Ligand Binding Domains

| CDR-L1 | CDR-L2 | CDR-L3 | CDR-H1 | CDR-H2 | CDR-H3 |
|---|---|---|---|---|---|
| HLA-B*07 CDRs | | | | | |
| RASENIYSNLA (SEQ ID NO: 421) | AATYLPD (SEQ ID NO: 428) | QHFWVTPYT (SEQ ID NO: 434) | SGYSWH (SEQ ID NO: 446) | YIHFSGSTHYHPSLKS (SEQ ID NO: 466) | GGVVSHYAMDC (SEQ ID NO: 492) |
| HLA-A*11 CDRs | | | | | |
| RASQSISSYLN (SEQ ID NO: 417) | AASSLQS (SEQ ID NO: 424) | QQSYSTPLT (SEQ ID NO: 430) | SGGYYWS (SEQ ID NO: 445) | YIYYSGSTYYNPSLKS (SEQ ID NO: 465) | HYYYYYMDV (SEQ ID NO: 493) |
| RASQSISSYLN (SEQ ID NO: 417) | AASSLQS (SEQ ID NO: 424) | QQSYSTPLT (SEQ ID NO: 430) | TSGVGVG (SEQ ID NO: 447) | LIYWNDDKRYSPSLKS (SEQ ID NO: 467) | KTTSFYFDY (SEQ ID NO: 494) |
| RASQSISSYLN (SEQ ID NO: 417) | AASSLQS (SEQ ID NO: 424) | QQSYSTPLT (SEQ ID NO: 430) | SGGYYWS (SEQ ID NO: 445) | YIYYSGSTYYNPSLKS (SEQ ID NO: 465) | HYYYYMDV (SEQ ID NO: 495) |
| RASQSISSYLN (SEQ ID NO: 417) | AASSLQS (SEQ ID NO: 424) | QQSYSTPLT (SEQ ID NO: 430) | SYWMH (SEQ ID NO: 448) | RINSDGSSTSYADSVKG (SEQ ID NO: 468) | GVLLYNWFDP (SEQ ID NO: 496) |
| RASQSISSYLN (SEQ ID NO: 417) | AASSLQS (SEQ ID NO: 424) | QQSYSTPLT (SEQ ID NO: 430) | SGGYYWS (SEQ ID NO: 445) | YIYYSGSTYYNPSLKS (SEQ ID NO: 465) | HYYYYYLDV (SEQ ID NO: 497) |
| RASQSISSYLN (SEQ ID NO: 417) | AASSLQS (SEQ ID NO: 424) | QQSYSTPLT (SEQ ID NO: 430) | SYDMH (SEQ ID NO: 449) | AIGTAGDTYYPGSVKG (SEQ ID NO: 469) | DLPGSYWYFDL (SEQ ID NO: 498) |
| RASQSISSYLN (SEQ ID NO: 417) | AASSLQS (SEQ ID NO: 424) | QQSYSTPLT (SEQ ID NO: 430) | SYAMH (SEQ ID NO: 450) | WINAGNGNTKYSQKFQG (SEQ ID NO: 470) | EGNGANPDAFDI (SEQ ID NO: 499) |
| RASQSISSYLN (SEQ ID NO: 417) | AASSLQS (SEQ ID NO: 424) | QQSYSTPLT (SEQ ID NO: 430) | TSGVGVG (SEQ ID NO: 447) | LIYWNDDKRYSPSLKS (SEQ ID NO: 467) | RHMRLSCFDY (SEQ ID NO: 500) |
| RASQSISSYLN (SEQ ID NO: 417) | AASSLQS (SEQ ID NO: 424) | QQSYSTPLT (SEQ ID NO: 430) | SGGYYWS (SEQ ID NO: 445) | YIYYSGSTYYNPSLKS (SEQ ID NO: 465) | HYYYYSMDV (SEQ ID NO: 501) |
| HLA-C*07 CDRs | | | | | |
| RASQSISSYLN (SEQ ID NO: 417) | AASSLQS (SEQ ID NO: 424) | QQSYSTPLT (SEQ ID NO: 430) | SYAMS (SEQ ID NO: 451) | AISGSGGSTYYADSVKG (SEQ ID NO: 471) | SFDWFDP (SEQ ID NO: 502) |
| RASQSISSYLN (SEQ ID NO: 417) | AASSLQS (SEQ ID NO: 424) | QQSYSTPLT (SEQ ID NO: 430) | SGGYYWS (SEQ ID NO: 445) | YIYYSGSTYYNPSLKS (SEQ ID NO: 465) | ERSISPYYYYYMDV (SEQ ID NO: 503) |
| SGSSSNIGSNTVN (SEQ ID NO: 420) | SNNQRPS (SEQ ID NO: 427) | AAWDDSLNGWV (SEQ ID NO: 433) | SSSYYWG (SEQ ID NO: 444) | SIYYSGSTYYNPSLKS (SEQ ID NO: 464) | DSVIWYWFDP (SEQ ID NO: 504) |
| RASQSISSYLN (SEQ ID NO: 417) | AASSLQS (SEQ ID NO: 424) | QQSYSTPLT (SEQ ID NO: 430) | SGGYYWS (SEQ ID NO: 445) | YIYYSGSTYYNPSLKS (SEQ ID NO: 465) | EEILPRLSYYYYMDV (SEQ ID NO: 505) |
| RASQSISSYLN (SEQ ID NO: 417) | AASSLQS (SEQ ID NO: 424) | QQSYSTPLT (SEQ ID NO: 430) | SYAMN (SEQ ID NO: 452) | WINTNTGNPTYAQGFTG (SEQ ID NO: 472) | GGRAHSSWYFDL (SEQ ID NO: 506) |

TABLE 9-continued

CDRs Of HLA-A*03, HLA-B*07, HLA-A*11, HLA-C*07 and HLA-A*01 Ligand Binding Domains

| CDR-L1 | CDR-L2 | CDR-L3 | CDR-H1 | CDR-H2 | CDR-H3 |
|---|---|---|---|---|---|
| RASQSISSYLN (SEQ ID NO: 417) | AASSLQS (SEQ ID NO: 424) | QQSYSTPLT (SEQ ID NO: 430) | SGGYYWS (SEQ ID NO: 445) | YIYYSGSTYYNPSLKS (SEQ ID NO: 465) | DRIKILPRLGYYYYMDV (SEQ ID NO: 507) |
| RASQSISSYLN (SEQ ID NO: 417) | AASSLQS (SEQ ID NO: 424) | QQSYSTPLT (SEQ ID NO: 430) | SGGYYWS (SEQ ID NO: 445) | YIYYSGSTYYNPSLKS (SEQ ID NO: 465) | DTVIHYYYYMDV (SEQ ID NO: 508) |
| RASQSISSYLN (SEQ ID NO: 417) | AASSLQS (SEQ ID NO: 424) | QQSYSTPLT (SEQ ID NO: 430) | SGGYYWS (SEQ ID NO: 445) | YIYYSGSTYYNPSLKS (SEQ ID NO: 465) | DVIVEVFLSYYYYMDV (SEQ ID NO: 509) |
| RASQSISSYLN (SEQ ID NO: 417) | AASSLQS (SEQ ID NO: 424) | QQSYSTPLT (SEQ ID NO: 430) | SGGYYWS (SEQ ID NO: 445) | YIYYSGSTYYNPSLKS (SEQ ID NO: 465) | DIFIHYYYYMDV (SEQ ID NO: 510) |
| RASQSISSYLN (SEQ ID NO: 417) | AASSLQS (SEQ ID NO: 424) | QQSYSTPLT (SEQ ID NO: 430) | SYSMN (SEQ ID NO: 439) | YISSSSSTIYYADSVKG (SEQ ID NO: 460) | DGTFYSYSPYYFDY (SEQ ID NO: 511) |
| RASQSISSYLN (SEQ ID NO: 417) | AASSLQS (SEQ ID NO: 424) | QQSYSTPLT (SEQ ID NO: 430) | SGGYYWS (SEQ ID NO: 445) | YIYYSGSTYYNPSLKS (SEQ ID NO: 465) | EWIKILPRLGYYYYMDV (SEQ ID NO: 512) |
| RASQSISSYLN (SEQ ID NO: 417) | AASSLQS (SEQ ID NO: 424) | QQSYSTPLT (SEQ ID NO: 430) | SGGYYWS (SEQ ID NO: 445) | YIYYSGSTYYNPSLKS (SEQ ID NO: 465) | DRSLYYYYMDV (SEQ ID NO: 513) |
| RASQSISSYLN (SEQ ID NO: 417) | AASSLQS (SEQ ID NO: 424) | QQSYSTPLT (SEQ ID NO: 430) | SGGYYWS (SEQ ID NO: 445) | YIYYSGSTYYNPSLKS (SEQ ID NO: 465) | DKILAPNYYYYMDV (SEQ ID NO: 514) |
| RASQSISSYLN (SEQ ID NO: 417) | AASSLQS (SEQ ID NO: 424) | QQSYSTPLT (SEQ ID NO: 430) | SGGYYWS (SEQ ID NO: 445) | YIYYSGSTYYNPSLKS (SEQ ID NO: 465) | EKSWKYFYYYYYMDV (SEQ ID NO: 515) |
| RASQSISSYLN (SEQ ID NO: 417) | AASSLQS (SEQ ID NO: 424) | QQSYSTPLT (SEQ ID NO: 430) | SGGYYWS (SEQ ID NO: 445) | YIYYSGSTYYNPSLKS (SEQ ID NO: 465) | ENTSTIPYYYYYMDV (SEQ ID NO: 516) |
| RASQSISSYLN (SEQ ID NO: 417) | AASSLQS (SEQ ID NO: 424) | QQSYSTPLT (SEQ ID NO: 430) | SGGYYWS (SEQ ID NO: 445) | YIYYSGSTYYNPSLKS (SEQ ID NO: 465) | EDVDKNTSTIYYYYYMDV (SEQ ID NO: 517) |
| RASQGISSALA (SEQ ID NO: 422) | DASSLES (SEQ ID NO: 429) | QQFNSYPLT (SEQ ID NO: 435) | DYYMS (SEQ ID NO: 453) | YISSSGSTIYYADSVKG (SEQ ID NO: 473) | DGGDIVSSSAIYWYFDL (SEQ ID NO: 518) |
| RASQSISSYLN (SEQ ID NO: 417) | AASSLQS (SEQ ID NO: 424) | QQSYSTPLT (SEQ ID NO: 430) | SGGYYWS (SEQ ID NO: 445) | YIYYSGSTYYNPSLKS (SEQ ID NO: 465) | DLILPPYYYYMDV (SEQ ID NO: 519) |
| RASQSISSYLN (SEQ ID NO: 417) | AASSLQS (SEQ ID NO: 424) | QQSYSTPLT (SEQ ID NO: 430) | SGGYYWS (SEQ ID NO: 445) | YIYYSGSTYYNPSLKS (SEQ ID NO: 465) | ETWIKILPRYYYYYYMDV (SEQ ID NO: 520) |
| RASQSISSYLN (SEQ ID NO: 417) | AASSLQS (SEQ ID NO: 424) | QQSYSTPLT (SEQ ID NO: 430) | SGGYYWS (SEQ ID NO: 445) | YIYYSGSTYYNPSLKS (SEQ ID NO: 465) | DLSRYYYYMDV (SEQ ID NO: 521) |
| RASQGISSWLA (SEQ ID NO: 423) | AASSLQS (SEQ ID NO: 424) | QQYNSYPLT (SEQ ID NO: 436) | SYSMN (SEQ ID NO: 439) | YISSSSSTIYYADSVKG (SEQ ID NO: 460) | EHIVLCFDY (SEQ ID NO: 522) |

TABLE 9-continued

CDRs Of HLA-A*03, HLA-B*07, HLA-A*11, HLA-C*07 and HLA-A*01 Ligand Binding Domains

| CDR-L1 | CDR-L2 | CDR-L3 | CDR-H1 | CDR-H2 | CDR-H3 |
| --- | --- | --- | --- | --- | --- |
| RASQSISSYLN (SEQ ID NO: 417) | AASSLQS (SEQ ID NO: 424) | QQSYSTPLT (SEQ ID NO: 430) | SGGYYWS (SEQ ID NO: 445) | YIYYSGSTYYNPSLKS (SEQ ID NO: 465) | DKILPRPYYYYYMDV (SEQ ID NO: 523) |
| TGTSSDVGGYNYVS (SEQ ID NO: 419) | EVSKRPS (SEQ ID NO: 426) | SSYAGSNNWV (SEQ ID NO: 432) | SYGIS (SEQ ID NO: 438) | WISAYNGNTNYAQKLQG (SEQ ID NO: 459) | GSNEYFQH (SEQ ID NO: 524) |
| RASQSISSYLN (SEQ ID NO: 417) | AASSLQS (SEQ ID NO: 424) | QQSYSTPLT (SEQ ID NO: 430) | SYAMN (SEQ ID NO: 452) | WINTNTGNPTYAQGFTG (SEQ ID NO: 472) | GTSYWYFDL (SEQ ID NO: 525) |
| RASQSISSYLN (SEQ ID NO: 417) | AASSLQS (SEQ ID NO: 424) | QQSYSTPLT (SEQ ID NO: 430) | SGGYYWS (SEQ ID NO: 445) | YIYYSGSTYYNPSLKS (SEQ ID NO: 465) | EEIVEVFYYYYMDV (SEQ ID NO: 526) |
| RASQSISSYLN (SEQ ID NO: 417) | AASSLQS (SEQ ID NO: 424) | QQSYSTPLT (SEQ ID NO: 430) | SYAMS (SEQ ID NO: 451) | AISGSGGSTYYADSVKG (SEQ ID NO: 471) | VDDYYFDY (SEQ ID NO: 527) |
| RASQSISSYLN (SEQ ID NO: 417) | AASSLQS (SEQ ID NO: 424) | QQSYSTPLT (SEQ ID NO: 430) | SYWMH (SEQ ID NO: 44) | RINSDGSSTSYADSVKG (SEQ ID NO: 468) | STNILLSYTKAFDI (SEQ ID NO: 528) |
| RASQSISSYLN (SEQ ID NO: 417) | AASSLQS (SEQ ID NO: 424) | QQSYSTPLT (SEQ ID NO: 430) | SGGYYWS (SEQ ID NO: 445) | YIYYSGSTYYNPSLKS (SEQ ID NO: 465) | DKTYYYYYYMDV (SEQ ID NO: 529) |
| RASQSISSYLN (SEQ ID NO: 417) | AASSLQS (SEQ ID NO: 424) | QQSYSTPLT (SEQ ID NO: 430) | SGGYYWS (SEQ ID NO: 445) | YIYYSGSTYYNPSLKS (SEQ ID NO: 465) | EKYFHDKYFHDYYYYYMDV (SEQ ID NO: 530) |
| RASQSISSYLN (SEQ ID NO: 417) | AASSLQS (SEQ ID NO: 424) | QQSYSTPLT (SEQ ID NO: 430) | SGGYYWS (SEQ ID NO: 445) | YIYYSGSTYYNPSLKS (SEQ ID NO: 465) | DTSVYYYYYMDV (SEQ ID NO: 531) |
| RASQSISSYLN (SEQ ID NO: 417) | AASSLQS (SEQ ID NO: 424) | QQSYSTPLT (SEQ ID NO: 430) | SGGYYWS (SEQ ID NO: 445) | YIYYSGSTYYNPSLKS (SEQ ID NO: 465) | EKILPYYYYYYMDV (SEQ ID NO: 532) |
| SGSSSNIGSNTVN (SEQ ID NO: 420) | SNNQRPS (SEQ ID NO: 427) | AAWDDSLNGWV (SEQ ID NO: 433) | SYSMN (SEQ ID NO: 439) | YISSSSSTIYYADSVKG (SEQ ID NO: 460) | QWIYIYINPRGFIFLHDAFDI (SEQ ID NO: 533) |
| RASQSISSYLN (SEQ ID NO: 417) | AASSLQS (SEQ ID NO: 424) | QQSYSTPLT (SEQ ID NO: 430) | SNSAAWN (SEQ ID NO: 454) | RTYYRSKWYNDYAVSVKS (SEQ ID NO: 474) | EDVDFHHDAFDI (SEQ ID NO: 534) |
| RASQSISSYLN (SEQ ID NO: 417) | AASSLQS (SEQ ID NO: 424) | QQSYSTPLT (SEQ ID NO: 430) | SGGYYWS (SEQ ID NO: 445) | YIYYSGSTYYNPSLKS (SEQ ID NO: 465) | EGVDKNTSTIYYYYYMDV (SEQ ID NO: 535) |
| RASQGISSWLA (SEQ ID NO: 423) | AASSLQS (SEQ ID NO: 424) | QQYNSYPLT (SEQ ID NO: 436) | SYSMN (SEQ ID NO: 439) | YISSSSSTIYYADSVKG (SEQ ID NO: 460) | DRRGYFDL (SEQ ID NO: 536) |
| RASQSISSYLN (SEQ ID NO: 417) | AASSLQS (SEQ ID NO: 424) | QQSYSTPLT (SEQ ID NO: 430) | DYYMH (SEQ ID NO: 455) | LVDPEDGETIYAEKFQG (SEQ ID NO: 475) | GIHVDIRSMEDWFDP (SEQ ID NO: 537) |

TABLE 9-continued

CDRs Of HLA-A*03, HLA-B*07, HLA-A*11, HLA-C*07 and HLA-A*01 Ligand Binding Domains

| CDR-L1 | CDR-L2 | CDR-L3 | CDR-H1 | CDR-H2 | CDR-H3 |
|---|---|---|---|---|---|
| RASQSISSYLN (SEQ ID NO: 417) | AASSLQS (SEQ ID NO: 424) | QQSYSTPLT (SEQ ID NO: 430) | SGGYYWS (SEQ ID NO: 445) | YIYYSGSTYYNPSLKS (SEQ ID NO: 465) | DIGTSYYYYMDV (SEQ ID NO: 538) |
| RASQSISSYLN (SEQ ID NO: 417) | AASSLQS (SEQ ID NO: 424) | QQSYSTPLT (SEQ ID NO: 430) | SGGYYWS (SEQ ID NO: 445) | YIYYSGSTYYNPSLKS (SEQ ID NO: 465) | EVVEVFLYYYYYMDV (SEQ ID NO: 539) |
| RASQSISSYLN (SEQ ID NO: 417) | AASSLQS (SEQ ID NO: 424) | QQSYSTPLT (SEQ ID NO: 430) | SGGYYWS (SEQ ID NO: 445) | YIYYSGSTYYNPSLKS (SEQ ID NO: 465) | DLYYYYYYMDV (SEQ ID NO: 540) |
| RASQSISSYLN (SEQ ID NO: 417) | AASSLQS (SEQ ID NO: 424) | QQSYSTPLT (SEQ ID NO: 430) | SGGYYWS (SEQ ID NO: 445) | YIYYSGSTYYNPSLKS (SEQ ID NO: 465) | ESWKYFYPRGSIFIHYYYYMDV (SEQ ID NO: 541) |
| RASQSISSYLN (SEQ ID NO: 417) | AASSLQS (SEQ ID NO: 424) | QQSYSTPLT (SEQ ID NO: 430) | SGGYYWS (SEQ ID NO: 445) | YIYYSGSTYYNPSLKS (SEQ ID NO: 465) | DRIVEVFYYYYMDV (SEQ ID NO: 542) |
| RASQSISSYLN (SEQ ID NO: 417) | AASSLQS (SEQ ID NO: 424) | QQSYSTPLT (SEQ ID NO: 430) | SGGYYWS (SEQ ID NO: 445) | YIYYSGSTYYNPSLKS (SEQ ID NO: 465) | EKYFHDWLYYYYYMDV (SEQ ID NO: 543) |
| RASQSISSYLN (SEQ ID NO: 417) | AASSLQS (SEQ ID NO: 424) | QQSYSTPLT (SEQ ID NO: 430) | SGGYYWS (SEQ ID NO: 445) | YIYYSGSTYYNPSLKS (SEQ ID NO: 465) | DLVDKNTSYYYYYMDV (SEQ ID NO: 544) |
| TGTSSDVGGYNYVS (SEQ ID NO: 419) | EVSKRPS (SEQ ID NO: 426) | SSYAGSNNWV (SEQ ID NO: 432) | SYGIS (SEQ ID NO: 438) | WISAYNGNTNYAQKLQG (SEQ ID NO: 459) | VQNEYFQH (SEQ ID NO: 545) |
| RASQGISSWLA (SEQ ID NO: 423) | AASSLQS (SEQ ID NO: 424) | QQANSFPLT (SEQ ID NO: 437) | DYYMS (SEQ ID NO: 453) | YISSSGSTIYYADSVKG (SEQ ID NO: 473) | ANWFDP (SEQ ID NO: 546) |
| HLA-A*01 CDRs | | | | | |
| ASSTGAVTSGYYPN (SEQ ID NO: 418) | STSNKHS (SEQ ID NO: 425) | LLYYGAQWV (SEQ ID NO: 431) | SYGIS (SEQ ID NO: 438) | WISAYNGNTNYAQKLQG (SEQ ID NO: 459) | GGWTAWYYMDV (SEQ ID NO: 547) |
| SGSSSNIGSNTVN (SEQ ID NO: 420) | SNNQRPS (SEQ ID NO: 427) | AAWDDSLNGWV (SEQ ID NO: 433) | SYSMN (SEQ ID NO: 439) | YISSSSSTIYYADSVKG (SEQ ID NO: 460) | AKYYYMDV (SEQ ID NO: 548) |
| RASQSISSYLN (SEQ ID NO: 417) | AASSLQS (SEQ ID NO: 424) | QQSYSTPLT (SEQ ID NO: 430) | SGGYYWS (SEQ ID NO: 445) | YIYYSGSTYYNPSLKS (SEQ ID NO: 465) | DQVDKNTYYYYMDV (SEQ ID NO: 549) |
| RASQGISSWLA (SEQ ID NO: 423) | AASSLQS (SEQ ID NO: 424) | QQANSFPLT (SEQ ID NO: 437) | DYYMS (SEQ ID NO: 453) | YISSSGSTIYYADSVKG (SEQ ID NO: 473) | ACQLAEYFQH (SEQ ID NO: 550) |
| RASQSISSYLN (SEQ ID NO: 417) | AASSLQS (SEQ ID NO: 424) | QQSYSTPLT (SEQ ID NO: 430) | SGGYYWS (SEQ ID NO: 445) | YIYYSGSTYYNPSLKS (SEQ ID NO: 465) | DRVDKNTSYYYMDV (SEQ ID NO: 551) |
| RASQSISSYLN (SEQ ID NO: 417) | AASSLQS (SEQ ID NO: 424) | QQSYSTPLT (SEQ ID NO: 430) | SSNWWG (SEQ ID NO: 456) | YIYYSGSTYYNPSLKS (SEQ ID NO: 465) | RVQLKLVHWFDP (SEQ ID NO: 552) |

TABLE 9-continued

CDRs Of HLA-A*03, HLA-B*07, HLA-A*11, HLA-C*07 and HLA-A*01 Ligand Binding Domains

| CDR-L1 | CDR-L2 | CDR-L3 | CDR-H1 | CDR-H2 | CDR-H3 |
| --- | --- | --- | --- | --- | --- |
| RASQSISSY LN (SEQ ID NO: 417) | AASSLQS (SEQ ID NO: 424) | QQSYSTPL T (SEQ ID NO: 430) | SYDIN (SEQ ID NO: 457) | WMNPNSGNT GYAQKFQG (SEQ ID NO: 476) | YYDYVTVFY FQH (SEQ ID NO: 553) |
| RASQSISSY LN (SEQ ID NO: 417) | AASSLQS (SEQ ID NO: 424) | QQSYSTPL T (SEQ ID NO: 430) | SGGYSW S (SEQ ID NO: 458) | YIYHSGSTYY NPSLKS (SEQ ID NO: 477) | ESYPSFYAF DI (SEQ ID NO: 554) |
| RASQSISSY LN (SEQ ID NO: 417) | AASSLQS (SEQ ID NO: 424) | QQSYSTPL T (SEQ ID NO: 430) | TSGVGV G (SEQ ID NO: 447) | LIYWNDDKR YSPSLKS (SEQ ID NO: 467) | SNMWSYSL NDYYFDY (SEQ ID NO: 555) |

In some embodiments, the second, inhibitory ligand is HLA-A*02, and the inhibitory ligand binding domain comprises an HLA-A*02 antigen binding domain. In some embodiments, the second antigen binding domain binds HLA-A*02 independent of the peptide in a pMHC complex comprising HLA-A*02. In some embodiments, the HLA-A*02 antigen binding domain comprises an scFv domain. In some embodiments, the HLA-A*02 antigen binding domain comprises a sequence of any one of SEQ ID NOs: 63-74, 207, 209 or 211. In some embodiments, the HLA-A*02 ligand binding domain comprises a sequence at least 90%, at least 95% or at least 99% identical to a sequence of any one of SEQ ID NOs: 63-74, 207, 209 or 211.

In some embodiments, the non-target antigen comprises HLA-B*07, and the ligand binding domain of the second receptor comprises an HLA-B*07 ligand binding domain. In some embodiments, the ligand binding domain binds HLA-B*07 independent of the peptide in a pMHC complex comprising HLA-B*07. In some embodiments, the HLA-B*07 ligand binding domain comprises an scFv domain. In some embodiments, the HLA-B*07 ligand binding domain comprises a sequence of any one of the indicated B7 binding domains in Table 7. In some embodiments, the HLA-B*07 ligand binding domain comprises a sequence at least 90%, at least 95% or at least 99% identical to a sequence of any one of the indicated HLA-B*07 binding domains in Table 7 Table 9. In some embodiments, the HLA-B*07 scFv comprises any one of the indicated HLA-B*07 complementarity determined regions (CDRs) in Table 9. In some embodiments, the scFv comprises a sequence at least 95% identical to any one of the indicated HLA-B*07 scFv sequences in Table 7. In some embodiments, the scFv comprises a sequence identical to any one of the indicated HLA-B*07 scFv sequences in Table 7.

In some embodiments, the non-target antigen comprises HLA-A*11, and the ligand binding domain of the second receptor comprises an HLA-A*11 ligand binding domain. In some embodiments, the ligand binding domain binds HLA-A*11 independent of the peptide in a pMHC complex comprising HLA-A*11. In some embodiments, the HLA-A*11 ligand binding domain comprises an scFv domain. In some embodiments, the HLA-A*11 ligand binding domain comprises a sequence of any one of the indicated HLA-A*11 binding domains in Table 7. In some embodiments, the HLA-A*11 ligand binding domain comprises a sequence at least 90%, at least 95% or at least 99% identical to a sequence of any one of the indicated HLA-A*11 binding domains in Table 7. In some embodiments, the HLA-A*11 scFv comprises any one of the indicated HLA-A*11 complementarity determined regions (CDRs) in Table 9. In some embodiments, the scFv comprises a sequence at least 95% identical to any one of the indicated HLA-A*11 scFv sequences in Table 7. In some embodiments, the scFv comprises a sequence identical to any one of the indicated HLA-A*11 scFv sequences in Table 7.

In some embodiments, the non-target antigen comprises HLA-A*01, and the ligand binding domain of the second receptor comprises an HLA-A*01 ligand binding domain. In some embodiments, the ligand binding domain binds HLA-A*01 independent of the peptide in a pMHC complex comprising HLA-A*01. In some embodiments, the HLA-A*01 ligand binding domain comprises an scFv domain. In some embodiments, the HLA-A*01 ligand binding domain comprises a sequence of any one of the indicated HLA-A*01 binding domains in Table 7. In some embodiments, the HLA-A*01 ligand binding domain comprises a sequence at least 90%, at least 95% or at least 99% identical to a sequence of any one of the indicated HLA-A*01 binding domains in Table 7. In some embodiments, the HLA-A*01 scFv comprises any one of the indicated HLA-A*01 complementarity determined regions (CDRs) in Table 9. In some embodiments, the scFv comprises a sequence at least 95% identical to any one of the indicated HLA-A*01 scFv sequences in Table 7. In some embodiments, the scFv comprises a sequence identical to any one of the indicated HLA-A*01 scFv sequences in Table 7.

In some embodiments, the non-target antigen comprises HLA-A*03, and the ligand binding domain of the second receptor comprises an HLA-A*03 ligand binding domain. In some embodiments, the ligand binding domain binds HLA-A*03 independent of the peptide in a pMHC complex comprising HLA-A*03. In some embodiments, the HLA-A*03 ligand binding domain comprises an scFv domain. In some embodiments, the HLA-A*03 ligand binding domain comprises a sequence of any one of the indicated HLA-A*03 binding domains in Table 7. In some embodiments, the HLA-A*03 ligand binding domain comprises a sequence at least 90%, at least 95% or at least 99% identical to a sequence of any one of the indicated HLA-A*03 binding domains in Table 7. In some embodiments, the HLA-A*03 scFv comprises any one of the indicated HLA-A*03 complementarity determined regions (CDRs) in Table 9. In some embodiments, the scFv comprises a sequence at least 95% identical to any one of the indicated HLA-A*03 scFv sequences in Table 7. In some embodiments, the scFv comprises a sequence identical to any one of the indicated HLA-A*03 scFv sequences in Table 7.

In some embodiments, the non-target antigen comprises HLA-C*07, and the ligand binding domain of the second receptor comprises an HLA-C*07 ligand binding domain. In some embodiments, the ligand binding domain binds HLA-C*07 independent of the peptide in a pMHC complex comprising HLA-C*07. In some embodiments, the HLA-C*07 ligand binding domain comprises an scFv domain. In some embodiments, the HLA-C*07 ligand binding domain comprises a sequence of any one of the indicated HLA-C*07 binding domains in Table 7. In some embodiments, the HLA-C*07 ligand binding domain comprises a sequence at least 90%, at least 95% or at least 99% identical to a sequence of any one of the indicated HLA-C*07 binding domains in Table 7. In some embodiments, the HLA-C*07 scFv comprises any one of the indicated HLA-C*07 complementarity determined regions (CDRs) in Table 9. In some embodiments, the scFv comprises a sequence at least 95% identical to any one of the indicated HLA-C*07 scFv sequences in Table 7. In some embodiments, the scFv comprises a sequence identical to any one of the indicated HLA-C*07 scFv sequences in Table 7.

Minor Histocompatibility Antigens

In some embodiments, the second, inhibitor ligand comprises a minor histocompatibility antigen (MiHA). In some embodiments, the second, inhibitor ligand comprises an allele of a MiHA that is lost in a target cell through LOH.

MiHAs are peptides derived from proteins that contain nonsynonymous differences between alleles and are displayed by common HLA alleles. The non-synonymous differences can arise from SNPs, deletions, frameshift mutations or insertions in the coding sequence of the gene encoding the MiHA. Exemplary MiHAs can be about 9-12 amino acids in length and can bind to MHC class I and MHC class II proteins. Binding of the TCR to the MHC complex displaying the MiHA can activate T cells. The genetic and immunological properties of MiHAs will be known to the person of ordinary skill in the art. Candidate MiHAs are known peptides presented by known HLA class I alleles, are known to elicit T cell responses in the clinic (for example, in graft versus host disease, or transplant rejection, and allow for patient selection by simple SNP genotyping.

In some embodiments, the MiHA has broad or ubiquitous RNA expression.

In some embodiments, the MiHA has high minor allele frequency.

In some embodiments, the MiHA comprises a peptide derived from a Y chromosome gene.

In some embodiments, the second inhibitor ligand comprises a MiHA selected from the group of MiHAs disclosed in Table 10 and Table 11.

Exemplary, but non-limiting, examples of MiHAs that are envisaged as within the scope of the instant invention are disclosed in Table 10 below. Columns in Table 10 indicate, from left to right, the name of the MiHA, the gene which from which it is derived, MHC class I variant which can display the MiHA and the sequences of the peptide variants [A/B variants indicated in brackets].

TABLE 10

HLA Class I Autosomal MiHAs

| MiHA | Gene | HLA | Peptide A/B |
|---|---|---|---|
| LB-CYBA-1Y | cytochrome b-245 alpha chain (CYBA) | A*01:01 | STMERWGQK[Y/H] (SEQ ID NO: 103) |
| LB-OAS1-1R | 2'-5'-oligoadenylate synthetase 1 (OAS1) | A*01:01 | ETDDPR[R/T]YQKY (SEQ ID NO: 104) |
| HA-1/A2 | Rho GTPase activating protein 45 (HMHA1) | A*02:01 | VL[HR]DDLLEA (SEQ ID NO: 105) |
| HA-2 | myosin IG (MYO1G) | A*02:01 | YIGEVLVS[V/M] (SEQ ID NO: 106) |
| HA-8 | pumilio RNA binding family member 3 (KIAA0020, PUM3) | A*02:01 | [R/P]TLDKVLEV (SEQ ID NO: 107) |
| HA-3 | A-kinase anchoring protein 13 (AKAP13) | A*01:01 | V[T/M]EPGTAQY (SEQ ID NO: 108) |
| HwA11-S | chromosome 19 open reading frame 48 (C19ORF48) | A*02:01 | CIPPD[S/T]LLFPA (SEQ ID NO: 109) |
| LB-ADIR-1F | torsin family 3 member A (TOR3A) | A*02:01 | SVAPALAL[F/S]PA (SEQ ID NO: 110) |
| LB-HIVEP1-1S | HIVEP zinc finger 1 (HIVEP1) | A*02:01 | SLPKH[S/N]VTI (SEQ ID NO: 111) |
| LB-NISCH-1A | nischarin (NISCH) | A*02:01 | ALAPAP[A/V]EV (SEQ ID NO: 112) |
| LB-SSR1-1S | signal sequence receptor subunit 1 (SSR1) | A*02:01 | [S/L]LAVAQDLT (SEQ ID NO: 113) |
| LB-WNK1-1I | WNK lysine deficient protein kinase 1 (WNK1) | A*02:01 | RTLSPE[I/M]ITV (SEQ ID NO: 114) |
| T4A | tripartite motif containing 4 (TRIM42) | A*02:01 | GLYTYWSAG[A/E] (SEQ ID NO: 115) |

TABLE 10-continued

HLA Class I Autosomal MiHAs

| MiHA | Gene | HLA | Peptide A/B |
|---|---|---|---|
| UTA2-1 | retroelement silencing factor 1 (KIAA1551) | A*02:01 | QL[L/P]NSVLTL (SEQ ID NO: 116) |
| LB-CLYBL-1Y | citramalyl-CoA lyase (CLYBL) | A*02:01 | SLAA[Y/D]IPRL (SEQ ID NO: 117) |
| TRIM22 | tripartite motif containing 22 (TRIM22) | A*02:01 | MAVPPC[C/R]IGV (SEQ ID NO: 118) |
| PARP10-1L | poly(ADP-ribose) polymerase family member 10 (PARP10) | A*02:01 | GL[L/P]GQEGLVEI (SEQ ID NO: 119) |
| FAM119A-1T | methyltransferase like 21A (FAM119A) | A*02:01 | AMLERQF[T/I] (SEQ ID NO: 120) |
| GLRX3-1S | glutaredoxin 3 (GLRX3) | A*02:01 | FL[S/P]SANEHL (SEQ ID NO: 121) |
| HNF4G-1M | hepatocyte nuclear factor 4 gamma (HNF4G) | A*02:01 | M[M/I]YKDILLL (SEQ ID NO: 122) |
| HMMR-1V | hyaluronan mediated motility receptor (HMMR) | A*02:01 | SLQEK[V/A]AKA (SEQ ID NO: 123) |
| BCL2A1 | BCL2 related protein A1 (BCL2A1) | A*02:01 | VLQ[N/K]VAFSV (SEQ ID NO: 124) |
| CDC26-1F | cell division cycle 26 (CDC26) | A*02:01 | [F/S]VAGTQEVFV (SEQ ID NO: 125) |
| APOBEC3F-1S/A | apolipoprotein B mRNA editing enzyme catalytic subunit 3F (APOBEC3F) | A*02:01 | FL[S/A]EHPNVTL (SEQ ID NO: 126) |
| LB-PRCP-1D | prolylcarboxypeptidase (PRCP) | A*02:01 | FMWDVAE[D/E] (9 mer) (SEQ ID NO: 127), FMWDVAE[D/E]LKA (11 mer) (SEQ ID NO: 128) |
| LB-CCL4-1T | C-C motif chemokine ligand 4 (CCL4) | A*02:01 | CADPSE[T/S]WV (SEQ ID NO: 129) |
| LB-NCAPD3-1Q | non-SMC condensin II complex subunit D (NCAPD3) | A*02:01 | WL[Q/R]GVVPVV (SEQ ID NO: 130) |
| LB-NDC80-1P | NDC80 kinetochore complex component (NDC80) | A*02:01 | HLEEQI[P/A]KV (SEQ ID NO: 131) |
| LB-TTK-1D | TTK protein kinase (TTK) | A*02:01 | RLH[D/E]GRVFV (SEQ ID NO: 132) |
| WDR27-1L | WD repeat domain 27 (WDR27) | A*02:01 | S[L/P]DDHVVAV (SEQ ID NO: 133) |
| MIIP | migration and invasion inhibitory protein (MIIP) | A*02:01 | SEESAVP[K/E]RSW (11 mer) (SEQ ID NO: 134), EESAVP[K/E]RSW (10 mer) (SEQ ID NO: 135) |
| HER-2/NEU | Eerb-b2 receptor tyrosine kinase 2 (RBB2) | A*02:01 | not reported |
| LB-DHX33-1C | DEAH-box helicase 33 (DHX33) | A*02:01, C*03:03 | YLYEGGIS[C/R] (SEQ ID NO: 136) |
| PANE1 | centromere protein M (CENPM) | A*03:01 | RVWDLPGVLK (SEQ ID NO: 137) |
| SP110 | SP110 nuclear body protein (SP110) | A*03:01 | SLP[R/G]GTSTPK (SEQ ID NO: 138) |
| ACC-1C/Y | BCL2 related protein A1 (BCL2A1) | A*24:02 | DYLQ[Y/C]VLQI (SEQ ID NO: 139) |

TABLE 10-continued

HLA Class I Autosomal MiHAs

| MiHA | Gene | HLA | Peptide A/B |
|---|---|---|---|
| P2RX7 | purinergic receptor P2X 7 (P2RX7) | A*29:02 | WFHHC[H/R]PKY (SEQ ID NO: 140) |
| ACC-4 | cathepsin H (CTSH) | A*31:01 | ATLPLLCA[R/G] (SEQ ID NO: 141) |
| ACC-5 | CTSH | A*33:03 | WATLPLLCA[R/G] (SEQ ID NO: 142) |
| AKAP13 | A-kinase anchoring protein 13 (AKAP13) | B*07:02 | APAGVREV[M/T] (SEQ ID NO: 143) |
| LB-APOBEC3B-1K | apolipoprotein B mRNA editing enzyme catalytic subunit 3B (APOBEC3B) | B*07:02, B*08:01 | [K/E]PQYHAEMCF (SEQ ID NO: 144) |
| APOBEC3H | apolipoprotein B mRNA editing enzyme catalytic subunit 3H (APOBEC3H) | B*07:02 | KPQQ[K/E]GLRL (SEQ ID NO: 145) |
| LB-ARHGDIB-1R | Rho GDP dissociation inhibitor beta (ARHGDIB) | B*07:02 | LPRACW[R/P]EA (SEQ ID NO: 146) |
| LB-BCAT2-1R | BCAT2-branched chain amino acid transaminase 2 (BCAT2) | B*07:02 | QP[R/T]RALLFVIL (SEQ ID NO: 147) |
| BFAR | bifunctional apoptosis regulator (BFAR) | B*07:02 | APNTGRANQQ[M/R] (SEQ ID NO: 148) |
| C14orf169 | ribosomal oxygenase 1 (C14orf169 or RIOX1) | B*07:02 | RPR[A/V]PTEELAL (SEQ ID NO: 149) |
| LB-C16ORF-1R | C16ORF | B*07:02 | [R/W]PCPSVGLSFL (SEQ ID NO: 150) |
| C18orf21 | chromosome 18 open reading frame 21 (C18orf21) | B*07:02 | NPATP[A/T]SKL (SEQ ID NO: 151) |
| LB-EBI3-1I | Epstein-Barr virus induced 3 (EBI3) | B*07:02 | RPRARYY[I/V]QV (SEQ ID NO: 152) |
| POP1 | POP1 homolog, ribonuclease P/MRP subunit (POP1) | B*07:02 | LPQKKS[N/K]AL (SEQ ID NO: 153) |
| SCRIB | scribble planar cell polarity protein (SCRIB) | B*07:02 | LPQQPP[L/P]SL (SEQ ID NO: 154) |
| MTRR | 5-methyltetrahydrofolate-homocysteine methyltransferase reductase (MTRR) | B*07:02 | SPAS[S/L]RTDL (SEQ ID NO: 155) |
| LLGL2 | LLGL scribble cell polarity complex component 2 (LLGL2) | B*07:02 | SPSL[R/H]ILAI (SEQ ID NO: 156) |
| LB-ECGF-1H | thymidine phosphorylase (TYMP) | B*07:02 | RP[H/R]AIRRPLAL (SEQ ID NO: 157) |
| LB-ERAP1-1R | endoplasmic reticulum aminopeptidase 1 (ERAP1) | B*07:02 | HP[R/P]QEQIALLA (11 mer) (SEQ ID NO: 158), HP[R/P]QEQIAL (9 mer) (SEQ ID NO: 159) |
| LB-FUCA2-1V | alpha-L-fucosidase 2 (FUCA2) | B*07:02 | RLRQ[V/M]GSWL (SEQ ID NO: 160) |
| LB-GEMIN4-1V | gem nuclear organelle associated protein 4 (GEMIN4) | B*07:02, B*08:01 | FPALRFVE[V/E] (SEQ ID NO: 161) |
| HDGF | heparin binding growth factor (HDGF) | B*07:02 | LPMEVEKNST[L/P] (SEQ ID NO: 162) |
| LB-PDCD11-1F | programmed cell death 11 (PDCD11) | B*07:02 | GPDSSKT[F/L]LCL (SEQ ID NO: 163) |

TABLE 10-continued

HLA Class I Autosomal MiHAs

| MiHA | Gene | HLA | Peptide A/B |
|---|---|---|---|
| LB-PFAS-1P | phosphoribosylformylglycinamidine synthase (PFAS) | B*07:02 | A[P/S]GHTRRKL (SEQ ID NO: 164) |
| LB-TEP1-1S | telomerase associated protein 1 (TEP1) | B*07:02 | APDGAKVA[S/P]L (SEQ ID NO: 165) |
| LB-TMEM8A-1I | post-glycosylphosphatidylinositol attachment to proteins 6 (TMEM8A or PGAP6) | B*07:02 | RPRSVT[I/V]QPLL (SEQ ID NO: 166) |
| LB-USP15-1I | ubiquitin specific peptidase 15 (USP15) | B*07:02 | MPSHLRN[I/T]LL (SEQ ID NO: 167) |
| LRH-1 | purinergic receptor P2X 5 (P2RX5) | B*07:02 | TPNQRQNVC (SEQ ID NO: 168) |
| LB-MOB3A-1C | MOB kinase activator 3A (MOB3A) | B*07:02 | [C/S]PRPGTWTC (SEQ ID NO: 169) |
| LB-ZDHHC6-1Y | zinc finger DHHC-type palmitoyltransferase 6 (ZDHHC6) | B*07:02 | RPR[Y/H]WILLVKI (SEQ ID NO: 170) |
| ZAPHIR | zinc finger protein 419 (ZNF419) | B*07:02 | IPRDSWWVEL (SEQ ID NO: 171) |
| HEATR1 | HEAT repeat containing 1 (HEATR1) | B*08:01 | ISKERA[E/G]AL (SEQ ID NO: 172) |
| LB-GSTP1-1V | glutathione S-transferase pi 1 (GSTP1) | B*08:01 | DLRCKY[V/I]SL (SEQ ID NO: 173) |
| HA-1/B60 | Rho GTPase activating protein 45 (HMHA1) | B*40:01 | KECVL[H/R] (SEQ ID NO: 174) |
| LB-SON-1R | SON DNA and RNA binding protein (SON) | B*40:01 | SETKQ[R/C]TVL (SEQ ID NO: 175) |
| LB-SWAP70-1Q | switching B cell complex subunit SWAP70 (SWAP70) | B*40:01 | MEQLE[Q/E]LEL (SEQ ID NO: 176) |
| LB-TRIP10-1EPC | thyroid hormone receptor interactor 10 (TRIP 10) | B*40:01 | G[E/G][P/S]QDL[C/G]TL (SEQ ID NO: 177) |
| LB-NUP133-1R | nucleoporin 133 (NUP133) | B*40:01 | SEDLILC[R/Q]L (SEQ ID NO: 178) |
| LB-ZNFX1-1Q | zinc finger NFX1-type containing 1 (ZNFX1) | B*40:01 | NEIEDVW[Q/H]LDL (SEQ ID NO: 179) |
| SLC1A5 | solute carrier family 1 member 5 (SLC1A5) | B*40:02 | AE[A/P]TANGGLAL (SEQ ID NO: 180) |
| ACC-2 | BCL2A1 | B*44:02, B*44:03 | KEFED[D/G]IINW (SEQ ID NO: 181) |
| ACC-6 | histocompatibility minor serpin domain containing (HMSD) | B*44:03 | MEIFIEVFSHF (SEQ ID NO: 182) |
| HB-1H/Y | histocompatibility minor HB-1 (HMHB1) | B*44:03 | EEKRGSL[H/Y] (SEQ ID NO: 183) |
| DPH1 | diphthamide biosynthesis 1 (DPH1) | B*57:01 | S[V/L]LPEVDVW (SEQ ID NO: 184) |
| UGT2B17/A02 | UDP glucuronosyltransferase family 2 member B17 (UGT2B17) | A*02:06 | CVATMIFMI (SEQ ID NO: 185) |
| UGT2B17/A29 | UGT2B17 | A*29:02 | AELLNIPFLY (SEQ ID NO: 186) |

TABLE 10-continued

HLA Class I Autosomal MiHAs

| MiHA | Gene | HLA | Peptide A/B |
|---|---|---|---|
| UGT2B17/B44 | UGT2B17 | B*44:03 | AELLNIPFLY (SEQ ID NO: 187) |

Exemplary, but non-limiting, examples of MiHAs that are envisaged as within the scope of the instant invention are disclosed in Table 11 below. Columns in Table 11 indicate, from left to right, the name of the MiHA, the gene which from which it is derived, MHC class I variant which can display the MiHA and the sequences of the peptide variants [A/B variants indicated in brackets).

TABLE 11

HLA Class I Y linked MiHAs

| MiHA | Gene | HLA | Peptide A/B |
|---|---|---|---|
| DFFRY | ubiquitin specific peptidase 9 Y-linked (DFFRY) | A*01:01 | IVD[C/S]LTEMY (SEQ ID NO: 188) |
| SMCY | lysine demethylase 5 (SMCY) | A*02:01 | FIDSYICQV (SEQ ID NO: 189) |
| TMSB4Y | thymosin beta 4 Y-linked (TMSB4Y) | A*33:03 | EVLLRPGLHFR (SEQ ID NO: 190) |
| SMCY | SMCY | B*07:02 | SP[S/A]VDKA[R/Q]AEL (SEQ ID NO: 191) |
| UTY | ubiquitously transcribed tetratricopeptide repeat containing, Y-linked (UTY) | B*08:01 | LPHN[H/R]T[D/N]L (SEQ ID NO: 192) |
| RPS4Y | ribosomal protein S4 Y-linked 1 (RPS4Y) | B*52:01 | TIRYPDP[V/L]I (*SEQ ID NO: 193*) |
| UTY | UTY | B*60:01 | [R/G]ESEE[E/A]S[V/P]SL (SEQ ID NO: 194) |

In some embodiments, the MiHA comprises HA-1. HA-1 is a peptide antigen having a sequence of VL[H/R]DDLLEA (SEQ ID NO: 105), and is derived from the Rho GTPase activating protein 45 (HA-1) gene.

Exemplary ligand binding domains that selectively bind to HA-1 variant H peptide (VLHDDLLEA (SEQ ID NO: 195)) are shown in Table 12 below. TCR alpha and TCR beta sequences are separated by a P2A self-cleaving polypeptide of sequence ATNFSLLKQAGDVEENPGP (SEQ ID NO: 196) with an N terminal GSG linker.

TABLE 12

Ftcr HA-1(H) Inhibitory receptor Sequences

| | |
|---|---|
| C-003754 KP7 HA-1H TCRalpha T48C P2A KP7 HA-1H TCRbeta S57C:<br>MVKIRQFLLAILWLQLSCVSAAKNEVEQSPQNLTAQEGEFITINCS<br>YSVGISALHWLQQHPGGGIVSLFMLSSGKKKHGRLIATINIQEKH<br>SSLHITASHPRDSAVYICAVRSVSGAGSYQLTFGKGTKLSVIPNIQ<br>NPDPAVYQLRDSKSSDKSVCLFTDFDSQTNVSQSKDSDVYITDKC<br>VLDMRSMDFKSNSAVAWSNKSDFACANAFNNSIIPEDTFFPSPES<br>SCDVKLVEKSFETDTNLNFQNLSVIGFRILLLKVAGFNLLMTLRL<br>WSSGSGATNFSLLKQAGDVEENPGPMGTSLLCWMALCLLGADH<br>ADTGVSQNPRHKITKRGQNVTFRCDPISEHNRLYWYRQTLGQGP<br>EFLTYFQNEAQLEKSRLLSDRFSAERPKGSFSTLEIQRTEQGDSAM<br>YLCASSIDSFNEQFFGPGTRLTVLEDLKNVFPPEVAVFEPSEAEISH<br>TQKATLVCLATGFYPDHVELSWWVNGKEVHSGVCTDPQPLKEQ<br>PALNDSRYCLSSRLRVSATFWQNPRNHFRCQVQFYGLSENDEWT | C-003754 KP7 HA-1H TCRalpha T48C P2A KP7 HA-1H TCRbeta S57C DNA Sequence: SEQ ID NO: 194 |

TABLE 12-continued

Ftcr HA-1(H) Inhibitory receptor Sequences

| | |
|---|---|
| QDRAKPVTQIVSAEAWGRADCGFTSESYQQGVLSATILYEILLGK<br>ATLYAVLVSALVLMAMVKRKDSRG (SEQ ID NO: 197) | |
| HA-1H TCR alpha:<br>MVKIRQFLLAILWLQLSCVSAAKNEVEQSPQNLTAQEGEFITINCS<br>YSVGISALHWLQQHPGGGIVSLFMLSSGKKKHGRLIATINIQEKH<br>SSLHITASHPRDSAVYICAVRSVSGAGSYQLTFGKGTKLSVIPNIQ<br>NPDPAVYQLRDSKSSDKSVCLFTDFDSQTNVSQSKDSDVYITDKC<br>VLDMRSMDFKSNSAVAWSNKSDFACANAFNNSIIPEDTFFPSPES<br>SCDVKLVEKSFETDTNLNFQNLS (SEQ ID: 198) | HA-1H<br>TCR alpha<br>DNA<br>Sequence:<br>SEQ ID<br>NO: 201 |
| HA-1(H) TCRbeta:<br>MGTSLLCWMALCLLGADHADTGVSQNPRHKITKRGQNVTFRCD<br>PISEHNRLYWYRQTLGQGPEFLTYFQNEAQLEKSRLLSDRFSAER<br>PKGSFSTLEIQRTEQGDSAMYLCASSIDSFNEQFFGPGTRLTVLED<br>LKNVFPPEVAVFEPSEAEISHTQKATLVCLATGFYPDHVELSWW<br>VNGKEVHSGVCTDPQPLKEQPALNDSRYCLSSRLRVSATFWQNP<br>RNHFRCQVQFYGLSENDEWTQDRAKPVTQIVSAEAWGRADCGF<br>TSESYQQGVLS (SEQ ID NO: 199) | HA-1H<br>TCRbeta<br>DNA<br>Sequence:<br>SEQ ID<br>NO: 202 |
| C-003755 KP7 HA-1H FTCRalpha LIR1 TICD:<br>MVKIRQFLLAILWLQLSCVSAAKNEVEQSPQNLTAQEGEFITINCS<br>YSVGISALHWLQQHPGGGIVSLFMLSSGKKKHGRLIATINIQEKH<br>SSLHITASHPRDSAVYICAVRSVSGAGSYQLTFGKGTKLSVIPNIQ<br>NPDPAVYQLRDSKSSDKSVCLFTDFDSQTNVSQSKDSDVYITDKC<br>VLDMRSMDFKSNSAVAWSNKSDFACANAFNNSIIPEDTFFPSPES<br>SCDVKLVEKSFETDTNLNFQNLSVVIGILVAVILLLLLLLLLFLILR<br>HRRQGKHWTSTQRKADFQHPAGAVGPEPTDRGLQWRSSPAADA<br>QEENLYAAVKHTQPEDGVEMDTRSPHDEDPQAVTYAEVKHSRP<br>RREMASPPSPLSGEFLDTKDRQAEEDRQMDTEAAASEAPQDVTY<br>AQLHSLTLRREATEPPPSQEGPSPAVPSIYATLAIH (SEQ ID NO:<br>200) | C-003755<br>KP7 HA-1H<br>FTCRalpha<br>LIR1 TICD<br>DNA<br>Sequence:<br>SEQ ID<br>NO: 196 |
| C-003756 KP7 HA-1H FTCRbeta LIR1 TICD:<br>MGTSLLCWMALCLLGADHADTGVSQNPRHKITKRGQNVTFRCD<br>PISEHNRLYWYRQTLGQGPEFLTYFQNEAQLEKSRLLSDRFSAER<br>PKGSFSTLEIQRTEQGDSAMYLCASSIDSFNEQFFGPGTRLTVLED<br>LKNVFPPEVAVFEPSEAEISHTQKATLVCLATGFYPDHVELSWW<br>VNGKEVHSGVCTDPQPLKEQPALNDSRYCLSSRLRVSATFWQNP<br>RNHFRCQVQFYGLSENDEWTQDRAKPVTQIVSAEAWGRADCGF<br>TSESYQQGVLSVVIGILVAVILLLLLLLLLFLILRHRRQGKHWTST<br>QRKADFQHPAGAVGPEPTDRGLQWRSSPAADAQEENLYAAVKH<br>TQPEDGVEMDTRSPHDEDPQAVTYAEVKHSRPRREMASPPSPLS<br>GEFLDTKDRQAEEDRQMDTEAAASEAPQDVTYAQLHSLTLRRE<br>ATEPPPSQEGPSPAVPSIYATLAIH (SEQ ID NO: 201) | C-003756<br>KP7 HA-1H<br>FTCRbeta<br>LIR1 TICD<br>DNA<br>Sequence:<br>SEQ ID<br>NO: 198 |

In some embodiments, the second, inhibitory ligand comprises HA-1(H). In some embodiments, the second, inhibitory ligand binding is isolated or derived from a TCR. In some embodiments, the second, inhibitory ligand binding domain comprises TCR alpha and TCR beta variable domains. In some embodiments, the TCR alpha and TCR beta variable domains are separated by a self-cleaving polypeptide sequence. In some embodiments, the TCR alpha and TCR beta variable domains separated by a self-cleaving polypeptide sequence comprise SEQ ID NO: 197. In some embodiments, the TCR alpha and TCR beta variable domains separated by a self-cleaving polypeptide sequence comprise SEQ ID NO: 197, or a sequence having at least 90%, at least 95%, or at least 99% identity thereto. In some embodiments, the TCR alpha and TCR beta variable domains are encoded by a sequence of SEQ ID NO: 202, or a sequence having at least 80% identity, at least 90%, at least 95%, or at least 99% identity thereto. In some embodiments, the TCR alpha variable domain comprises SEQ ID NO: 198 or a sequence having at least 90%, at least 95%, or at least 99% identity thereto. In some embodiments, the TCR beta variable domain comprises SEQ ID NO: 199 or a sequence having at least 90%, at least 95%, or at least 99% identity thereto.

Loss of Y Chromosome Antigens

In some embodiments, the second, inhibitor ligand comprises a Y chromosome gene, i.e. peptide encoded by a gene on the Y chromosome. In some embodiments, the second, inhibitor ligand comprises a peptide encoded by a Y chromosome gene that is lost in target cells through loss of Y chromosome (LoY). For example, about a third of the characterized MiHAs come from the Y chromosome. The Y chromosome contains over 200 protein coding genes, all of which are envisaged as within the scope of the instant disclosure.

As used herein, "loss of Y", or "LoY" refers a genetic change that occurs at high frequency in tumors whereby one copy of part or all of the Y chromosome is deleted, leading to a loss of Y chromosome encoded gene(s).

Loss of Y chromosome is known to occur in certain cancers. For example, there is a reported 40% somatic loss of Y chromosome in renal clear cell cancers (Arseneault et al., Sci. Rep. 7: 44876 (2017)). Similarly, clonal loss of the Y chromosome was reported in 5 out of 31 in male breast cancer subjects (Wong et al., Oncotarget 6(42):44927-40 (2015)). Loss of the Y chromosome in tumors from male patients has been described as a "consistent feature" of head and neck cancer patients (el-Naggar et al., Am J Clin Pathol 105(1):102-8 (1996)). Further, Y chromosome loss was associated with X chromosome disomy in four of seven male patients with gastric cancer (Saal et al., Virchows Arch B Cell Pathol (1993)). Thus, Y chromosome genes can be lost in a variety of cancers, and can be used as inhibitor ligands with the engineered receptors of the instant disclosure targeting cancer cells.

Chimeric Antigen Receptors (CARs)

In some embodiments, the either the first or the second engineered receptor is a chimeric antigen receptor (CAR). In some embodiments, the first and second engineered receptors are chimeric antigen receptors. All CAR architectures are envisaged as within the scope of the instant disclosure.

Extracellular Domains

In some embodiments, the extracellular domain of the CAR comprises the antigen binding domains described supra.

Hinge Region

In some embodiments, the CARs of the present disclosure comprise an extracellular hinge region. Incorporation of a hinge region can affect cytokine production from CAR-T cells and improve expansion of CAR-T cells in vivo. Exemplary hinges can be isolated or derived from IgG, CD28 or CD8, among others, for example IgG1. Exemplary hinge domains are provided in Table 13.

In some embodiments, the hinge is isolated or derived from CD8α or CD28. In some embodiments, the CD8α hinge comprises an amino acid sequence having at least 80% identity, at least 90% identity, at least 95% identity, at least 99% identity or is identical to a sequence of TTTPAPRPPT-PAPTIASQPLSLRPEACRPAAGGAVHTRGLDFACD (SEQ ID NO: 219). In some embodiments, the CD8α hinge comprises SEQ ID NO: 219. In some embodiments, the CD8α hinge consists essentially of SEQ ID NO: 219. In some embodiments, the CD8α hinge is encoded by a nucleotide sequence having at least 80% identity, at least 90% identity, at least 95% identity, at least 99% identity or is identical to a sequence of

```
                                      (SEQ ID NO: 220)
ACCACGACGCCAGCGCCGCGACCACCAACACCGGCGCCCACCATCGCGTC

GCAGCCCCTGTCCCTGCGCCCAGAGGCGTGCCGGCCAGCGGCGGGGGGCG

CAGTGCACACGAGGGGGCTGGACTTCGCCTGTGAT.
```

In some embodiments, the CD8α hinge is encoded by SEQ ID NO: 220.

In some embodiments, the CD28 hinge comprises an amino acid sequence having at least 80% identity, at least 90% identity, at least 95% identity, at least 99% identity or is identical to a sequence of CTIEVMYPPPYLD-NEKSNGTIIHVKGKHLCPSPLFPGPSKP (SEQ ID NO: 221). In some embodiments, the CD28 hinge comprises or consists essentially of SEQ ID NO: 221. In some embodiments, the CD28 hinge is encoded by a nucleotide sequence having at least 80% identity, at least 90% identity, at least 95% identity, at least 99% identity or is identical to a sequence of:

```
                                      (SEQ ID NO: 222)
TGTACCATTGAAGTTATGTATCCTCCTCCTTACCTAGACAATGAGAAGAG

CAATGGAACCATTATCCATGTGAAAGGGAAACACCTTTGTCCAAGTCCCC

TATTTCCCGGACCTTCTAAGCCC.
```

In some embodiments, the CD28 hinge is encoded by SEQ ID NO: 222.

In some embodiments, the activator receptor comprises a hinge sequence isolated or derived from CD8, CD28, IgG1, or IgG4, or a synthetic hinge.

TABLE 13

Hinge Domain Sequences and Their Use in HER2 CAR Constructs

| CAR Construct | Hinge | Protein Sequence | DNA Sequence |
|---|---|---|---|
| CT-292 | CD8 | FVPVFLPAKPTT TPAPRPPTPAPTI ASQPLSLRPEAC RPAAGGAVHTR GLDFACD (SEQ ID NO 223) | TTCGTGCCGGTCTTCCTGCCAGCGAAGCCCA CCACGACGCCAGCGCCGCGACCACCAACAC CGGCGCCCACCATCGCGTCGCAGCCCCTGTC CCTGCGCCCAGAGGCGTGCCGGCCAGCGGC GGGGGGCGCAGTGCACACGAGGGGCTGGA CTTCGCCTGTGAT (SEQ ID NO 224) |
| CT-297 | CD28 | IEVMYPPPYLDN EKSNGTIIHVKG KHLCPSPLFPGP SKP (SEQ ID NO 225) | ATTGAAGTTATGTATCCTCCTCCTTACCTAG ACAATGAGAAGAGCAATGGAACCATTATCC ATGTGAAAGGGAAACACCTTTGTCCAAGTCC CCTATTTCCCGGACCTTCTAAGCCC (SEQ ID NO 226) |
| CT-298 | Short linker | GGGSSGGGSG (SEQ ID NO: 1) | GGTGGCGGTTCTTCCGGCGGTGGCTCTGGT (SEQ ID NO: 227) |
| CT-299 | IgG4 (EQ) | ESKYGPPCPSCP APEFEGGPSVFL FPPKPKDTLMIS RTPEVTCVVVD VSQEDPEVQFN WYVDGVEVHN AKTKPREEQFQ STYRVVSVLTV LHQDWLNGKE YKCKVSNKGLP SSIEKTISKAKG QPREPQVYTLPP | GAGTCCAAATATGGTCCCCCATGCCCATCAT GCCCAGCACCTGAGTTCGAGGGGGGACCAT CAGTCTTCCTGTTCCCCCCAAAACCCAAGGA CACTCTCATGATCTCCCGGACCCCTGAGGTC ACGTGCGTGGTGGTGGACGTGAGCCAGGAA GACCCCGAGGTCCAGTTCAACTGGTACGTGG ATGGCGTGGAGGTGCATAATGCCAAGACAA AGCCGCGGGAGGAGCAGTTCCAGAGCACGT ACCGTGTGGTCAGCGTCCTCACCGTCCTGCA CCAGGACTGGCTGAACGGCAAGGAGTACAA GTGCAAGGTCTCCAACAAAGGCCTCCCGTCC TCCATCGAGAAAACCATCTCCAAAGCCAAA |

TABLE 13-continued

Hinge Domain Sequences and Their Use in HER2 CAR Constructs

| CAR Construct | Hinge | Protein Sequence | DNA Sequence |
|---|---|---|---|
| | | SQEEMTKNQVS LTCLVKGFYPS DIAVEWESNGQ PENNYKTTPPVL DSDGSFFLYSRL TVDKSRWQEGN VFSCSVMHEAL HNHYTQKSLSL SLGK (SEQ ID NO: 228) | GGGCAGCCCCGAGAGCCACAGGTGTACACC CTGCCCCCATCCCAGGAGGAGATGACCAAG AACCAGGTCAGCCTGACCTGCCTGGTCAAA GGCTTCTACCCCAGCGACATCGCCGTGGAGT GGGAGAGCAATGGGCAGCCGGAGAACAACT ACAAGACCACGCCTCCCGTGCTGGACTCCGA CGGCTCCTTCTTCCTCTACAGCAGGCTCACC GTGGACAAGAGCAGGTGGCAGGAGGGGAAT GTCTTCTCATGCTCCGTGATGCATGAGGCTC TGCACAACCACTACACACAGAAGAGCCTCT CCCTGTCTCTGGGTAAA (SEQ ID NO: 229) |
| CT-1094, CT-1095 | IgG1 | AEPKSPDKTHT CPPCPKDPK (SEQ ID NO: 230) | GCCGAGCCCAAGTCCCCTGATAAAACTCAC ACCTGCCCACCCTGTCCTAAGGACCCGAAG (SEQ ID NO: 231) |

In some embodiments, for example those embodiments where the CAR is an activator receptor, the hinge comprises a sequence of SEQ ID NO: 1, 223, 225, 228, or 230, or a sequence having at least 80%, at least 85%, at least 90%, at least 95%, at least 97%, at least 99%, or that is identical thereto. In some embodiments, for example those embodiments where the CAR is an activator receptor, the hinge comprises a sequence of SEQ ID NO: 1, 223, 225, 228, or 230.

Transmembrane Domain

The CARs of the present disclosure can be designed to comprise a transmembrane domain that is fused to the extracellular domain of the CAR. In some embodiments, the transmembrane domain that naturally is associated with one of the domains in the CAR is used. For example, a CAR comprising a CD28 co-stimulatory domain might also use a CD28 transmembrane domain. In some instances, the transmembrane domain can be selected or modified by amino acid substitution to avoid binding of such domains to the transmembrane domains of the same or different surface membrane proteins to minimize interactions with other members of the receptor complex.

The transmembrane domain may be derived either from a natural or from a synthetic source. Where the source is natural, the domain may be derived from any membrane-bound or transmembrane protein. Transmembrane regions may be isolated or derived from (i.e. comprise at least the transmembrane region(s) of) the alpha, beta or zeta chain of the T-cell receptor, CD28, CD3 epsilon, CD45, CD4, CD5, CD8, CD9, CD16, CD22, CD33, CD37, CD64, CD80, CD86, CD134, CD137, CD154, or from an immunoglobulin such as IgG4. Alternatively the transmembrane domain may be synthetic, in which case it will comprise predominantly hydrophobic residues such as leucine and valine. In some embodiments, a triplet of phenylalanine, tryptophan and valine will be found at each end of a synthetic transmembrane domain. Optionally, a short oligo- or polypeptide linker, preferably between 2 and 10 amino acids in length may form the linkage between the transmembrane domain and the cytoplasmic signaling domain of the CAR. A glycine-serine doublet provides a particularly suitable linker.

In some embodiments of the CARs of the disclosure, the CARs comprise a CD28 transmembrane domain. In some embodiments, the CD28 transmembrane domain comprises an amino acid sequence having at least 80% identity, at least 90% identity, at least 95% identity, at least 99% identity or is identical to a sequence of FWVLVVVGGVLACYSLL-VTVAFIIFWV (SEQ ID NO: 232). In some embodiments, the CD28 transmembrane domain comprises or consists essentially of SEQ ID NO: 232. In some embodiments, the CD28 transmembrane domain is encoded by a nucleotide sequence having at least 80% identity, at least 90% identity, at least 95% identity, at least 99% identity or is identical to a sequence of (SEQ ID NO: 233)
TTCTGGGTGCTGGTCGTTGTGGGCGGCGTGCTGGCCTGCTACAGCCTGCT

GGTGACAGTGGCCTTCATCATCTTTTGGGTG.

In some embodiments, the CD28 transmembrane domain is encoded by SEQ ID NO: 233.

In some embodiments of the CARs of the disclosure, the CARs comprise an IL-2Rbeta transmembrane domain. In some embodiments, the IL-2Rbeta transmembrane domain comprises an amino acid sequence having at least 80% identity, at least 90% identity, at least 95% identity, at least 99% identity or is identical to a sequence of IPWLGHLL-VGLSGAFGFIILVYLLI (SEQ ID NO: 234). In some embodiments, the IL-2Rbeta transmembrane domain comprises or consists essentially of SEQ ID NO: 234. In some embodiments, the IL-2Rbeta transmembrane domain is encoded by a nucleotide sequence having at least 80% identity, at least 90% identity, at least 95% identity, at least 99% identity or is identical to a sequence of (SEQ ID NO: 235)
ATTCCGTGGCTCGGCCACCTCCTCGTGGGCCTCAGCGGGGCTTTTGGCTT

CATCATCTTAGTGTACTTGCTGATC.

In some embodiments, the IL-2Rbeta transmembrane domain is encoded by SEQ ID NO: 235.

In some embodiments, the CAR comprises a transmembrane domain isolated or derived from CD8 or CD28. In some embodiments, the CAR comprises a transmembrane domain sequence in Table 14. In some embodiments, the CAR comprises a transmembrane domain sequence of SEQ ID NO: 232 or SEQ ID NO: 236, or a sequence having at least 80% identity, at least 90% identity, at least 95% identity, at least 99% identity or is identical thereto. In some embodiments, the CAR comprises a transmembrane domain sequence of SEQ ID NO: 232 or SEQ ID NO: 236. In some embodiments, the CAR comprises a transmembrane domain sequence of SEQ ID NO: 561.

TABLE 14

Transmembrane Domain Sequences and their use in HER2 CAR Constructs

| CAR Construct | TM Domain | Protein Sequence | DNA Sequence |
|---|---|---|---|
| CT-298, CT-299 | CD8 | IYIWAPLAGTCGVL LLSLVIT (SEQ ID NO: 236) | ATCTACATCTGGGCGCCCTTGGCCG GGACTTGTGGGGTCCTTCTCCTGTC ACTGGTTATCACC (SEQ ID NO: 237) |
| CT-292 | CD8 | IYIWAPLAGTCGVL LLSLVITLYCNHRN (SEQ ID NO: 561) | ATCTACATCTGGGCGCCCTTGGCCG GGACTTGTGGGGTCCTTCTCCTGTC ACTGGTTATCACCCTTTACTGCAAC CACAGGAAC (SEQ ID NO: 562) |
| CT-297, CT-1094, CT1095 | CD28 | FWVLVVVGGVLAC YSLLVTVAFIIFWV (SEQ ID NO: 232) | TTCTGGGTGCTGGTCGTTGTGGGCG GCGTGCTGGCCTGCTACAGCCTGCT GGTGACAGTGGCCTTCATCATCTTT TGGGTG (SEQ ID NO: 233) |

Cytoplasmic Domain

The disclosure provides an activator receptor comprising an extracellular ligand binding domain specific to an erb-b2 receptor tyrosine kinase 2 (HER2) antigen. In some embodiments, the activator receptor is a T cell receptor (TCR) or a chimeric antigen receptor (CAR). In some embodiments, the CAR comprises an intracellular domain isolated or derived from CD28, 4-1BB or CD3z, or a combination thereof.

The cytoplasmic domain or otherwise the intracellular signaling domain of the CARs of the instant invention is responsible for activation of at least one of the normal effector functions of the immune cell in which the CAR has been placed. The term "effector function" refers to a specialized function of a cell. Effector functions of a regulatory T cell, for example, include the suppression or downregulation of induction or proliferation of effector T cells. Thus the term "intracellular signaling domain" refers to the portion of a protein which transduces the effector function signal and directs the cell to perform a specialized function. While usually the entire intracellular signaling domain can be employed, in many cases it is not necessary to use the entire domain. To the extent that a truncated portion of the intracellular signaling domain is used, such truncated portion may be used in place of the intact chain as long as it transduces the effector function signal. In some cases, multiple intracellular domains can be combined to achieve the desired functions of the CAR-T cells of the instant disclosure. The term intracellular signaling domain is thus meant to include any truncated portion of one or more intracellular signaling domains sufficient to transduce the effector function signal.

Examples of intracellular signaling domains for use in the CARs of the instant disclosure include the cytoplasmic sequences of the T cell receptor (TCR) and co-receptors that act in concert to initiate signal transduction following antigen receptor engagement, as well as any derivative or variant of these sequences and any synthetic sequence that has the same functional capability.

Accordingly, the intracellular domain of CARs of the instant disclosure comprises at least one cytoplasmic activation domain. In some embodiments, the intracellular activation domain ensures that there is T-cell receptor (TCR) signaling necessary to activate the effector functions of the CAR T-cell. In some embodiments, the at least one cytoplasmic activation is a CD247 molecule (CD3ζ) activation domain, a stimulatory killer immunoglobulin-like receptor (KIR) KIR2DS2 activation domain, or a DNAX-activating protein of 12 kDa (DAP12) activation domain. In some embodiments, the CD3ζ activation domain comprises an amino acid sequence having at least 80% identity, at least 90% identity, at least 95% identity, at least 99% identity or is identical to a sequence of (SEQ ID NO: 238)
RVKFSRSADAPAYKQGQNQLYNELNLGRREEYDVLDKRRGRDPEMGGKPR

RKNPQEGLYNELQKDKMAEAYSEIGMKGERRRGKGHDGLYQGLSTATKDT

YDALHMQALPPR.

In some embodiments, the CD3ζ activation domain comprises or consists essentially of SEQ ID NO: 238. In some embodiments, the CD3ζ activation domain is encoded by a nucleotide sequence having at least 80% identity, at least 90% identity, at least 95% identity, at least 99% identity or is identical to a sequence of AGAGTGAAGTTCAGCAG-GAGCGCAGACGCCCCCGCGTA-CAAGCAGGGCCAGAA CCAGCTCTATAACGAGCT-CAATCTAGGACGAAGAGAGGAGTACGATGTTTTG GA CAAGCGTAGAGGCCGGGACCCT-GAGATGGGGGGAAAGCCGAGAAGGAAGAACC CTCAGGAAGGCCTGTACAATGAACTGCAGAAAGA-TAAGATGGCGGAGGCCTACA GTGAGATTGGGAT-GAAAGGCGAGCGCCGGAGGGGCAAGGGGCAC-GATGGCCTT TACCAGGGACTCAGTACAGCCACCAAGGACACC-TACGACGCCCTTCACATGCAG GCCCTGCCCCCTCGC (SEQ ID NO: 239). In some embodiments, the CD3ζ activation domain is encoded by SEQ ID NO: 239.

It is known that signals generated through the TCR alone are often insufficient for full activation of the T cell and that a secondary or co-stimulatory signal is also required. Thus, T cell activation can be said to be mediated by two distinct classes of cytoplasmic signaling sequence: those that initiate antigen-dependent primary activation through the TCR (primary cytoplasmic signaling sequences) and those that act in an antigen-independent manner to provide a secondary or co-stimulatory signal (secondary cytoplasmic signaling sequences).

Primary cytoplasmic signaling sequences regulate primary activation of the TCR complex either in a stimulatory way, or in an inhibitory way. Primary cytoplasmic signaling sequences that act in a stimulatory manner may contain signaling motifs which are known as immunoreceptor tyrosine-based activation motifs or ITAMs. In some embodiments, the ITAM contains a tyrosine separated from a leucine or an isoleucine by any two other amino acids (YxxL) (SEQ ID NO: 240).

In some embodiments, the cytoplasmic domain contains 1, 2, or 3 ITAMs. In some embodiments, the cytoplasmic domain contains 1 ITAM. In some embodiments, the cytoplasmic domain contains 2 ITAMs. In some embodiments, the cytoplasmic domain contains 3 ITAMs. In some embodiments, the cytoplasmic domain contains 4 ITAMs. In some embodiments, the cytoplasmic domain contains 5 ITAMs.

In some embodiments, the cytoplasmic domain is a CD3ζ activation domain. In some embodiments, CD3ζ activation domain comprises a single ITAM. In some embodiments, CD3ζ activation domain comprises two ITAMs. In some embodiments, CD3ζ activation domain comprises three ITAMs.

In some embodiments, the CD3ζ activation domain comprising a single ITAM comprises an amino acid sequence having at least 80% identity, at least 90% identity, at least 95% identity, at least 99% identity or is identical to a sequence of (SEQ ID NO: 241)
RVKFSRSADAPAYQQGQNQLYNELNLGRREEYDVLHMQALPPR.

In some embodiments, the CD3ζ activation domain comprises SEQ ID NO: 241. In some embodiments, the CD3ζ activation domain comprising a single ITAM consists essentially of an amino acid sequence of (SEQ ID NO: 241)
RVKFSRSADAPAYQQGQNQLYNELNLGRREEYDVLHMQALPPR.

In some embodiments, the CD3ζ activation domain comprising a single ITAM is encoded by a nucleotide sequence having at least 80% identity, at least 90% identity, at least 95% identity, at least 99% identity or is identical to a sequence of AGAGTGAAGTTCAGCAGGAGCGCAGACGCCCCCGCGTACCAGCAGGGCCAGAACCAGCTCTATAACGAGCTCAATCTAGGACGAAGAGAGGAGTACGATGTTTTGCACATGCAGGCCCTGCCCCCTCGC (SEQ ID NO: 242). In some embodiments, the CD3ζ activation domain is encoded by SEQ ID NO: 242.

Further examples of ITAM containing primary cytoplasmic signaling sequences that can be used in the CARs of the instant disclosure include those derived from TCRζ, FcRγ, FcRβ, CD3γ, CD3δ, CD3ε, CD3ζ, CD5, CD22, CD79a, CD79b, and CD66d. It is particularly preferred that cytoplasmic signaling molecule in the CAR of the instant invention comprises a cytoplasmic signaling sequence derived from CD3.

Co-Stimulatory Domain

In some embodiments, the cytoplasmic domain of the CAR can be designed to comprise the CD3ζ signaling domain by itself or combined with any other desired cytoplasmic domain(s) useful in the context of the CAR of the instant disclosure. For example, the cytoplasmic domain of the CAR can comprise a CD3ζ chain portion and a co-stimulatory domain. The co-stimulatory domain refers to a portion of the CAR comprising the intracellular domain of a costimulatory molecule. A costimulatory molecule is a cell surface molecule other than an antigen receptor or its ligands that is required for an efficient response of lymphocytes to an antigen. Examples of such molecules include the co-stimulatory domain is selected from the group consisting of IL-2Rβ, Fc Receptor gamma (FcRγ), Fc Receptor beta (FcRβ), CD3g molecule gamma (CD3γ), CD3δ, CD3ε, CD5 molecule (CD5), CD22 molecule (CD22), CD79a molecule (CD79a), CD79b molecule (CD79b), carcinoembryonic antigen related cell adhesion molecule 3 (CD66d), CD27 molecule (CD27), CD28 molecule (CD28), TNF receptor superfamily member 9 (4-1BB), TNF receptor superfamily member 4 (OX40), TNF receptor superfamily member 8 (CD30), CD40 molecule (CD40), programmed cell death 1 (PD-1), inducible T cell costimulatory (ICOS), lymphocyte function-associated antigen-1 (LFA-1), CD2 molecule (CD2), CD7 molecule (CD7), TNF superfamily member 14 (LIGHT), killer cell lectin like receptor C2 (NKG2C) and CD276 molecule (B7-H3) c-stimulatory domains, or functional fragments thereof.

The cytoplasmic domains within the cytoplasmic signaling portion of the CARs of the instant disclosure may be linked to each other in a random or specified order. Optionally, a short oligo- or polypeptide linker, for example between 2 and 10 amino acids in length may form the linkage. A glycine-serine doublet provides an example of a suitable linker.

In some embodiments, the intracellular domains of CARs of the instant disclosure comprise at least one co-stimulatory domain. In some embodiments, the co-stimulatory domain is isolated or derived from CD28. In some embodiments, the CD28 co-stimulatory domain comprises an amino acid sequence having at least 80% identity, at least 90% identity, at least 95% identity, at least 99% identity or is identical to a sequence of (SEQ ID NO: 243)
RSKRSRLLHSDYMNMTPRRPGPTRKHYQPYAPPRDFAAYRS.

In some embodiments, the CD28 co-stimulatory domain comprises or consists essentially of SEQ ID NO: 243. In some embodiments, the CD28 co-stimulatory domain is encoded by a nucleotide sequence having at least 80% identity, at least 90% identity, at least 95% identity, at least 99% identity or is identical to a sequence of AGGAGCAAGCGGAGCAGACTGCTGCACAGCGACTACATGAACATGACCCCCCGG AGGCCTGGCCCCACCCGGAAGCACTACCAGCCCTACGCCCCTCCCAGGGATTTCGCCGCCTACCGGAGC (SEQ ID NO: 244). In some embodiments, the CD28 co-stimulatory domain is encoded by SEQ ID NO: 44.

In some embodiments, the intracellular domain of the CARs of the instant disclosure comprises an interleukin-2 receptor beta-chain (IL-2Rbeta or IL-2R-beta) cytoplasmic domain. In some embodiments, the IL-2Rbeta domain is truncated. In some embodiments, the IL-2Rbeta cytoplasmic domain comprises one or more STAT5-recruitment motifs. In some embodiments, the CAR comprises one or more STAT5-recruitment motifs outside the IL-2Rbeta cytoplasmic domain.

In some embodiments, the IL-2-Rbeta intracellular domain comprises an amino acid sequence having at least 80% identity, at least 90% identity, at least 95% identity, at least 99% identity or is identical to a sequence of NCRNTGPWLKKVLKCNTPDPSKFF-SQLSSEHGGDVQKWLSSPFPSSSFSPGGLAPEIS PLEVLERDKVTQLLPLNTDAYLSLQELQGQDPTHLV (SEQ ID NO: 245). In some embodiments, the IL2R-beta intracellular domain comprises or consists essentially of SEQ ID NO: 245. In some embodiments, the IL-2R-beta intracellular domain is encoded by a nucleotide sequence having at least 80% identity, at least 90% identity, at least 95% identity, at least 99% identity or is identical to a sequence of AACTGCAGGAACACCGGGCCATGGCTGAAGAAGGTCCTGAAGTGTAACACCCCAGACCCCTCGAAGTTCTTTTCCCAGCTGAGCTCAGAGCATGGAGGCGACGTCCAGAAGTGGCTCTCTTCGCCCTTCCCCTCATCGTCCTTCAGCCCTGGCGGCCTGGCACCTGAGATCTCGCCACTAGAAGTGCTGGAGAGGGACAAGGTGACGCAGCTGCTCCCCCTGAACACTGATGCCTACTTGTCTCTCCAAGAACTCCAGGGTCAGGACCCAACTCACTTGGTG (SEQ ID NO: 246). In some embodiments, the IL-2R-beta intracellular domain is encoded by SEQ ID NO: 246.

In an embodiment, the IL-2R-beta cytoplasmic domain comprises one or more STAT5-recruitment motifs. Exemplary STAT5-recruitment motifs are provided by Passerini et al. (2008) STAT5-signaling cytokines regulate the expression of FOXP3 in CD4+CD25+ regulatory T cells and CD4+CD25+ effector T cells. International Immunology, Vol. 20, No. 3, pp. 421-431, and by Kagoya et al. (2018) A novel chimeric antigen receptor containing a JAK-STAT signaling domain mediates superior antitumor effects. Nature Medicine doi:10.1038/nm.4478.

In some embodiments, the STAT5-recruitment motif(s) consists of the sequence Tyr-Leu-Ser-Leu (SEQ ID NO: 247).

In some embodiments, the CAR comprises an intracellular domain isolated or derived from CD28, 4-1BB and/or CD3z, or a combination thereof. Exemplary domains derived from CD28, 4-1BB and/or CD3z are shown in Table 15 below. In some embodiments, the CAR comprises an intracellular domain comprising a sequence of SEQ ID NOS: 248, 250 or 252, or a sequence having at least 80%, at least 85%, at least 90%, at least 95%, at least 97%, at least 99%, or that is identical thereto. In some embodiments, the CAR comprises an intracellular domain comprising a sequence of SEQ ID NOS: 248, 250 or 252. In some embodiments, the CAR intracellular domain is encoded by the sequence set forth in any one of SEQ ID NOs: 249, 251, 253, or 21804.

TABLE 15

Intracellular Domain Sequences and their use in HER2 CAR Constructs

| CAR Construct | IC Domain | Protein Sequence | DNA Sequence |
|---|---|---|---|
| CT-292 | CD28-4-1BB-CD3z | RSKRSRLLHS DYMNMTPRR PGPTRKHYQP YAPPRDFAA YRSRFSVVKR GRKKLLYIFK QPFMRPVQTT QEEDGCSCRF PEEEEGGCEL RVKFSRSADA PAYQQGQNQ LYNELNLGR REEYDVLDK RRGRDPEMG GKPRRKNPQ EGLYNELQK DKMAEAYSEI GMKGERRRG KGHDGLYQG LSTATKDTYD ALHMQALPP R (SEQ ID NO: 248) | AGGAGTAAGAGGAGCAGGCTCCTGCAC AGTGACTACATGAACATGACTCCCCGC CGCCCCGGGCCCACCCGCAAGCATTAC CAGCCCTATGCCCCACCACGCGACTTCG CAGCCTATCGCTCCCGTTTCTCTGTTGT TAAACGGGGCAGAAAGAAGCTCCTGTA TATATTCAAACAACCATTTATGAGACCA GTACAAACTACTCAAGAGGAAGATGGC TGTAGCTGCCGATTTCCAGAAGAAGAA GAAGGAGGATGTGAACTGAGAGTGAAG TTCAGCAGGAGCGCAGACGCCCCCGCG TACCAGCAGGGCCAGAACCAGCTCTAT AACGAGCTCAATCTAGGACGAAGAGAG GAGTACGATGTTTTGGACAAGAGACGT GGCCGGGACCCTGAGATGGGGGGAAAG CCGAGAAGGAAGAACCCTCAGGAAGGC CTGTACAATGAACTGCAGAAAGATAAG ATGGCGGAGGCCTACAGTGAGATTGGG ATGAAAGGCGAGCGCCGGAGGGGCAA GGGGCACGATGGCCTTTACCAGGGTCT CAGTACAGCCACCAAGGACACCTACGA CGCCCTTCACATGCAGGCCCTGCCCCCT CGCTAG (SEQ ID NO: 249) |
| CT-297, CT-1094, CT-1095 | CD28-CD3z | RSKRSRLLHS DYMNMTPRR PGPTRKHYQP YAPPRDFAA YRSRVKFSRS ADAPAYKQG QNQLYNELN LGRREEYDV LDKRRGRDP EMGGKPRRK NPQEGLYNEL QKDKMAEAY SEIGMKGERR RGKGHDGLY QGLSTATKDT YDALHMQAL PPR (SEQ ID NO: 250) | AGGAGCAAGCGGAGCAGACTGCTGCAC AGCGACTACATGAACATGACCCCCCGG AGGCCTGGCCCCACCCGGAAGCACTAC CAGCCCTACGCCCCTCCCAGGGATTTCG CCGCCTACCGGAGCAGAGTGAAGTTCA GCAGGAGCGCAGACGCCCCCGCGTACA AGCAGGGCCAGAACCAGCTCTATAACG AGCTCAATCTAGGACGAAGAGAGGAGT ACGATGTTTTGGACAAGCGTAGAGGCC GGGACCCTGAGATGGGGGGAAAGCCGA GAAGGAAGAACCCTCAGGAAGGCCTGT ACAATGAACTGCAGAAAGATAAGATGG CGGAGGCCTACAGTGAGATTGGGATGA AAGGCGAGCGCCGGAGGGGCAAGGGG CACGATGGCCTTTACCAGGGACTCAGT ACAGCCACCAAGGACACCTACGACGCC CTTCACATGCAGGCCCTGCCCCCTCGCT AG (SEQ ID NO: 251) |
| CT-298, CT-299 | 4-1BB-CD3z | KRGRKKLLYI FKQPFMRPV | AAACGGGGCAGAAAGAAGCTCCTGTAT ATATTCAAACAACCATTTATGAGACCA |

TABLE 15-continued

Intracellular Domain Sequences and their use in HER2 CAR Constructs

| CAR Construct IC Domain | Protein Sequence | DNA Sequence |
|---|---|---|
| | QTTQEEDGCS | GTACAAACTACTCAAGAGGAAGATGGC |
| | CRFPEEEEGG | TGTAGCTGCCGATTTCCAGAAGAAGAA |
| | CELGGGRVK | GAAGGAGGATGTGAACTGGGCGGTGGC |
| | FSRSADAPAY | AGAGTGAAGTTCAGCAGGAGCGCAGAC |
| | QQGQNQLYN | GCCCCCGCGTACCAGCAGGGCCAGAAC |
| | ELNLGRREEY | CAGCTCTATAACGAGCTCAATCTAGGA |
| | DVLDKRRGR | CGAAGAGAGGAGTACGATGTTTTGGAC |
| | DPEMGGKPR | AAGAGACGTGGCCGGGACCCTGAGATG |
| | RKNPQEGLY | GGGGGAAAGCCGAGAAGGAAGAACCC |
| | NELQKDKMA | TCAGGAAGGCCTGTACAATGAACTGCA |
| | EAYSEIGMKG | GAAAGATAAGATGGCGGAGGCCTACAG |
| | ERRRGKGHD | TGAGATTGGGATGAAAGGCGAGCGCCG |
| | GLYQGLSTAT | GAGGGGCAAGGGGCACGATGGCCTTTA |
| | KDTYDALHM | CCAGGGTCTCAGTACAGCCACCAAGGA |
| | QALPPR (SEQ ID NO: 252) | CACCTACGACGCCCTTCACATGCAGGC CCTGCCCCCTCGCTAG (SEQ ID NO: 253) |

T Cell Receptors (TCRs)

The disclosure provides a first, activator receptor and immune cells comprising same. In some embodiments, the first receptor is a T cell receptor (TCR). Exemplary TCRs comprising intracellular domains for use in the instant disclosure are described in PCT/US2020/045250 filed on Sep. 6, 2020, the contents of which are incorporated herein by reference.

As used herein, a "TCR", sometimes also called a "TCR complex" or "TCR/CD3 complex" refers to a protein complex comprising a TCR alpha chain, a TCR beta chain, and one or more of the invariant CD3 chains (zeta, gamma, delta and epsilon), sometimes referred to as subunits. The TCR alpha and beta chains can be disulfide-linked to function as a heterodimer to bind to peptide-MHC complexes. Once the TCR alpha/beta heterodimer engages peptide-MHC, conformational changes in the TCR complex in the associated invariant CD3 subunits are induced, which leads to their phosphorylation and association with downstream proteins, thereby transducing a primary stimulatory signal. In an exemplary TCR complex, the TCR alpha and TCR beta polypeptides form a heterodimer, CD3 epsilon and CD3 delta form a heterodimer, CD3 epsilon and CD3 gamma form a heterodimer, and two CD3 zeta form a homodimer.

Any suitable ligand binding domain may be fused to an extracellular domain, hinge domain or transmembrane of the TCRs described herein. For example, the ligand binding domain can be an antigen binding domain of an antibody or TCR, or comprise an antibody fragment, a Vβ only domain, a linear antibody, a single-chain variable fragment (scFv), or a single domain antibody (sdAb).

In some embodiments, the ligand binding domain is fused to one or more extracellular domains or transmembrane domains of one or more TCR subunits. The TCR subunit can be TCR alpha, TCR beta, CD3 delta, CD3 epsilon, CD3 gamma or CD3 zeta. For example, the ligand binding domain can be fused to TCR alpha, or TCR beta, or portions of the ligand binding can be fused to two subunits, for example portions of the ligand binding domain can be fused to both TCR alpha and TCR beta.

TCR subunits include TCR alpha, TCR beta, CD3 zeta, CD3 delta, CD3 gamma and CD3 epsilon. Any one or more of TCR alpha, TCR beta chain, CD3 gamma, CD3 delta, CD3 epsilon, or CD3 zeta, or fragments or derivative thereof, can be fused to one or more domains capable of providing a stimulatory signal of the disclosure, thereby enhancing TCR function and activity.

TCR transmembrane domains isolated or derived from any source are envisaged as within the scope of the disclosure. The transmembrane domain may be derived either from a natural or from a recombinant source. Where the source is natural, the domain may be derived from any membrane-bound or transmembrane protein.

In some embodiments, the transmembrane domain is capable of signaling to the intracellular domain(s) whenever the TCR complex has bound to a target. A transmembrane domain of particular use in this disclosure may include at least the transmembrane region(s) of e.g., the alpha, beta or zeta chain of the TCR, CD3 delta, CD3 epsilon or CD3 gamma, CD28, CD3 epsilon, CD45, CD4, CD5, CD8, CD9, CD16, CD22, CD33, CD37, CD64, CD80, CD86, CD134, CD137, CD154.

In some embodiments, the transmembrane domain can be attached to the extracellular region of a polypeptide of the TCR, e.g., the antigen binding domain of the TCR alpha or beta chain, via a hinge, e.g., a hinge from a human protein. For example, the hinge can be a human immunoglobulin (Ig) hinge, e.g., an IgG4 hinge, or a CD8α hinge. In some embodiments, the hinge is isolated or derived from CD8α or CD28.

In some embodiments, the extracellular ligand binding domain is attached to one or more transmembrane domains of the TCR. In some embodiments, the transmembrane domain comprises a TCR alpha transmembrane domain, a TCR beta transmembrane domain, or both. In some embodiments, the transmembrane comprises a CD3 zeta transmembrane domain.

A transmembrane domain can include one or more additional amino acids adjacent to the transmembrane region, e.g., one or more amino acid associated with the extracellular region of the protein from which the transmembrane was derived (e.g., 1, 2, 3, 4, 5, 6, 7, 8, 9, 10 or up to 15 amino acids of the extracellular region) and/or one or more additional amino acids associated with the intracellular region of the protein from which the transmembrane protein is derived (e.g., 1, 2, 3, 4, 5, 6, 7, 8, 9, 10 or up to 15 amino acids of the intracellular region).

In some embodiments, the transmembrane domain can be selected or modified by amino acid substitution to avoid binding of such domains to the transmembrane domains of the same or different surface membrane proteins, e.g., to minimize interactions with other members of the receptor complex.

When present, the transmembrane domain may be a natural TCR transmembrane domain, a natural transmembrane domain from a heterologous membrane protein, or an artificial transmembrane domain. The transmembrane domain may be a membrane anchor domain. Without limitation, a natural or artificial transmembrane domain may comprise a hydrophobic a-helix of about 20 amino acids, often with positive charges flanking the transmembrane segment. The transmembrane domain may have one transmembrane segment or more than one transmembrane segment. Prediction of transmembrane domains/segments may be made using publicly available prediction tools (e.g. TMHMM, Krogh et al. Journal of Molecular Biology 2001; 305(3):567-580; or TMpred, Hofmann & Stoffel Biol. Chem. Hoppe-Seyler 1993; 347: 166). Non-limiting examples of membrane anchor systems include platelet derived growth factor receptor (PDGFR) transmembrane domain, glycosylphosphatidylinositol (GPI) anchor (added post-translationally to a signal sequence) and the like.

In some embodiments, the transmembrane domain comprises a TCR alpha transmembrane domain. In some embodiments, the TCR alpha transmembrane domain comprises an amino acid sequence having at least 85% identity, at least 90% identity, at least 95% identity, at least 96% identity, at least 97% identity, at least 98% identity, at least 99% identity or is identical to a sequence of: VIGFRILLLKVAGFNLLMTLRLW (SEQ ID NO: 316). In some embodiments, the TCR alpha transmembrane domain comprises, or consists essentially of, SEQ ID NO: 316. In some embodiments, the TCR alpha transmembrane domain is encoded by a sequence of

```
                                          (SEQ ID NO: 317)
GTGATTGGGTTCCGAATCCTCCTCCTGAAAGTGGCCGGGTTTAATCTGCT

CATGACGCTGCGGCTGTGG.
```

In some embodiments, the transmembrane domain comprises a TCR beta transmembrane domain. In some embodiments, the TCR beta transmembrane domain comprises an amino acid sequence having at least 85% identity, at least 90% identity, at least 95% identity, at least 96% identity, at least 97% identity, at least 98% identity, at least 99% identity or is identical to a sequence of: TILYEILLGKATLYAVLVSALVL (SEQ ID NO: 318). In some embodiments, the TCR beta transmembrane domain comprises, or consists essentially of, SEQ ID NO: 318. In some embodiments, the TCR beta transmembrane domain is encoded by a sequence of

```
                                          (SEQ ID NO: 319)
ACCATCCTCTATGAGATCTTGCTAGGGAAGGCCACCTTGTATGCCGTGCT

GGTCAGTGCCCTCGTGCTG.
```

TCRs of the disclosure can comprise one or more intracellular domains. In some embodiments, the intracellular domain comprises one or more domains capable of providing a stimulatory signal to a transmembrane domain. In some embodiments, the intracellular domain comprises a first intracellular domain capable of providing a stimulatory signal and a second intracellular domain capable of providing a stimulatory signal. In other embodiments, the intracellular domain comprises a first, second and third intracellular domain capable of providing a stimulatory signal. The intracellular domains capable of providing a stimulatory signal are selected from the group consisting of a CD28 molecule (CD28) domain, a LCK proto-oncogene, Src family tyrosine kinase (Lck) domain, a TNF receptor superfamily member 9 (4-1BB) domain, a TNF receptor superfamily member 18 (GITR) domain, a CD4 molecule (CD4) domain, a CD8α molecule (CD8a) domain, a FYN proto-oncogene, Src family tyrosine kinase (Fyn) domain, a zeta chain of T cell receptor associated protein kinase 70 (ZAP70) domain, a linker for activation of T cells (LAT) domain, lymphocyte cytosolic protein 2 (SLP76) domain, (TCR) alpha, TCR beta, CD3 delta, CD3 gamma and CD3 epsilon intracellular domains.

In some embodiments, an intracellular domain comprises at least one intracellular signaling domain. An intracellular signaling domain generates a signal that promotes a function a cell, for example an immune effector function of a TCR containing cell, e.g., a TCR-expressing T-cell. In some embodiments, the intracellular domain of the first receptor of the disclosure includes at least one intracellular signaling domain. For example, the intracellular domains of CD3 gamma, delta or epsilon comprise signaling domains.

In some embodiments, the extracellular domain, transmembrane domain and intracellular domain are isolated or derived from the same protein, for example T-cell receptor (TCR) alpha, TCR beta, CD3 delta, CD3 gamma, CD3 epsilon or CD3 zeta.

Examples of intracellular domains for use in activator receptors of the disclosure include the cytoplasmic sequences of the TCR alpha, TCR beta, CD3 zeta, and 4-1BB, and the intracellular signaling co-receptors that act in concert to initiate signal transduction following antigen receptor engagement, as well as any derivative or variant of these sequences and any recombinant sequence that has the same functional capability.

In some embodiments, the intracellular signaling domain comprises a primary intracellular signaling domain. Exemplary primary intracellular signaling domains include those derived from the proteins responsible for primary stimulation, or antigen dependent stimulation.

In some embodiments, the intracellular domain comprises a CD3 delta intracellular domain, a CD3 epsilon intracellular domain, a CD3 gamma intracellular domain, a CD3 zeta intracellular domain, a TCR alpha intracellular domain or a TCR beta intracellular domain.

In some embodiments, the intracellular domain comprises a TCR alpha intracellular domain. In some embodiments, a TCR alpha intracellular domain comprises Ser-Ser. In some embodiments, a TCR alpha intracellular domain is encoded by a sequence of TCCAGC.

In some embodiments, the intracellular domain comprises a TCR beta intracellular domain. In some embodiments, the TCR beta intracellular domain comprises an amino acid sequence having at least 80% identity, at least 90% identity, or is identical to a sequence of: MAMVKRKDSR (SEQ ID NO: 320). In some embodiments, the TCR beta intracellular domain comprises, or consists essentially of SEQ ID NO: 320. In some embodiments, the TCR beta intracellular domain is encoded by a sequence of

```
                                          (SEQ ID NO: 321)
                   ATGGCCATGGTCAAGAGAAAGGATTCCAGA.
```

In some embodiments, the intracellular signaling domain comprises at least one stimulatory intracellular domain. In some embodiments, the intracellular signaling domain comprises a primary intracellular signaling domain, such as a CD3 delta, CD3 gamma and CD3 epsilon intracellular domain, and one additional stimulatory intracellular domain, for example a co-stimulatory domain. In some embodiments, the intracellular signaling domain comprises a primary intracellular signaling domain, such as a CD3 delta, CD3 gamma and CD3 epsilon intracellular domain, and two additional stimulatory intracellular domains.

Exemplary co-stimulatory intracellular signaling domains include those derived from proteins responsible for co-stimulatory signals, or antigen independent stimulation. Co-stimulatory molecules include, but are not limited to an MHC class I molecule, BTLA, a Toll ligand receptor, as well as DAP10, DAP12, CD30, LIGHT, OX40, CD2, CD27, CDS, ICAM-1, LFA-1 (CD11a/CD18) 4-1BB (CD137, TNF receptor superfamily member 9), and CD28 molecule (CD28). A co-stimulatory protein can be represented in the following protein families: TNF receptor proteins, Immunoglobulin-like proteins, cytokine receptors, integrins, signaling lymphocytic activation molecules (SLAM proteins), and activating NK cell receptors. Examples of such molecules include CD27, CD28, 4-1BB (CD137), OX40, GITR, CD30, CD40, ICOS, BAFFR, HVEM, lymphocyte function-associated antigen-1 (LFA-1), CD2, CD7, LIGHT, NKG2C, SLAMF7, NKp80, CD160, B7-H3, a ligand that specifically binds with CD83, CD4, and the like. The co-stimulatory domain can comprise the entire intracellular portion, or the entire native intracellular signaling domain, of the molecule from which it is derived, or a functional variant thereof.

In some embodiments, the stimulatory domain comprises a co-stimulatory domain. In some embodiments, the co-stimulatory domain comprises a CD28 or 4-1BB co-stimulatory domain. CD28 and 4-1BB are well characterized co-stimulatory molecules required for full T cell activation and known to enhance T cell effector function. For example, CD28 and 4-1BB have been utilized in chimeric antigen receptors (CARs) to boost cytokine release, cytolytic function, and persistence over the first-generation CAR containing only the CD3 zeta signaling domain. Likewise, inclusion of co-stimulatory domains, for example CD28 and 4-1BB domains, in TCRs can increase T cell effector function and specifically allow co-stimulation in the absence of co-stimulatory ligand, which is typically down-regulated on the surface of tumor cells. In some embodiments, the stimulatory domain comprises a CD28 intracellular domain or a 4-1BB intracellular domain.

Inhibitory Receptors

The disclosure provides a second receptor, comprising an extracellular ligand binding domain specific to a non-target antigen that has been lost in a cancer cell, such as an allelic variant of a gene. The non-target allelic variant can be lost in the cancer cell through any mechanism, such as, without limitation, epigenetic changes that effect non-target allelic variant expression, mutations to the gene encoding the non-target allelic variant, disruption of cellular signaling that regulates expression of the non-target allelic variant, chromosome loss, partial or complete deletion of the genomic locus, gene silencing through modification of nucleic acids or heterochromatin, or loss of expression through other mechanisms. In variations of the compositions and methods disclosed herein, the cells or subject treated may exhibit a loss of expression of the non-target allelic variant because of non-genetic changes. Accordingly the disclosure provides compositions and methods for killing cells and/or treating subject lacking expression of the non-target antigen from any cause, including but not limited to, loss of heterozygosity.

Exemplary inhibitory receptors are described in PCT/US2020/045228 filed on Sep. 6, 2020, PCT/US2020/064607, filed on Dec. 11, 2020, PCT/US2021/029907, filed on Apr. 29, 2021 and PCT/US2020/059856 filed on Nov. 10, 2020, the contents of each of which are incorporated herein by reference.

The term "inhibitory chimeric antigen receptor" or "inhibitory receptor" as used herein refers to an antigen-binding domain that is fused to an intracellular signaling domain capable of transducing an inhibitory signal that inhibits or suppresses the immune activity of an immune cell. Inhibitory receptors have immune cell inhibitory potential, and are distinct and distinguishable from CARs, which are receptors with immune cell activating potential. For example, CARs are activating receptors as they include intracellular stimulatory and/or co-stimulatory domains. Inhibitory receptors are inhibiting receptors that contain intracellular inhibitory domains.

As used herein "inhibitory signal" refers to signal transduction or changes in protein expression in an immune cell resulting in suppression of an immune response (e.g., decrease in cytokine production or reduction of immune cell activation). Inhibition or suppression of an immune cell can selective and/or reversible, or not selective and/or reversible. Inhibitory receptors are responsive to non-target antigens (e.g. HLA-A*02). For example, when a non-target antigen (e.g. HLA-A*02) binds to or contacts the inhibitory receptor, the inhibitory receptor is responsive and activates an inhibitory signal in the immune cell expressing the inhibitory receptor upon binding of the non-target antigen by the extracellular ligand binding domain of the inhibitory receptor.

The non-target antigen can be a non-target allelic variant. A "non-target allelic variant" as used herein refers to an allele (e.g. an allelic variant of an MHC Class I gene), whose expression is reduced or eliminated in a target cell (e.g. a cancer cell) due to loss of heterozygosity, or another mechanism of expression loss, but is expressed or detectably expressed in a normal or healthy cell. The non-target antigen can be a protein, or an antigen peptide thereof in a complex with a major histocompatibility complex class I (MHC-I), where the non-target antigen comprises a polymorphism. Because the non-target antigen is polymorphic, loss of a single copy of the gene encoding the non-target antigen, which may occur through loss of heterozygosity in a cancer cell, yields a cancer cell that retains the other polymorphic variant of gene, but has lost the non-target antigen. For example, a subject having HLA-A*02 and HLA-A*01 alleles at the HLA locus may have a cancer in which only the HLA-A*02 allele is lost. In such a subject, the HLA-A*01 protein remains present, but is not recognized by the inhibitory receptor of immune cells encountering the cancer cell, because the inhibitor receptor is designed to be specific to the HLA-A*02 (or other non-target antigen). In normal non-malignant cells, the HLA-A*02 (or other non-target antigen) is present and inhibits activation of the engineered immune cell. In cancer cells having loss of heterozygosity, the HLA-A*02 allelic variant (or other non-target antigen) is lost. Immune cells engineered to express the inhibitory receptor do not receive an inhibitory signal from the inhibitory receptor, as the inhibitory receptor only responds to the HLA-A*02 (or other non-target antigen), which is absent on cancer cells. By this mechanism, the immune cell is selectively activated, and selectively kills, cancer cells expressing HER2 but having lost HLA-A*02 (or another non-target antigen) due to loss-of-heterozygosity. HLA-A is used here as an example. Similar polymorphic variation occurs in the population at other MHC genes and in other non-MHC genes as well. Accordingly, in some embodiments, the non-target antigen comprises a polymorphic variant of COLEC12, APCDD1 or CXCL16, or HLA-A*02. In some embodiments, the non-target antigen is an HLA class I allele or a minor histocompatibility antigen (MiHA). In some embodiments, the HLA Class I allele comprises HLA-A, HLA-B, HLA-C, or HLA-E. In some embodiments, the HLA class I allele is HLA-A*02. In some embodiments, the HLA-A*02 non-target antigen is expressed by healthy cells of a subject. In some embodiments, the non-target antigen is a non-target allelic variant. In some embodiments, the non-target antigen is not expressed in a cancer cell of the subject. In some embodiments, the non-target antigen is not expressed in a fraction of the cells in a tumor in the subject. In some embodiments, a cancer cell in a subject has lost expression of the non-target antigen. Loss of expression or lack of expression of the non-target antigen in a cell can be by any mechanism, such as, without limitation, epigenetic changes that effect non-target gene expression, mutations to the gene encoding the non-target antigen, or disruption of cellular signaling that regulates expression of the non-target gene.

In some embodiments, the second receptor is an inhibitory chimeric antigen receptor (i.e. inhibitory receptor). In some embodiments, the second receptor is an inhibitory receptor. In some embodiments, the second receptor is humanized.

In some embodiments, the second receptor comprises SEQ ID NO: 323, or a sequence sharing at least 75%, at least 80%, at least 85%, at least 90%, at least 95%, or at least 98% identity thereto. In some embodiments, the second receptor comprises SEQ ID NO: 324 or a sequence sharing at least 75%, at least 80%, at least 85%, at least 90%, at least 95%, or at least 98% identity thereto.

The disclosure provides a second receptor, which is an inhibitory receptor, comprising an extracellular ligand binding that can discriminate between single amino-acid variant alleles of a non-target antigen. This ability to discriminate between allelic variants of a non-target antigen allows the second receptor to inhibit activation of immune cells comprising the second receptor in the presence of non-target cells that express that the allele recognized by the ligand binding domain. However, activation of immune cells is not inhibited in the presence of target cells that have lost the allele, for example cancer cells that have lost one allele of a gene through loss of heterozygosity.

The disclosure provides a second receptor, which is an inhibitory receptor, comprising an extracellular ligand binding that can discriminate between different levels of expression of a non-target antigen. This allows the second receptor to inhibit activation of immune cells comprising the second receptor in the presence of non-target cells that express the ligand for the second receptor, but to allow activation of immune cells in the presence of cancer cells that express low levels, or have no expression, of the ligand for the second receptor.

Inhibitor Ligands

In some embodiments, the non-target antigen is not expressed by the target cells, and is expressed by non-target cells. In some embodiments, the non-target antigen is expressed by healthy cells, i.e. cells that are not cancer cells. In some embodiments, the target cells are a plurality of cancer cells that have lost expression of the non-target antigen through loss of heterozygosity (LOH). In some embodiments, the non-target cells are a plurality of healthy cells (i.e., non-cancer, normal, or healthy cells), that express both the target and the non-target antigen.

Any cell surface molecule expressed by the non-target cells that is not expressed by target cells may be a suitable non-target antigen for the second receptor extracellular ligand binding domain. For example, a cell adhesion molecule, a cell-cell signaling molecule, an extracellular domain, a molecule involved in chemotaxis, a glycoprotein, a G protein-coupled receptor, a transmembrane, a receptor for a neurotransmitter or a voltage gated ion channel can be used as a non-target antigen.

In some embodiments, the target antigen is a peptide antigen of a cancer cell-specific antigen in a complex with a major histocompatibility complex class I (MHC-I).

In some embodiments, the non-target antigen is lost in the cancer cells due to loss of heterozygosity. Exemplary non-target antigens lost in cancer cells due to loss of heterozygosity include COLEC12, APCDD1, CXCL16 and HLA-A*02. In some embodiments, the non-target antigen is selected from the group consisting of a polymorphic variant of COLEC12, APCDD1 and CXCL166, or a peptide antigen thereof a complex with a major histocompatibility complex class I (MHC-I), or HLA-A*02. In some embodiments, the non-target antigen is an antigen peptide comprising a polymorphic residue of COLEC12, APCDD1 and CXCL16 in a complex with a major histocompatibility complex class I (MHC-I).

Non-target MHC-1 (MHC) antigens comprising any of HLA-A, HLA-B or HLA-C are envisaged as within the scope of the disclosure. In some embodiments, the non-target antigen comprises HLA-A. In some embodiments, the non-target antigen comprises a human leukocyte antigen A*02 allelic product (HLA-A*02). In some embodiments, the non-target antigen comprises human leukocyte antigen A*69. In some embodiments, the non-target antigen comprises HLA-B. In some embodiments, the non-target antigen comprises HLA-C.

In some embodiments, the non-target antigen comprises HLA-A*02.

In some embodiments, the non-target antigen comprises C-X-C motif chemokine ligand 16 (CXCL16) or an antigen peptide thereof in a complex with MHC-I. Human CXCL16 precursor is described in NCBI record number NP_001094282.1, the contents of which are incorporated by reference herein in their entirety. In some embodiments, CXCL16 comprises an amino acid sequence of:

```
                                          (SEQ ID NO: 325)
  1  MSGSQSEVAP  SPQSPRSPEM  GRDLRPGSRV  LLLLLLLLLV
     YLTQPGNGNE  GSVTGSCYCG

61  KRISSDSPPS  VQFMNRLRKH  LRAYHRCLYY  TRFQLLSWSV
     CGGNKDPWVQ  ELMSCLDLKE

121  CGHAYSGIVA  HQKHLLPTSP  PISQASEGAS  SDIHTPAQML
     LSTLQSTQRP  TLPVGSLSSD

181  KELTRPNETT  IHTAGHSLAA  GPEAGENQKQ  PEKNAGPTAR
     TSATVPVLCL  LAIIFILTAA

241  LSYVLCKRRR  GQSPQSSPDL  PVHYIPVAPD  SNT.
```

In some embodiments, the non-target antigen comprises a polymorphism of CXCL16. For example, the non-target antigen comprises a peptide derived from CXCL16 comprising a polymorphic residue of CXCL16. Polymorphic residues of CXCL16 include positions 142 and 200 of SEQ ID NO: 325. In some embodiments, the non-target antigen comprises a peptide of CXCL16 comprising amino acid 142 or 200 of SEQ ID NO: 325. In some embodiments, the non-target antigen comprises a peptide of CXCL16 comprising an A at amino acid 200 of SEQ ID NO: 325. In some embodiments, the non-target antigen comprises a peptide of CXCL16 comprising a V at amino acid 200 of SEQ ID NO: 325. In some embodiments, the non-target antigen comprises a peptide of CXCL16 comprising an I at amino acid 142 of SEQ ID NO: 325. In some embodiments, the non-target antigen comprises a peptide of CXCL16 comprising a T at amino acid 142 of SEQ ID NO: 325.

In some embodiments, the non-target antigen comprises a polymorphism of CXCL16. In some embodiments, the non-target antigen comprises a peptide of CXCL16 comprising an A at amino acid 200 of SEQ ID NO: 325, and the second receptor comprises a ligand binding domain with a higher affinity for a CXCL16 ligand with an A at position 200 of SEQ ID NO: 325 than for a CXCL16 ligand with a V at position 200 of SEQ ID NO: 325. In some embodiments, the non-target antigen comprises a peptide of CXCL16 comprising a V at amino acid 200 of SEQ ID NO: 325, and the second receptor comprises a ligand binding domain with a higher affinity for a CXCL16 ligand with a V at position 200 of SEQ ID NO: 325 than for a CXCL16 ligand with an A at position 200 of SEQ ID NO: 325. In some embodiments, the non-target antigen comprises a peptide of CXCL16 comprising an I at amino acid 142 of SEQ ID NO: 325, and the second receptor comprises a ligand binding domain with a higher affinity for a CXCL16 ligand with an I at position 142 of SEQ ID NO: 325 than for a CXCL16 ligand with a T at position 142 of SEQ ID NO: 325. In some embodiments, the non-target antigen comprises a peptide of CXCL16 comprising a T at amino acid 142 of SEQ ID NO: 325, and the second receptor comprises a ligand binding domain with a higher affinity for a CXCL16 ligand with a T at position 142 of SEQ ID NO: 325 than for a CXCL16 ligand with an I at position 142 of SEQ ID NO: 325.

In some embodiments, the non-target antigen comprises collectin subfamily member 12 (COLEC12) or an antigen peptide thereof in a complex with MHC-I. Human COLEC12 is described in NCBI record number NP_569057.2, the contents of which are incorporated by reference herein in their entirety. In some embodiments, COLEC12 comprises an amino acid sequence of:

```
                                        (SEQ ID NO: 326)
  1 MKDDFAEEEE VQSFGYKRFG IQEGTQCTKC KNNWALKFSI

ILLYILCALL TITVAILGYK

61 VVEKMDNVTG GMETSRQTYD DKLTAVESDL KKLGDQTGKK

AISTNSELST FRSDILDLRQ

121 QLREITEKTS KNKDTLEKLQ ASGDALVDRQ SQLKETLENN

SFLITTVNKT LQAYNGYVTN

181 LQQDTSVLQG NLQNQMYSHN VVIMNLNNLN LTQVQQRNLI

TNLQRSVDDT SQAIQRIKND

241 FQNLQQVFLQ AKKDTDWLKE KVQSLQTLAA NNSALAKANN

DTLEDMNSQL NSFTGQMENI
```

-continued

```
301 TTISQANEQN LKDLQDLHKD AENRTAIKFN QLEERFQLFE

TDIVNIISNI SYTAHHLRTL

361 TSNLNEVRTT CTDTLTKHTD DLTSLNNTLA NIRLDSVSLR

MQQDLMRSRL DTEVANLSVI

421 MEEMKLVDSK HGQLIKNFTI LQGPPGPRGP RGDRGSQGPP

GPTGNKGQKG EKGEPGPPGP

481 AGERGPIGPA GPPGERGGKG SKGSQGPKGS RGSPGKPGPQ

GSSGDPGPPG PPGKEGLPGP

541 QGPPGFQGLQ GTVGEPGVPG PRGLPGLPGV PGMPGPKGPP

GPPGPSGAVV PLALQNEPTP

601 APEDNGCPPH WKNFTDKCYY FSVEKEIFED AKLFCEDKSS

HLVFINTREE QQWIKKQMVG

661 RESHWIGLTD SERENEWKWL DGTSPDYKNW KAGQPDNWGH

GHGPGEDCAG LIYAGQWNDF

721 QCEDVNNFIC EKDRETVLSS AL.
```

In some embodiments, the non-target antigen comprises a polymorphism of COLEC12. For example, the non-target antigen comprises a peptide derived from COLEC12 comprising a polymorphic residue of COLEC12. Polymorphic residues of COLEC12 include position 522 of SEQ ID NO: 326. In some embodiments, the non-target antigen comprises a peptide of COLEC12 comprising amino acid 522 of SEQ ID NO: 326. In some embodiments, the non-target antigen comprises a peptide of COLEC12 comprising an S at amino acid 522 of SEQ ID NO: 326. In some embodiments, the non-target antigen comprises a peptide of COLEC12 comprising a P at amino acid 522 of SEQ ID NO: 326.

In some embodiments, the non-target antigen comprises APC down-regulated 1 (APCDD1) or an antigen peptide thereof in a complex with MHC-I. An exemplary human APCDD1 is described in UniProtKB record number Q8J025, the contents of which are incorporated by reference herein in their entirety. In some embodiments, APCDD1 comprises an amino acid sequence of:

```
                                        (SEQ ID NO: 327)
  1 MSWPRRLLLR YLFPALLLHG LGEGSALLHP DSRSHPRSLE

KSAWRAFKES QCHHMLKHLH

61 NGARITVQMP PTIEGHWVST GCEVRSGPEF ITRSYRFYHN

NTFKAYQFYY GSNRCTNPTY

121 TLIIRGKIRL RQASWIIRGG TEADYQLHNV QVICHTEAVA

EKLGQQVNRT CPGFLADGGP

181 WVQDVAYDLW REENGCECTK AVNFAMHELQ LIRVEKQYLH

HNLDHLVEEL FLGDIHTDAT

241 QRMFYRPSSY QPPLQNAKNH DHACIACRII YRSDEHHPPI

LPPKADLTIG LHGEWVSQRC

301 EVRPEVLFLT RHFIFHDNNN TWEGHYYHYS DPVCKHPTFS

IYARGRYSRG VLSSRVMGGT
```

```
361  EFVFKVNHMK  VTPMDAATAS  LLNVFNGNEC  GAEGSWQVGI

QQDVTHTNGC  VALGIKLPHT

421  EYEIFKMEQD  ARGRYLLFNG  QRPSDGSSPD  RPEKRATSYQ

MPLVQCASSS  PRAEDLAEDS

481  GSSLYGRAPG  RHTWSLLLAA  LACLVPLLHW  NIRR.
```

In some embodiments, the non-target antigen comprises a polymorphism of APCDD1. Exemplary polymorphisms of APCDD1 include rs3748415, which can be a V, I or L at position 150 of SEQ ID NO: 327. In some embodiments, the non-target antigen comprises a peptide of APCDD1 comprising amino acid 150 of SEQ ID NO: 327. In some embodiments, the non-target antigen comprises a peptide of APCDD1 comprising an V at amino acid 150 of SEQ ID NO: 327. In some embodiments, the non-target antigen comprises a peptide of APCDD1 comprising an I at amino acid 150 of SEQ ID NO: 327. In some embodiments, the non-target antigen comprises a peptide of APCDD1 comprising an L at amino acid 150 of SEQ ID NO: 327.

A further exemplary human APCDD1 is described in UniProtKB record number V9GY82, the contents of which are incorporated by reference herein in their entirety. In some embodiments, APCDD1 comprises an amino acid sequence of:

```
                                      (SEQ ID NO: 328)
  1  XDVAYDLWRE  ENGCECTKAV  NFAMHELQLI  RVEKQYLHHN

LDHLVEELFL  GDIHTDATQR

61  MFYRPSSYQP  PLQNAKCAAE  SSGSFQILPQ  DSSEKEQNGL

SHWCLSRPGH  QKDWALCAHA

121  GPATAGCPSC  LWPPAETGRK  AGRTSSKTVH  ACPGEAGTSS

FELFYFPNCW  SIETKLKISL

181  NAKLSFKPRA  SAPLETGHRV  KIETLSQLVF  LSFIQLCCEV

QSPLANK.
```

Exemplary polymorphisms of APCDD1 include rs1786683, which can be a Y or S at position 165 of SEQ ID NO: 328. In some embodiments, the non-target antigen comprises a peptide of APCDD1 comprising amino acid 165 of SEQ ID NO: 328. In some embodiments, the non-target antigen comprises a peptide of APCDD1 comprising a Y at amino acid 165 of SEQ ID NO: 328. In some embodiments, the non-target antigen comprises a peptide of APCDD1 comprising an S at amino acid 165 of SEQ ID NO: 328.

A further exemplary human APCDD1 is described in UniProt record number J3QSE3, the contents of which are incorporated by reference herein in their entirety. In some embodiments, APCDD1 comprises an amino acid sequence of:

```
                                      (SEQ ID NO: 329)
  1  PEDVLPALQL  PAPSAECQVE  MGFHHVGQDG  LQLPTSSDPP

ALASQSAGIT  GVSHRPPGRH

61  LSNDLRTTTM  PASPVGSSIG  QTSTTLPSCP  QRQT.
```

Exemplary polymorphisms of APCDD1 include rs9952598, which can be a Q or R at position 28 of SEQ ID NO: 329. In some embodiments, the non-target antigen comprises a peptide of APCDD1 comprising amino acid 28 of SEQ ID NO: 329. In some embodiments, the non-target antigen comprises a peptide of APCDD1 comprising a Q at amino acid 28 of SEQ ID NO: 329. In some embodiments, the non-target antigen comprises a peptide of APCDD1 comprising an R at amino acid 28 of SEQ ID NO: 329.

In some embodiments, APCDD1 comprises a sequence that shares at least 80%, at least 85%, at least 90%, at least 95%, at least 94%, at least 97%, at least 98%, or at least 99% identity to any one of SEQ ID NOs: 327-329. Polymorphic residues of APCDD1 are marked as bold and underlined in SEQ ID NOs: 327-329.

In some embodiments, the non-target antigen comprising HLA-A*02, and the ligand binding domain of the second receptor comprises an HLA-A*02 ligand binding domain. In some embodiments, the ligand binding domain binds HLA-A*02 independent of the peptide in a pMHC complex comprising HLA-A*02. In some embodiments, the HLA-A*02 ligand binding domain comprises an scFv domain. In some embodiments, the HLA-A*02 ligand binding domain comprises a sequence of any one of SEQ ID NOs: 63-74. In some embodiments, the HLA-A*02 ligand binding domain comprises a sequence at least 90%, at least 95% or at least 99% identical to a sequence of any one of SEQ ID NOs: 63-74.

In some embodiments, the HLA-A*02 scFv comprises the complementarity determined regions (CDRs) of any one of SEQ ID NOS: 87-102. In some embodiments, the scFv comprises a sequence at least 95% identical to any one of SEQ ID NOS: 87-102. In some embodiments, the scFv comprises a sequence identical to any one of SEQ ID NOS: 87-102. In some embodiments, the heavy chain of the antigen binding domain comprises the heavy chain CDRs of any one of SEQ ID NOS: 87-102, and wherein the light chain of the antigen binding domain comprises the light chain CDRs of any one of SEQ ID NOS: 87-102. In some embodiments, the HLA-A*02 antigen binding domain comprises a heavy chain and a light chain, and the heavy chain comprises CDRs selected from SEQ ID NOs: 95-102 and the light chain comprises CDRs selected from SEQ ID NOs: 87-94. In further embodiments of any of the ligand binding domains, each CDR sequence may have 1, 2, 3 or more substitutions, insertions, or deletions. CDR sequences may tolerate substitutions, deletions, or insertions. Using sequence alignment tools, routine experimentation, and known assays, those of skill in the art may generate and test variant sequences having 1, 2, 3, or more substitutions, insertions, or deletions in CDR sequences without undue experimentation.

In some embodiments, the HLA-A*02 antigen binding domain comprises a heavy chain and a light chain, and the heavy chain comprises a sequence at least 95% identical to the heavy chain portion of any one of SEQ ID NOS: 63-74, and the light chain comprises a sequence at least 95% identical to the light chain portion of any one of SEQ ID NOS: 63-74.

In some embodiments, the heavy chain comprises a sequence identical to the heavy chain portion of any one of SEQ ID NOS: 63-74, and wherein the light chain of comprises a sequence identical to the light chain portion of any one of SEQ ID NOS: 63-74.

In some embodiments, the non-target antigen comprises HLA-B*07, and the ligand binding domain of the second receptor comprises an HLA-B*07 ligand binding domain. In some embodiments, the ligand binding domain binds HLA-B*07 independent of the peptide in a pMHC complex comprising HLA-B*07. In some embodiments, the HLA- B*07 ligand binding domain comprises an scFv domain. In some embodiments, the HLA-B*07 ligand binding domain comprises a sequence of any one of the indicated B7 binding domains in Table 7. In some embodiments, the HLA-B*07 ligand binding domain comprises a sequence at least 90%, at least 95% or at least 99% identical to a sequence of any one of the indicated HLA-B*07 binding domains in Table 7. In some embodiments, the HLA-B*07 scFv comprises any one of the indicated HLA-B*07 complementarity determined regions (CDRs) in Table 9. In some embodiments, the scFv comprises a sequence at least 95% identical to any one of the indicated HLA-B*07 scFv sequences in Table 7. In some embodiments, the scFv comprises a sequence identical to any one of the indicated HLA-B*07 scFv sequences in Table 7.

In some embodiments, the non-target antigen comprises HLA-A*11, and the ligand binding domain of the second receptor comprises an HLA-A*11 ligand binding domain. In some embodiments, the ligand binding domain binds HLA-A*11 independent of the peptide in a pMHC complex comprising HLA-A*11. In some embodiments, the HLA-A*11 ligand binding domain comprises an scFv domain. In some embodiments, the HLA-A*11 ligand binding domain comprises a sequence of any one of the indicated HLA-A*11 binding domains in Table 7. In some embodiments, the HLA-A*11 ligand binding domain comprises a sequence at least 90%, at least 95% or at least 99% identical to a sequence of any one of the indicated HLA-A*11 binding domains in Table 7. In some embodiments, the HLA-A*11 scFv comprises any one of the indicated HLA-A*11 complementarity determined regions (CDRs) in Table 9. In some embodiments, the scFv comprises a sequence at least 95% identical to any one of the indicated HLA-A*11 scFv sequences in Table 7. In some embodiments, the scFv comprises a sequence identical to any one of the indicated HLA-A*11 scFv sequences in Table 7.

In some embodiments, the non-target antigen comprises HLA-A*01, and the ligand binding domain of the second receptor comprises an HLA-A*01 ligand binding domain. In some embodiments, the ligand binding domain binds HLA-A*01 independent of the peptide in a pMHC complex comprising HLA-A*01. In some embodiments, the HLA-A*01 ligand binding domain comprises an scFv domain. In some embodiments, the HLA-A*01 ligand binding domain comprises a sequence of any one of the indicated HLA-A*01 binding domains in Table 7. In some embodiments, the HLA-A*01 ligand binding domain comprises a sequence at least 90%, at least 95% or at least 99% identical to a sequence of any one of the indicated HLA-A*01 binding domains in Table 7. In some embodiments, the HLA-A*01 scFv comprises any one of the indicated HLA-A*01 complementarity determined regions (CDRs) in Table 9 In some embodiments, the scFv comprises a sequence at least 95% identical to any one of the indicated HLA-A*01 scFv sequences in Table 7. In some embodiments, the scFv comprises a sequence identical to any one of the indicated HLA-A*01 scFv sequences in Table 7.

In some embodiments, the non-target antigen comprises HLA-A*03, and the ligand binding domain of the second receptor comprises an HLA-A*03 ligand binding domain. In some embodiments, the ligand binding domain binds HLA-A*03 independent of the peptide in a pMHC complex comprising HLA-A*03. In some embodiments, the HLA-A*03 ligand binding domain comprises an scFv domain. In some embodiments, the HLA-A*03 ligand binding domain comprises a sequence of any one of the indicated HLA-A*03 binding domains in Table 7. In some embodiments, the HLA-A*03 ligand binding domain comprises a sequence at least 90%, at least 95% or at least 99% identical to a sequence of any one of the indicated HLA-A*03 binding domains in Table 7. In some embodiments, the HLA-A*03 scFv comprises any one of the indicated HLA-A*03 complementarity determined regions (CDRs) in Table 9. In some embodiments, the scFv comprises a sequence at least 95% identical to any one of the indicated HLA-A*03 scFv sequences in Table 7. In some embodiments, the scFv comprises a sequence identical to any one of the indicated HLA-A*03 scFv sequences in Table 7.

In some embodiments, the non-target antigen comprises HLA-C*07, and the ligand binding domain of the second receptor comprises an HLA-C*07 ligand binding domain. In some embodiments, the ligand binding domain binds HLA-C*07 independent of the peptide in a pMHC complex comprising HLA-C*07. In some embodiments, the HLA-C*07 ligand binding domain comprises an scFv domain. In some embodiments, the HLA-C*07 ligand binding domain comprises a sequence of any one of the indicated HLA-C*07 binding domains in Table 7. In some embodiments, the HLA-C*07 ligand binding domain comprises a sequence at least 90%, at least 95% or at least 99% identical to a sequence of any one of the indicated HLA-C*07 binding domains in Table 7. In some embodiments, the HLA-C*07 scFv comprises any one of the indicated HLA-C*07 complementarity determined regions (CDRs) in Table 9. In some embodiments, the scFv comprises a sequence at least 95% identical to any one of the indicated HLA-C*07 scFv sequences in Table 7. In some embodiments, the scFv comprises a sequence identical to any one of the indicated HLA-C*07 scFv sequences in Table 7.

Inhibitory receptors of the disclosure may comprise an extracellular ligand binding domain. Any type of ligand binding domain that can regulate the activity of a receptor in a ligand dependent manner is envisaged as within the scope of the instant disclosure.

In some embodiments, the ligand binding domain is an antigen binding domain. Exemplary antigen binding domains include, inter alia, scFv, SdAb, Vβ-only domains, and TCR antigen binding domains derived from the TCR α and β chain variable domains.

Any type of antigen binding domain is envisaged as within the scope of the instant disclosure.

In some embodiments, the extracellular ligand binding domain of the second receptor binds to and recognizes a polymorphic variant of COLEC12, APCDD1, CXCL16 or an antigen peptide thereof in a complex with a major histocompatibility complex class I (MHC-I), or HLA-A*02. In some embodiments, the extracellular ligand binding domain of the second receptor is an scFv.

In some embodiments, the extracellular ligand binding domain of the second receptor is fused to the extracellular domain of an inhibitory receptor.

In some embodiments, the inhibitory receptors of the present disclosure comprise an extracellular hinge region. Exemplary hinges can be isolated or derived from IgD and CD8 domains, for example IgG1. In some embodiments, the hinge is isolated or derived from CD8α or CD28.

The inhibitory receptors of the present disclosure can be designed to comprise a transmembrane domain that is fused to the extracellular domain of the inhibitory receptors. In some instances, the transmembrane domain can be selected or modified by amino acid substitution to avoid binding of such domains to the transmembrane domains of the same or different surface membrane proteins to minimize interactions with other members of the receptor complex.

The transmembrane domain may be derived either from a natural or from a synthetic source. Where the source is natural, the domain may be derived from any membrane-bound or transmembrane protein. Transmembrane regions may be isolated or derived from (i.e. comprise at least the transmembrane region(s) of) the alpha, beta or zeta chain of the T-cell receptor, CD28, CD3 epsilon, CD45, CD4, CD5, CD8, CD9, CD16, CD22, CD33, CD37, CD64, CD80, CD86, CD134, CD137, CD154, or from an immunoglobulin such as IgG4. Alternatively, the transmembrane domain may be synthetic, in which case it will comprise predominantly hydrophobic residues such as leucine and valine. In some embodiments, a triplet of phenylalanine, tryptophan and valine will be found at each end of a synthetic transmembrane domain. Optionally, a short oligo- or polypeptide linker, preferably between 2 and 10 amino acids in length may form the linkage between the transmembrane domain and the intracellular domain of the inhibitory receptors. A glycine-serine doublet provides a particularly suitable linker.

The disclosure provides an inhibitory receptors comprising an intracellular domain. The intracellular domain of the inhibitory receptors of the instant disclosure is responsible for inhibiting activation of the immune cells comprising the inhibitory receptors, which would otherwise be activated in response to activation signals by the first receptor. In some embodiments, for example in the second inhibitory receptors of the disclosure which provide an inhibitory signal, the inhibitory signal is transmitted through the intracellular domain of the receptor. In some embodiments, the inhibitory receptor comprises an inhibitory intracellular domain. In some embodiments, the inhibitory engineered receptor is a CAR comprising an inhibitory intracellular domain (an inhibitory CAR).

In some embodiments, the inhibitory intracellular domain comprises an immunoreceptor tyrosine-based inhibitory motif (ITIM). In some embodiments, the inhibitory intracellular domain comprising an ITIM can be isolated or derived from an immune checkpoint inhibitor such as CTLA-4 and PD-1. CTLA-4 and PD-1 are immune inhibitory receptors expressed on the surface of T cells, and play a pivotal role in attenuating or terminating T cell responses.

Inhibitory domains can be isolated from human tumor necrosis factor related apoptosis inducing ligand (TRAIL) receptor and CD200 receptor 1. In some embodiments, the TRAIL receptor comprises TR10A, TR10B or TR10D.

In some embodiments, the inhibitory domain comprises an intracellular domain, a transmembrane or a combination thereof. In some embodiments, the inhibitory intracellular domain is isolated from phosphoprotein membrane anchor with glycosphingolipid microdomains 1 (PAG1). In some embodiments, the inhibitory intracellular domain is isolated from leukocyte immunoglobulin like receptor B1 (LILRB1). In some embodiments, the inhibitory domain is isolated or derived from a human protein, for example a human TRAIL receptor, CTLA-4, or PD-1, PAG1 or LILRB1 protein.

In some embodiments, the inhibitory domain comprises an intracellular domain, a transmembrane domain, a hinge region or a combination thereof. In some embodiments, the inhibitory domain comprises an immunoreceptor tyrosine-based inhibitory motif (ITIM). In some embodiments, the inhibitory domain comprising an ITIM can be isolated or derived from an immune checkpoint inhibitor such as CTLA-4 and PD-1. Exemplary hinge, transmembrane, and intracellular domains that may be used in inhibitory receptors described herein are shown in Table 16.

Inhibitory domains can be isolated from human tumor necrosis factor related apoptosis inducing ligand (TRAIL) receptor and CD200 receptor 1. In some embodiments, the inhibitory domain is isolated or derived from a human protein, for example a human TRAIL receptor, CTLA-4, or PD-1 protein. In some embodiments, the TRAIL receptor comprises TR10A, TR10B or TR10D.

Endogenous TRAIL is expressed as a 281-amino acid type II trans-membrane protein, which is anchored to the plasma membrane and presented on the cell surface. TRAIL is expressed by natural killer cells, which, following the establishment of cell-cell contacts, can induce TRAIL-dependent apoptosis in target cells. Physiologically, the TRAIL-signaling system was shown to be essential for immune surveillance, for shaping the immune system through regulating T-helper cell 1 versus T-helper cell 2 as well as "helpless" CD8+ T-cell numbers, and for the suppression of spontaneous tumor formation.

In some embodiments, the inhibitory domain comprises an intracellular domain isolated or derived from a CD200 receptor. The cell surface glycoprotein CD200 receptor 1 (Uniprot ref: Q8TD46) represents another example of an inhibitory intracellular domain of the present invention. This inhibitory receptor for the CD200/OX2 cell surface glycoprotein limits inflammation by inhibiting the expression of proinflammatory molecules including TNF-alpha, interferons, and inducible nitric oxide synthase (iNOS) in response to selected stimuli.

In some embodiments, the engineered receptor comprises an inhibitory domain isolated or derived from killer cell immunoglobulin like receptor, three Ig domains and long cytoplasmic tail 2 (KIR3DL2), killer cell immunoglobulin like receptor, three Ig domains and long cytoplasmic tail 3 (KIR3DL3), leukocyte immunoglobulin like receptor B1 (LIR1, also called LIR-1 and LILRB1), programmed cell death 1 (PD-1), Fc gamma receptor IIB (FcgRIIB), killer cell lectin like receptor K1 (NKG2D), CTLA-4, a domain containing a synthetic consensus ITIM, a ZAP70 SH2 domain (e.g., one or both of the N and C terminal SH2 domains), or ZAP70 KI_K369A (kinase inactive ZAP70).

In some embodiments, the inhibitory domain is isolated or derived from a human protein. In some embodiments, the second, inhibitory receptor comprises an inhibitory domain. In some embodiments, the second, inhibitory receptor comprises an inhibitory intracellular domain and/or an inhibitory domain and transmembrane domain. In some embodiments, the inhibitory intracellular domain is fused to an intracellular domain of an inhibitory receptors. In some embodiments, the inhibitory intracellular domain is fused to the transmembrane domain of an inhibitory receptors.

In some embodiments, the second, inhibitory receptor comprises a cytoplasmic domain and transmembrane domain isolated or derived from the same protein, for example an ITIM containing protein. In some embodiments, the second, inhibitory receptor comprises a cytoplasmic domain, a transmembrane domain, and an extracellular domain or a portion thereof isolated or derived isolated or derived from the same protein, for example an ITIM containing protein. In some embodiments, the second, inhibitory receptor comprises a hinge region isolated or derived from isolated or derived from the same protein as the intracellular domain and/or transmembrane domain, for example an ITIM containing protein. In some embodiments, the second, inhibitory receptor comprises an inhibitory domain. In some embodiments, the second, inhibitory receptor comprises an inhibitory intracellular domain and/or an inhibitory transmembrane domain. In some embodiments, the second engineered receptor is a CAR comprising an inhibitory domain (an inhibitory CAR). In some embodiments, the inhibitory intracellular domain is fused to the intracellular domain of a CAR. In some embodiments, the inhibitory intracellular domain is fused to the transmembrane domain of a CAR.

LILRB1 Inhibitory Receptors

The present disclosure provides a second inhibitory receptor comprising a LILRB1 inhibitory domain, and optionally, a LILRB1 transmembrane and/or hinge domain, or functional variants thereof. The inclusion of the LILRB1 transmembrane domain and/or the LILRB1 hinge domain in the inhibitory receptor may increase the inhibitory signal generated by the inhibitory receptor compared to a reference inhibitory receptor having another transmembrane domain or another hinge domains. The second, inhibitory receptor comprising the LILRB1 inhibitory domain may be a CAR or TCR, as described herein. Any suitable ligand binding domain, as described herein, may be fused to the LILRB1-based second, inhibitory receptors having one or more domains from Leukocyte immunoglobulin-like receptor subfamily B member 1 (LILRB1, or LIR1). In some embodiments, the inhibitory receptor comprises a LILRB1 intracellular domain or a functional variant thereof.

Leukocyte immunoglobulin-like receptor subfamily B member 1 (LILRB1), also known as Leukocyte immunoglobulin-like receptor B1, as well as ILT2, LIR1, MIR7, PIRB, CD85J, ILT-2 LIR-1, MIR-7 and PIR-B, is a member of the leukocyte immunoglobulin-like receptor (LIR) family. The LILRB1 protein belongs to the subfamily B class of LIR receptors. These receptors contain two to four extracellular immunoglobulin domains, a transmembrane domain, and two to four cytoplasmic immunoreceptor tyrosine-based inhibitory motifs (ITIMs). The LILRB1 receptor is expressed on immune cells, where it binds to MHC class I molecules on antigen-presenting cells and transduces a negative signal that inhibits stimulation of an immune response. LILRB1 is thought to regulate inflammatory responses, as well as cytotoxicity, and to play a role in limiting auto-reactivity. Multiple transcript variants encoding different isoforms of LILRB1 exist, all of which are contemplated as within the scope of the instant disclosure.

In some embodiments of the inhibitory receptors described herein, the inhibitory receptor comprises one or more domains isolated or derived from LILRB1. In some embodiments of the receptors having one or more domains isolated or derived from LILRB1, the one or more domains of LILRB1 comprise an amino acid sequence that is at least 80%, at least 90%, at least 95%, at least 96%, at least 97%, at least 98%, at least 99% or is identical to a sequence or subsequence of SEQ ID NO: 280. In some embodiments, the one or more domains of LILRB1 comprise an amino acid sequence that is identical to a sequence or subsequence of SEQ ID NO: 280. In some embodiments, the one or more domains of LILRB1 consist of an amino acid sequence that is at least 80%, at least 90%, at least 95%, at least 96%, at least 97%, at least 98%, at least 99% or is identical to a sequence or subsequence of SEQ ID NO: 280. In some embodiments, the one or more domains of LILRB1 consist of an amino acid sequence that is identical to a sequence or subsequence of SEQ ID NO: 280.

In some embodiments of the receptors having one or more domains isolated or derived from LILRB1, the one or more domains of LILRB1 are encoded by a polynucleotide sequence that is at least 80%, at least 90%, at least 95%, at least 96%, at least 97%, at least 98%, at least 99% or is identical to a sequence or subsequence of SEQ ID NO: 556.

In some embodiments of the receptors having one or more domains of LILRB1, the one or more domains of LILRB1 are encoded by a polynucleotide sequence that is identical to a sequence or subsequence of SEQ ID NO: 556. In various embodiments, a chimeric antigen receptor is provided, comprising a polypeptide, wherein the polypeptide comprises one or more of: an LILRB1 hinge domain or functional fragment or variant thereof; an LILRB1 transmembrane domain or a functional variant thereof; and an LILRB1 intracellular domain or an intracellular domain comprising at least one, or at least two immunoreceptor tyrosine-based inhibitory motifs (ITIMs), wherein each ITIM is independently selected from NLYAAV (SEQ ID NO: 256), VTYAEV (SEQ ID NO: 257), VTYAQL (SEQ ID NO: 258), and SIYATL (SEQ ID NO: 259).

Intracellular Domain

The disclosure provides inhibitory receptors, the inhibitory receptors comprising a polypeptide. In some embodiments, the polypeptide comprises an intracellular domain. In some embodiments, the inhibitory receptor comprises a LILRB1 intracellular domain or a functional variant thereof.

As used herein, "intracellular domain" refers to the cytoplasmic or intracellular domain of a protein, such as a receptor, that interacts with the interior of the cell, and carries out a cytosolic function. As used herein, "cytosolic function" refers to a function of a protein or protein complex that is carried out in the cytosol of a cell. For example, intracellular signal transduction cascades are cytosolic functions.

As used herein an "immunoreceptor tyrosine-based inhibitory motif" or "ITIM" refers to a conserved sequence of amino acids with a consensus sequence of S/I/V/LxYxxI/V/L (SEQ ID NO: 260), or the like, that is found in the cytoplasmic tails of many inhibitory receptors of the immune system. After ITIM-possessing inhibitory receptors interact with their ligand, the ITIM motif is phosphorylated, allowing the inhibitory receptor to recruit other enzymes, such as the phosphotyrosine phosphatases SHP-1 and SHP-2, or the inositol-phosphatase called SHIP.

In some embodiments, the polypeptide comprises an intracellular domain comprising at least one immunoreceptor tyrosine-based inhibitory motif (ITIM), at least two ITIMs, at least 3 ITIMs, at least 4 ITIMs, at least 5 ITIMs or at least 6 ITIMs. In some embodiments, the intracellular domain has 1, 2, 3, 4, 5, or 6 ITIMs.

In some embodiments, the polypeptide comprises an intracellular domain comprising at least one ITIM selected from the group of ITIMs consisting of NLYAAV (SEQ ID NO: 256), VTYAEV (SEQ ID NO: 257), VTYAQL (SEQ ID NO: 258), and SIYATL (SEQ ID NO: 259).

In further particular embodiments, the polypeptide comprises an intracellular domain comprising at least two immunoreceptor tyrosine-based inhibitory motifs (ITIMs), wherein each ITIM is independently selected from NLYAAV (SEQ ID NO: 256), VTYAEV (SEQ ID NO: 257), VTYAQL (SEQ ID NO: 258), and SIYATL (SEQ ID NO: 259).

In some embodiments, the intracellular domain comprises both ITIMs NLYAAV (SEQ ID NO: 256) and VTYAEV (SEQ ID NO: 257). In some embodiments, the intracellular domain comprises a sequence at least 95% identical to SEQ ID NO: 260. In some embodiments, the intracellular domain comprises or consists essentially of a sequence identical to SEQ ID NO: 281.

In some embodiments, the intracellular domain comprises both ITIMs VTYAEV (SEQ ID NO: 257) and VTYAQL (SEQ ID NO: 258). In some embodiments, the intracellular domain comprises a sequence at least 95% identical to SEQ ID NO: 261. In some embodiments, the intracellular domain comprises or consists essentially of a sequence identical to SEQ ID NO: 261.

In some embodiments, the intracellular domain comprises both ITIMs VTYAQL (SEQ ID NO: 258) and SIYATL (SEQ ID NO: 259). In some embodiments, the intracellular domain comprises a sequence at least 95% identical to SEQ ID NO: 262. In some embodiments, the intracellular domain comprises or consists essentially of a sequence identical to SEQ ID NO: 262.

In some embodiments, the intracellular domain comprises the ITIMs NLYAAV (SEQ ID NO: 256), VTYAEV (SEQ ID NO: 257), and VTYAQL (SEQ ID NO: 258). In some embodiments, the intracellular domain comprises a sequence at least 95% identical to SEQ ID NO: 263. In some embodiments, the intracellular domain comprises or consists essentially of a sequence identical to SEQ ID NO: 263.

In some embodiments, the intracellular domain comprises the ITIMs VTYAEV (SEQ ID NO: 257), VTYAQL (SEQ ID NO: 258), and SIYATL (SEQ ID NO: 259). In some embodiments, the intracellular domain comprises a sequence at least 95% identical to SEQ ID NO: 264. In some embodiments, the intracellular domain comprises or consists essentially of a sequence identical to SEQ ID NO: 264.

In some embodiments, the intracellular domain comprises the ITIMs NLYAAV (SEQ ID NO: 256), VTYAEV (SEQ ID NO: 257), VTYAQL (SEQ ID NO: 258), and SIYATL (SEQ ID NO: 259). In embodiments, the intracellular domain comprises a sequence at least 95% identical to SEQ ID NO: 265. In some embodiments, the intracellular domain comprises or consists essentially of a sequence identical to SEQ ID NO: 265.

In some embodiments, the intracellular domain comprises a sequence at least 95% identical to the LILRB1 intracellular domain (SEQ ID NO: 266). In some embodiments, the intracellular domain comprises or consists essentially of a sequence identical to the LILRB1 intracellular domain (SEQ ID NO: 266).

LILRB1 intracellular domains or functional variants thereof of the disclosure can have at least 1, at least 2, at least 4, at least 4, at least 5, at least 6, at least 7, or at least 8 ITIMs. In some embodiments, the LILRB1 intracellular domain or functional variant thereof has 2, 3, 4, 5, or 6 ITIMs.

In particular embodiments, the polypeptide comprises an intracellular domain comprising two, three, four, five, or six immunoreceptor tyrosine-based inhibitory motifs (ITIMs), wherein each ITIM is independently selected from NLYAAV (SEQ ID NO: 256), VTYAEV (SEQ ID NO: 257), VTYAQL (SEQ ID NO: 258), and SIYATL (SEQ ID NO: 259).

In particular embodiments, the polypeptide comprises an intracellular domain comprising at least three immunoreceptor tyrosine-based inhibitory motifs (ITIMs), wherein each ITIM is independently selected from NLYAAV (SEQ ID NO: 256), VTYAEV (SEQ ID NO: 257), VTYAQL (SEQ ID NO: 258), and SIYATL (SEQ ID NO: 259).

In particular embodiments, the polypeptide comprises an intracellular domain comprising three immunoreceptor tyrosine-based inhibitory motifs (ITIMs), wherein each ITIM is independently selected from NLYAAV (SEQ ID NO: 256), VTYAEV (SEQ ID NO: 257), VTYAQL (SEQ ID NO: 258), and SIYATL (SEQ ID NO: 259).

In particular embodiments, the polypeptide comprises an intracellular domain comprising four immunoreceptor tyrosine-based inhibitory motifs (ITIMs), wherein each ITIM is independently selected from NLYAAV (SEQ ID NO: 256), VTYAEV (SEQ ID NO: 257), VTYAQL (SEQ ID NO: 258), and SIYATL (SEQ ID NO: 259).

In particular embodiments, the polypeptide comprises an intracellular domain comprising five immunoreceptor tyrosine-based inhibitory motifs (ITIMs), wherein each ITIM is independently selected from NLYAAV (SEQ ID NO: 256), VTYAEV (SEQ ID NO: 257), VTYAQL (SEQ ID NO: 258), and SIYATL (SEQ ID NO: 259).

In particular embodiments, the polypeptide comprises an intracellular domain comprising six immunoreceptor tyrosine-based inhibitory motifs (ITIMs), wherein each ITIM is independently selected from NLYAAV (SEQ ID NO: 256), VTYAEV (SEQ ID NO: 257), VTYAQL (SEQ ID NO: 258), and SIYATL (SEQ ID NO: 259).

In particular embodiments, the polypeptide comprises an intracellular domain comprising at least seven immunoreceptor tyrosine-based inhibitory motifs (ITIMs), wherein each ITIM is independently selected from NLYAAV (SEQ ID NO: 256), VTYAEV (SEQ ID NO: 257), VTYAQL (SEQ ID NO: 258), and SIYATL (SEQ ID NO: 259).

In some embodiments, the intracellular domain comprises a TCR alpha intracellular domain. In some embodiments, the intracellular domain comprises a TCR alpha intracellular domain and an LILRB1 intracellular domain, as described herein. In some embodiments, a TCR alpha intracellular domain comprises Ser-Ser. In some embodiments, a TCR alpha intracellular domain is encoded by a sequence of TCCAGC.

In some embodiments, the intracellular domain comprises a TCR beta intracellular domain. In some embodiments, the intracellular domain comprises a TCR beta intracellular domain and an LILRB1 intracellular domain, as described herein. In some embodiments, the TCR beta intracellular domain comprises an amino acid sequence having at least 80% identity, at least 90% identity, or is identical to a sequence of: MAMVKRKDSR (SEQ ID NO: 267). In some embodiments, the TCR beta intracellular domain comprises, or consists essentially of MAMVKRKDSR (SEQ ID NO: 267). In some embodiments, the TCR beta intracellular domain is encoded by a sequence of

```
                                    (SEQ ID NO: 268)
ATGGCCATGGTCAAGAGAAAGGATTCCAGA.
```

The LILRB1 protein has four immunoglobulin (Ig) like domains termed D1, D2, D3 and D4. In some embodiments, the LILRB1 hinge domain comprises an LILRB1 D3D4 domain or a functional variant thereof. In some embodiments, the LILRB1 D3D4 domain comprises a sequence at least 95%, at least 96%, at least 97%, at least 98%, at least 99% or identical to SEQ ID NO: 274. In some embodiments, the LILRB1 D3D4 domain comprises or consists essentially of SEQ ID NO: 274.

Transmembrane Domain

The disclosure provides inhibitory receptors the receptors comprising a polypeptide. In some embodiments, the polypeptide comprises a transmembrane domain. In some embodiments, the inhibitory receptor comprises a LILRB1 hinge domain, or a functional variant thereof. In some embodiments, the inhibitory receptor comprises a LILRBI transmembrane domain, or a functional variant thereof. In some embodiments, the inhibitory receptor comprises LILRB1 hinge and transmembrane domains, or functional variants thereof.

A "transmembrane domain", as used herein, refers to a domain of a protein that spans membrane of the cell.

Transmembrane domains typically consist predominantly of non-polar amino acids, and may traverse the lipid bilayer once or several times. Transmembrane domains usually comprise alpha helices, a configuration which maximizes internal hydrogen bonding.

Transmembrane domains isolated or derived from any source are envisaged as within the scope of the fusion proteins of the disclosure.

In particular embodiments, the polypeptide comprises an LILRB1 transmembrane domain or a functional variant thereof.

In some embodiments, the LILRB1 transmembrane domain or a functional variant thereof comprises a sequence at least 95% identical, at least 96% identical, at least 97% identical, at least 98% identical or at least 99% to SEQ ID NO: 269. In some embodiments, the LILRB1 transmembrane domain or a functional variant thereof comprises a sequence at least 95% identical to SEQ ID NO: 269. In some embodiments, the LILRB1 transmembrane domain comprises a sequence identical to SEQ ID NO: 269. In embodiments, the LILRB1 transmembrane domain consists essentially of a sequence identical to SEQ ID NO: 269.

In some embodiments of the chimeric antigen receptors of the disclosure, the transmembrane domain is not a LILRB1 transmembrane domain. In some embodiments, the transmembrane domain is one that is associated with one of the other domains of the fusion protein, or isolated or derived from the same protein as one of the other domains of the fusion protein.

The transmembrane domain may be derived either from a natural or from a recombinant source. Where the source is natural, the domain may be derived from any membrane-bound or transmembrane protein. Exemplary transmembrane domains may include at least the transmembrane region(s) of e.g., the alpha, beta or zeta chain of the TCR, CD3 delta, CD3 epsilon or CD3 gamma, CD28, CD3 epsilon, CD45, CD4, CD5, CD8, CD9, CD16, CD22, CD33, CD37, CD64, CD80, CD86, CD134, CD137, CD154.

In some embodiments, the transmembrane comprises a TCR alpha transmembrane domain. In some embodiments, the TCR alpha transmembrane domain comprises an amino acid sequence having at least 85% identity, at least 90% identity, at least 95% identity, at least 96% identity, at least 97% identity, at least 98% identity, at least 99% identity or is identical to a sequence of: VIGFRILLLKVAGFNLL-MTLRLW (SEQ ID NO: 270). In some embodiments, the TCR alpha transmembrane domain comprises, or consists essentially of, VIGFRILLLKVAGFNLLMTLRLW (SEQ ID NO: 270). In some embodiments, the TCR alpha transmembrane domain is encoded by a sequence of:

(SEQ ID NO: 271)
GTGATTGGGTTCCGAATCCTCCTCCTGAAAGTGGCCGGGTTTAATCTGCT

CATGACGCTGCGGCTGTGG.

In some embodiments, the transmembrane comprises a TCR beta transmembrane domain. In some embodiments, the TCR beta transmembrane domain comprises an amino acid sequence having at least 85% identity, at least 90% identity, at least 95% identity, at least 96% identity, at least 97% identity, at least 98% identity, at least 99% identity or is identical to a sequence of: TILYEILLGKAT-LYAVLVSALVL (SEQ ID NO: 272). In some embodiments, the TCR beta transmembrane domain comprises, or consists essentially of TILYEILLGKATLYAVLVSALVL (SEQ ID NO: 272). In some embodiments, the TCR beta transmembrane domain is encoded by a sequence of (SEQ ID NO: 273)
ACCATCCTCTATGAGATCTTGCTAGGGAAGGCCACCTTGTATGCCGTGCT

GGTCAGTGCCCTCGTGCTG.

In some embodiments, the TCR alpha and/or TCR beta transmembrane domain comprises one or more mutations that attenuate or abolish interaction of the TCR with the TCR CD3 subunit. In some embodiments, the TCR alpha transmembrane domain comprises a R253L mutation. In some embodiments, the TCR beta transmembrane domain comprises a K288L mutation.

In some embodiments the transmembrane domain comprise a CD28 transmembrane domain. In some embodiments, the CD28 transmembrane domain comprises an amino acid sequence having at least 80% identity, at least 90% identity, at least 95% identity, at least 99% identity or is identical to a sequence of FWVLVVVGGVLACYSLL-VTVAFIIFWV (SEQ ID NO: 232). In some embodiments, the CD28 transmembrane domain comprises or consists essentially of FWVLVVVGGVLACYSLLVTVAFIIFWV (SEQ ID NO: 232). In some embodiments, the CD28 transmembrane domain is encoded by a nucleotide sequence having at least 80% identity, at least 90% identity, at least 95% identity, at least 99% identity or is identical to a sequence of (SEQ ID NO: 233)
TTCTGGGTGCTGGTCGTTGTGGGCGGCGTGCTGGCCTGCTACAGCCTGCT

GGTGACAGTGGCCTTCATCATCTTTTGGGTG.

In some embodiments, the transmembrane domain can be attached to the extracellular region chimeric antigen receptor, e.g., the antigen-binding domain or ligand binding domain, via a hinge, e.g., a hinge from a human protein. For example, in some embodiments, the hinge can be a human immunoglobulin (Ig) hinge, e.g., an IgG4 hinge, a CD8α hinge or an LILRB1 hinge.

Hinge Domain

The disclosure provides inhibitory receptors, the receptors comprising a polypeptide. In some embodiments, the polypeptide comprises a hinge domain. In some embodiments, the hinge domain is a LILRB1 hinge domain or a functional variant thereof.

The LILRB1 protein has four immunoglobulin (Ig) like domains termed D1, D2, D3 and D4. In some embodiments, the LILRB1 hinge domain comprises an LILRB1 D3D4 domain or a functional variant thereof. In some embodiments, the LILRB1 D3D4 domain comprises a sequence at least 95%, at least 96%, at least 97%, at least 98%, at least 99% or identical to SEQ ID NO: 274. In some embodiments, the LILRB1 D3D4 domain comprises or consists essentially of SEQ ID NO: 274.

In some embodiments, the polypeptide comprises the LILRB1 hinge domain or functional fragment or variant thereof. In embodiments, the LILRB1 hinge domain or functional fragment or variant thereof comprises a sequence at least 95%, at least 96%, at least 97%, at least 98%, at least 99% identical or identical to SEQ ID NO: 275, SEQ ID NO: 274, or SEQ ID NO: 276. In embodiments, the LILRB1 hinge domain or functional fragment or variant thereof comprises a sequence at least 95% identical to SEQ ID NO: 275, SEQ ID NO: 274, or SEQ ID NO: 276.

In some embodiments, the LILRB1 hinge domain comprises a sequence identical to SEQ ID NO: 275, SEQ ID NO: 274, or SEQ ID NO: 276.

In some embodiments, the LILRB1 hinge domain consists essentially of a sequence identical to SEQ ID NO: 275, SEQ ID NO: 274, or SEQ ID NO: 276.

In some embodiments the chimeric antigen receptors of the disclosure, the polypeptide comprises a hinge that is not isolated or derived from LILRB1.

In some embodiments, the hinge is isolated or derived from CD8α or CD28. In some embodiments, the CD8α hinge comprises an amino acid sequence having at least 80% identity, at least 90% identity, at least 95% identity, at least 99% identity or is identical to a sequence of TTTPAPRPPT-PAPTIASQPLSLRPEACRPAAGGAVHTRGLDFACD (SEQ ID NO: 219). In some embodiments, the CD8α hinge comprises TTTPAPRPPTPAPTIASQPLSLRPEACR-PAAGGAVHTRGLDFACD (SEQ ID NO: 219).

In some embodiments, the CD8α hinge consists essentially of

```
                                         (SEQ ID NO: 219)
TTTPAPRPPTPAPTIASQPLSLRPEACRPAAGGAVHTRGLDFACD.
```

In some embodiments, the CD8α hinge is encoded by a nucleotide sequence having at least 80% identity, at least 90% identity, at least 95% identity, at least 99% identity or is identical to a sequence of

```
                                         (SEQ ID NO: 220)
accacgacgccagcgccgcgaccaccaacaccggcgccaccatcgcgtc gcagccctgtccctgcgcccagaggcgtgccggccagcggcggggggcg cagtgcacacgaggggctggacttcgcctgtgat.
```

In some embodiments, the CD28 hinge comprises an amino acid sequence having at least 80% identity, at least 90% identity, at least 95% identity, at least 99% identity or is identical to a sequence of CTIEVMYPPPYLD-NEKSNGTIIHVKGKHLCPSPLFPGPSKP (SEQ ID NO: 221). In some embodiments, the CD28 hinge comprises or consists essentially of CTIEVMYPPPYLD-NEKSNGTIIHVKGKHLCPSPLFPGPSKP (SEQ ID NO: 221). In some embodiments, the CD28 hinge is encoded by a nucleotide sequence having at least 80% identity, at least 90% identity, at least 95% identity, at least 99% identity or is identical to a sequence of

```
                                         (SEQ ID NO: 222)
tgtaccattgaagttatgtatcctcctccttacctagacaatgagaagag caatggaaccattatccatgtgaaagggaaacacctttgtccaagtcccc tatttcccggaccttctaagccc.
```

Combinations of LILRB1 Domains

In some embodiments, the inhibitory receptors of the disclosure comprise a polypeptide comprising more than one LILRB1 domain or functional equivalent thereof. For example, in some embodiments, the polypeptide comprises an LILRB1 transmembrane domain and intracellular domain, or an LILRB1 hinge domain, transmembrane domain and intracellular domain.

In particular embodiments, the polypeptide comprises an LILRB1 hinge domain or functional fragment or variant thereof, and the LILRB1 transmembrane domain or a functional variant thereof. In some embodiments, the polypeptide comprises a sequence at least 95% identical, at least 96% identical, at least 97% identical, at least 98% identical, at least 99% identical or identical to SEQ ID NO: 277. In some embodiments, the polypeptide comprises a sequence at least 95% identical to SEQ ID NO: 277. In some embodiments, the polypeptide comprises a sequence identical to SEQ ID NO: 277.

In further embodiments, the polypeptide comprises: the LILRB1 transmembrane domain or a functional variant thereof, and an LILRB1 intracellular domain and/or an intracellular domain comprising at least one immunoreceptor tyrosine-based inhibitory motif (ITIM), wherein the ITIM is selected from NLYAAV (SEQ ID NO: 256), VTY-AEV (SEQ ID NO: 257), VTYAQL (SEQ ID NO: 258), and SIYATL (SEQ ID NO: 259). In some embodiments, the polypeptide comprises the LILRB1 transmembrane domain or a functional variant thereof, and an LILRB1 intracellular domain and/or an intracellular domain comprising at least two ITIM, wherein each ITIM is independently selected from NLYAAV (SEQ ID NO: 256), VTYAEV (SEQ ID NO: 257), VTYAQL (SEQ ID NO: 258), and SIYATL (SEQ ID NO: 259).

In some embodiments, the polypeptide comprises a LILRB1 transmembrane domain and intracellular domain. In some embodiments, the polypeptide comprises a sequence at least 95% identical, at least 96% identical, at least 97% identical, at least 98% identical, at least 99% identical or identical to SEQ ID NO: 278. In some embodiments, the polypeptide comprises a sequence at least 95% identical to SEQ ID NO: 278. In some embodiments, the polypeptide comprises a sequence identical to SEQ ID NO: 278.

In preferred embodiments, the polypeptide comprises: an LILRB1 hinge domain or functional fragment or variant thereof; an LILRB1 transmembrane domain or a functional variant thereof; and an LILRB1 intracellular domain and/or an intracellular domain comprising at least two immunoreceptor tyrosine-based inhibitory motifs (ITIMs), wherein each ITIM is independently selected from NLYAAV (SEQ ID NO: 256), VTYAEV (SEQ ID NO: 257), VTYAQL (SEQ ID NO: 258), and SIYATL (SEQ ID NO: 259).

In some embodiments, the polypeptide comprises a sequence at least 95% identical to SEQ ID NO: 254 or SEQ ID NO: 279, or at least 99% identical to SEQ ID NO: 254 or SEQ ID NO: 279, or identical to SEQ ID NO: 254 or SEQ ID NO: 279.

In some embodiments, the polypeptide comprises a sequence at least 99% identical to SEQ ID NO: 277, or at least 99% identical to SEQ ID NO: 277, or identical to SEQ ID NO: 277.

In some embodiments, the polypeptide comprises a sequence at least 99% identical to SEQ ID NO: 278, or at least 99% identical to SEQ ID NO: 278, or identical to SEQ ID NO: 278.

In some embodiments, the inhibitory receptor comprises a LIRLRB1 hinge, transmembrane and intracellular domain. In some embodiments, the LIRLRB1 hinge, transmembrane and intracellular domain comprises a sequence of SEQ ID NO: 254, or a sequence at 90%, at least 95% identical, at least 96% identical, at least 97% identical, at least 98% identical, at least 99% identical or identical thereto.

TABLE 16

Inhibitory receptor Hinge, Transmembrane and Intracellular Domains

| Construct | Protein Sequence | DNA Sequence |
|---|---|---|
| C-1765, C2162, C2163 | YGSQSSKPYLLT HPSDPLELVVSG PSGGPSSPTTGP TSTSGPEDQPLT PTGSDPQSGLGR HLGVVIGILVAV ILLLLLLLLLFL ILRHRRQGKHWT STQRKADFQHPA GAVGPEPTDRGL QWRSSPAADAQE ENLYAAVKHTQP EDGVEMDTRSPH DEDPQAVTYAEV KHSRPRREMASP PSPLSGEFLDTK DRQAEEDRQMDT EAAASEAPQDVT YAQLHSLTLRRE ATEPPPSQEGPS PAVPSIYATLAI H (SEQ ID NO: 254) | TACGGCTCACAGAGCTCCAAACCCTA CCTGCTGACTCACCCCAGTGACCCCC TGGAGCTCGTGGTCTCAGGACCGTCT GGGGGGCCCCAGCTCCCCGACAACAGG CCCCACCTCCACATCTGGCCCTGAGG ACCAGCCCCTCACCCCCACCGGGTCG GATCCCCAGAGTGGTCTGGGAAGGCA CCTGGGGGTTGTGATCGGCATCTTGG TGGCCGTCATCCTACTGCTCCTCCTC CTCCTCCTCCTCTTCCTCATCCTCCG ACATCGACGTCAGGGCAAACACTGGA CATCGACCCAGAGAAAGGCTGATTTC CAACATCCTGCAGGGGCTGTGGGGCC AGAGCCCACAGACAGAGGCCTGCAGT GGAGGTCCAGCCCAGCTGCCGATGCC CAGGAAGAAAACCTCTATGCTGCCGT CAGGAAGAAAACCTCTATGCTGCCGT GAAGCACACACAGCCTGAGGATGGGG TGGAGATGGACACTCGGAGCCCACAC GATGAAGACCCCCAGGCAGTGACGTA TGCCGAGGTGAAACACTCCAGACCTA GGAGAGAAATGGCCTCTCCTCCTTCC CCACTGTCTGGGGAATTCCTGGACAC AAAGGACAGACAGGCGGAAGAGGACA GGCAGATGGACACTGAGGCTGCTGCA TCTGAAGCCCCCAGGATGTGACCTA CGCCCAGCTGCACAGCTTGACCCTCA GACGGGAGGCAACTGAGCCTCCTCCA TCCCAGGAAGGGCCCTCTCCAGCTGT GCCCAGCATCTACGCCACTCTGGCCA TCCACTAG (SEQ ID NO: 255) |

Additional sequences for the LILRB1 based inhibitory receptors of the disclosure are shown in Table 17 below.

TABLE 17

Polypeptide Sequences for Elements of Illustrative Inhibitory Receptors

| Name | Sequence |
|---|---|
| LILRB1 | MTPILTVLICLGLSLGPRTHVQAGHLPKPTLWAEPGSVIT QGSPVTLRCQGGQETQEYRLYREKKTALWITRIPQELVKK GQFPIPSITWEHAGRYRCYYGSDTAGRSESSDPLELVVTG AYIKPTLSAQPSPVVNSGGNVILQCDSQVAFDGFSLCKEG EDEHPQCLNSQPHARGSSRAIFSVGPVSPSRRWWYRCYAY DSNSPYEWSLPSDLLELLVLGVSKKPSLSVQPGPIVAPEE TLTLQCGSDAGYNRFVLYKDGERDFLQLAGAQPQAGLSQA NFTLGPVSRSYGGQYRCYGAHNLSSEWSAPSDPLDILIAG QFYDRVSLSVQPGPTVASGENVTLLCQSQGWMQTFLLTKE GAADDPWRLRSTYQSQKYQAEFPMGPVTSAHAGTYRCYGS QSSKPYLLTHPSDPLELVVSGPSGGPSSPTTGPTSTSGPE DQPLTPTGSDPQSGLGRHLGVVIGILVAVILLLLLLLLF LILRHRRQGKHWTSTQRKADFQHPAGAVGPEPTDRGLQWR SSPAADAQEENLYAAVKHTQPEDGVEMDTRSPHDEDPQAV TYAEVKHSRPRREMASPPSPLSGEFLDTKDRQAEEDRQMD TEAAASEAPQDVTYAQLHSLTLRREATEPPPSQEGPSPAV PSIYATLAIH SEQ ID NO: 280 |
| LILRB1 hinge-trans-membrane-intra-cellular domain | YGSQSSKPYLLTHPSDPLELVVSGPSGGPSSPTTGPTSTS GPEDQPLTPTGSDPQSGLGRHLGVVIGILVAVILLLLLLL LLFLILRHRRQGKHWTSTQRKADFQHPAGAVGPEPTDRGL QWRSSPAADAQEENLYAAVKHTQPEDGVEMDTRSPHDEDP QAVTYAEVKHSRPRREMASPPSPLSGEFLDTKDRQAEEDR QMDTEAAASEAPQDVTYAQLHSLTLRREATEPPPSQEGPS PAVPSIYATLAIH SEQ ID NO: 254 |
| LILRB1 hinge-trans-membrane-intra- | VVSGPSGGPSSPTTGPTSTSGPEDQPLTPTGSDPQSGLGR HLGVVIGILVAVILLLLLLLLFLILRHRRQGKHWTSTQR KADFQHPAGAVGPEPTDRGLQWRSSPAADAQEENLYAAVK HTQPEDGVEMDTRSPHDEDPQAVTYAEVKHSRPRREMASP PSPLSGEFLDTKDRQAEEDRQMDTEAAASEAPQDVTYAQL |

TABLE 17-continued

Polypeptide Sequences for Elements of Illustrative Inhibitory Receptors

| Name | Sequence |
|---|---|
| cellular domain (w/o YGSQSSKPY LLTHPSDPL EL, SEQ ID NO: 18) | HSLTLRREATEPPPSQEGPSPAVPSIYATLAIH SEQ ID NO: 279 |
| LILRB1 hinge domain | YGSQSSKPYLLTHPSDPLELVVSGPSGGPSSPTTGPTSTS GPEDQPLTPTGSDPQSGLGRHLG SEQ ID NO: 275 |
| LILRB1 trans-membrane domain | VVIGILVAVILLLLLLLLFLIL SEQ ID NO: 269 |
| LILRB1 intra-cellular domain | RHRRQGKHWTSTQRKADFQHPAGAVGPEPTDRGLQWRSSP AADAQEENLYAAVKHTQPEDGVEMDTRSPHDEDPQAVTYA EVKHSRPRREMASPPSPLSGEFLDTKDRQAEEDRQMDTEA AASEAPQDVTYAQLHSLTLRREATEPPPSQEGPSPAVPSI YATLAIH SEQ ID NO: 266 |
| ITIM1 | NLYAAV SEQ ID NO: 256 |
| ITIM2 | VTYAEV SEQ ID NO: 257 |
| ITIM3 | VTYAQL SEQ ID NO: 258 |
| ITIM4 | SIYATL SEQ ID NO: 259 |
| ITIM1-2 | NLYAAVKHTQPEDGVEMDTRSPHDEDPQAVTYAEV SEQ ID NO: 281 |
| ITIM2-3 | VTYAEVKHSRPRREMASPPSPLSGEFLDTKDRQAEEDRQM DTEAAASEAPQDVTYAQL SEQ ID NO: 261 |
| ITIM3-4 | VTYAQLHSLTLRREATEPPPSQEGPSPAVPSIYATL SEQ ID NO: 262 |
| ITIM1-3 | NLYAAVKHTQPEDGVEMDTRSPHDEDPQAVTYAEVKHSRP RREMASPPSPLSGEFLDTKDRQAEEDRQMDTEAAASEAPQ DVTYAQL SEQ ID NO: 263 |
| ITIM2-4 | VTYAEVKHSRPRREMASPPSPLSGEFLDTKDRQAEEDRQM DTEAAASEAPQDVTYAQLHSLTLRREATEPPPSQEGPSPA VPSIYATL SEQ ID NO: 264 |
| ITIM1-4 | NLYAAVKHTQPEDGVEMDTRSPHDEDPQAVTYAEVKHSRP RREMASPPSPLSGEFLDTKDRQAEEDRQMDTEAAASEAPQ DVTYAQLHSLTLRREATEPPPSQEGPSPAVPSIYATL SEQ ID NO: 265 |
| D3D4 domain | YGSQSSKPYLLTHPSDPLEL SEQ ID NO: 274 |
| Short hinge | VVSGPSGGPSSPTTGPTSTSGPEDQPLTPTGSDPQSGLGR HLG SEQ ID NO: 276 |
| Hinge (iTIM hinge) | YGSQSSKPYLLTHPSDPLELVVSGPSGGPSSPTTGPTSTS GPEDQPLTPTGSDPQSGLGRHLGV (SEQ ID NO: 282) |
| Short hinge 2 | VVSGPSGGPSSPTTGPTSTSGPEDQPLTPTGSDPQSGLGR HLGV (SEQ ID NO: 283) |
| Long hinge 1 | AGSGGSGGSGGSPVPSTPPTPSPSTPPTPSPSGGSGNSSG SGGSPVPSTPPTPSPSTPPTPSPSASV (SEQ ID NO: 284) |
| Long hinge 2 | AGSGGSGGSGGSPVPSTPPTNSSTPPTPSPSPVPSTPPT NSSTPPTPSPSPVPSTPPTNSSTPPTPSPSASV (SEQ ID NO: 285) |

TABLE 17-continued

Polypeptide Sequences for Elements of
Illustrative Inhibitory Receptors

| Name | Sequence |
|---|---|
| 2X short hinge | VVSGPSGGPSSPTTGPTSTSGPEDQPLTPTGSDPQSGLGR HVVSGPSGGPSSPTTGPTSTSGPEDQPLTPTGSDPQSGLG RHLGV (SEQ ID NO: 286) |
| Hinge (truncated) | TTGPTSTSGPEDQPLTPTGSDPQSGLGRHLGV (SEQ ID NO: 287) |
| Hinge-transmembrane | YGSQSSKPYLLTHPSDPLELVVSGPSGGPSSPTTGPTSTS GPEDQPLTPTGSDPQSGLGRHLGVVIGILVAVILLLLLL LLFLIL SEQ ID NO: 277 |
| Transmembrane-intracellular domain | VVIGILVAVILLLLLLLLLFLILRHRRQGKHWTSTQRKAD FQHPAGAVGPEPTDRGLQWRSSPAADAQEENLYAAVKHTQ PEDGVEMDTRSPHDEDPQAVTYAEVKHSRPRREMASPPSP LSGEFLDTKDRQAEEDRQMDTEAAASEAPQDVTYAQLHSL TLRREATEPPPSQEGPSPAVPSIYATLAIH SEQ ID NO: 278 |

Assays

Provided herein are assays that can be used to measure the activity of the engineered receptors of the disclosure.

The activity of engineered receptors can be assayed using a cell line engineered to express a reporter of receptor activity such as a luciferase reporter. Exemplary cell lines include Jurkat T cells, although any suitable cell line known in the art may be used. For example, Jurkat cells expressing a luciferase reporter under the control of an NFAT promoter can be used as effector cells. Expression of luciferase by this cell line reflects TCR-mediated signaling.

The reporter cells can be transfected with each of the various fusion protein constructs, combinations of fusion protein constructs or controls described herein.

Expression of the fusion proteins in reporter cells can be confirmed by using fluorescently labeled MHC tetramers, for example Alexa Fluor 647-labeled HER2-MHC tetramer, to detect expression of the fusion protein.

To assay the activity of engineered receptors, target cells are loaded with antigen prior to exposure to the effector cells comprising the reporter and the engineered receptor. For example, target cells can be loaded with antigen at least 12, 14, 16, 18, 20, 22 or 24 hours prior to exposure to effector cells. Exemplary target cells include A375 cells, although any suitable cells known in the art may be used. In some cases, target cells can be loaded with serially diluted concentrations of an antigen, such as a HER2 antigen. The effector cells can then be co-cultured with target cells for a suitable period of time, for example 6 hours. Luciferase is then measured by luminescence reading after co-culture. Luciferase luminescence can be normalized to maximum and minimum intensity to allow comparison of activating peptide concentrations for each engineered receptor construct.

Provided herein are methods of determining the relative EC50 of engineered receptors of the disclosure. As used herein, "EC50" refers to the concentration of an inhibitor or agent where the response (or binding) is reduced by half. EC50s of engineered receptors of the disclosure refer to concentration of antigen where binding of the engineered receptor to the antigen is reduced by half. Binding of the antigen, or probe to the engineered receptor can be measured by staining with labeled peptide or labeled peptide-MHC complex, for example MHC:HER2 pMHC complex conjugated with fluorophore. EC50 can be obtained by nonlinear regression curve fitting of reporter signal with peptide titration. Probe binding and EC50 can be normalized to the levels of benchmark TCR without a fusion protein, e.g. HER2.

Polynucleotides

The disclosure provides a polynucleotide system, comprising one or more polynucleotides comprising polynucleotide sequences encoding: an activator receptor comprising an extracellular ligand binding domain specific to an erb-b2 receptor tyrosine kinase 2 (HER2) antigen; and an inhibitory receptor comprising an extracellular ligand binding domain specific to a non-target antigen that is not expressed by the cancer cell due to a loss of heterozygosity in the cancer cell.

The disclosure provides vectors comprising the polynucleotide system described herein. The disclosure provides vectors comprising the polynucleotides described herein.

The disclosure provides polynucleotides encoding the sequence(s) of the activator and inhibitory receptors described herein. In some embodiments, the sequence of the activating and/or inhibitory receptor, or a fusion protein of the activator and/or inhibitory receptor is operably linked to a promoter. In some embodiments, the sequence encoding the activator receptor, or a polypeptide thereof, is operably linked to a first promoter, and the sequence encoding an inhibitory receptor, or a fusion protein thereof, is operably linked to a second promoter.

In some embodiments, the polynucleotide or polynucleotide system comprises SEQ ID NO: 52, or a sequence that shares at least 80%, at least 85%, at least 90%, at least 95%, or at least 98% identity thereto. In some embodiments, the polynucleotide or polynucleotide system comprises SEQ ID NO: 54, or a sequence that shares at least 80%, at least 85%, at least 90%, at least 95%, or at least 98% identity thereto. In some embodiments, the polynucleotide or polynucleotide system comprises SEQ ID NO: 56, or a sequence that shares at least 80%, at least 85%, at least 90%, at least 95%, or at least 98% identity thereto.

In some embodiments, the polynucleotide or polynucleotide system comprises SEQ ID NO: 58, or a sequence that shares at least 80%, at least 85%, at least 90%, at least 95%, or at least 98% identity thereto. In some embodiments, the polynucleotide or polynucleotide system comprises SEQ ID NO: 60, or a sequence that shares at least 80%, at least 85%, at least 90%, at least 95%, or at least 98% identity thereto. In some embodiments, the polynucleotide or polynucleotide system comprises SEQ ID NO: 62, or a sequence that shares at least 80%, at least 85%, at least 90%, at least 95%, or at least 98% identity thereto. In some embodiments, the polynucleotide or polynucleotide system comprises SEQ ID NO: 21803, or a sequence that shares at least 80%, at least 85%, at least 90%, at least 95%, or at least 98% identity thereto.

In some embodiments, the polynucleotide or polynucleotide system comprises anyone of SEQ ID NOs: 75-86, or a sequence that shares at least 80%, at least 85%, at least 90%, at least 95%, or at least 98% identity thereto. In some embodiments, the polynucleotide or polynucleotide system comprises SEQ ID NO: 76, or a sequence that shares at least 80%, at least 85%, at least 90%, at least 95%, or at least 98% identity thereto. In some embodiments, the polynucleotide or polynucleotide system comprises SEQ ID NO: 77, or a sequence that shares at least 80%, at least 85%, at least 90%, at least 95%, or at least 98% identity thereto. In some embodiments, the polynucleotide or polynucleotide system comprises SEQ ID NO: 78, or a sequence that shares at least 80%, at least 85%, at least 90%, at least 95%, or at least 98% identity thereto. In some embodiments, the polynucleotide or polynucleotide system comprises SEQ ID NO: 79, or a sequence that shares at least 80%, at least 85%, at least 90%, at least 95%, or at least 98% identity thereto. In some embodiments, the polynucleotide or polynucleotide system comprises SEQ ID NO: 80, or a sequence that shares at least 80%, at least 85%, at least 90%, at least 95%, or at least 98% identity thereto. In some embodiments, the polynucleotide or polynucleotide system comprises SEQ ID NO: 81, or a sequence that shares at least 80%, at least 85%, at least 90%, at least 95%, or at least 98% identity thereto. In some embodiments, the polynucleotide or polynucleotide system comprises SEQ ID NO: 82, or a sequence that shares at least 80%, at least 85%, at least 90%, at least 95%, or at least 98% identity thereto. In some embodiments, the polynucleotide or polynucleotide system comprises SEQ ID NO: 83, or a sequence that shares at least 80%, at least 85%, at least 90%, at least 95%, or at least 98% identity thereto. In some embodiments, the polynucleotide or polynucleotide system comprises SEQ ID NO: 84, or a sequence that shares at least 80%, at least 85%, at least 90%, at least 95%, or at least 98% identity thereto. In some embodiments, the polynucleotide or polynucleotide system comprises SEQ ID NO: 85, or a sequence that shares at least 80%, at least 85%, at least 90%, at least 95%, or at least 98% identity thereto. In some embodiments, the polynucleotide or polynucleotide system comprises SEQ ID NO: 86, or a sequence that shares at least 80%, at least 85%, at least 90%, at least 95%, or at least 98% identity thereto. In some embodiments, the polynucleotide or polynucleotide system comprises SEQ ID NO: 208, or a sequence that shares at least 80%, at least 85%, at least 90%, at least 95%, or at least 98% identity thereto. In some embodiments, the polynucleotide or polynucleotide system comprises SEQ ID NO: 210, or a sequence that shares at least 80%, at least 85%, at least 90%, at least 95%, or at least 98% identity thereto. In some embodiments, the polynucleotide or polynucleotide system comprises SEQ ID NO: 212, or a sequence that shares at least 80%, at least 85%, at least 90%, at least 95%, or at least 98% identity thereto.

In some embodiments, the polynucleotide or polynucleotide system comprises any one of SEQ ID NOs: 224, 226, 227, 229, or 231, or a sequence that shares at least 80%, at least 85%, at least 90%, at least 95%, or at least 98% identity thereto.

In some embodiments, the polynucleotide or polynucleotide system comprises any one of SEQ ID NOs: 292, 294, 296, 298, 300, 302 304, 306, or 308, or a sequence that shares at least 80%, at least 85%, at least 90%, at least 95%, or at least 98% identity thereto.

The disclosure provides vectors encoding the coding sequence or sequences of any of the engineered receptors described herein. In some embodiments, the sequence of the activating and/or inhibitory receptor is operably linked to a promoter. In some embodiments, the sequence encoding the activating receptor is operably linked to a first promoter, and the sequence encoding an inhibitory receptor is operably linked to a second promoter.

In some embodiments, the activating receptor is encoded by a first vector and the inhibitory receptor is encoded by second vector. In some embodiments, both engineered receptors are encoded by a single vector.

In some embodiments, the activator and inhibitory receptors are encoded by a single vector. Methods of encoding multiple polypeptides using a single vector will be known to persons of ordinary skill in the art, and include, inter alia, encoding multiple polypeptides under control of different promoters, or, if a single promoter is used to control transcription of multiple polypeptides, use of sequences encoding internal ribosome entry sites (IRES) and/or self-cleaving peptides. Exemplary self-cleaving peptides include T2A, P2A, E2A and F2A self-cleaving peptides. In some embodiments, the T2A self-cleaving peptide comprises a sequence of EGRGSLLTCGDVEENPGP (SEQ ID NO: 288). In some embodiments, the P2A self-cleaving peptide comprises a sequence of ATNFSLLKQAGDVEENPGP (SEQ ID NO: 196). In some embodiments, the E2A self-cleaving peptide comprises a sequence of QCTNYALLKLAGDVESNPGP (SEQ ID NO: 289). In some embodiments, the F2A self-cleaving peptide comprises a sequence of VKQTLNFDLLKLAGDVESNPGP (SEQ ID NO: 290). Any of the foregoing can also include an N terminal GSG linker. For example, a T2A self-cleaving peptide can also comprise a sequence of GSGEGRGSLLTCGDVEENPGP (SEQ ID NO: 557), which can be encoded by a sequence of

```
                                              (SEQ ID NO: 558)
GGATCCGGAGAGGGCAGAGGCAGCCTGCTGACATGTGGCGACGTGGAAGA

GAACCCTGGCCCC.
```

In some embodiments, the vector comprises SEQ ID NO: 52, or a sequence that shares at least 80%, at least 85%, at least 90%, at least 95%, or at least 98% identity thereto. In some embodiments, the vector comprises SEQ ID NO: 54, or a sequence that shares at least 80%, at least 85%, at least 90%, at least 95%, or at least 98% identity thereto. In some embodiments, the vector comprises SEQ ID NO: 56, or a sequence that shares at least 80%, at least 85%, at least 90%, at least 95%, or at least 98% identity thereto. In some embodiments, the vector comprises SEQ ID NO: 58, or a sequence that shares at least 80%, at least 85%, at least 90%, at least 95%, or at least 98% identity thereto. In some embodiments, the vector comprises SEQ ID NO: 60, or a sequence that shares at least 80%, at least 85%, at least 90%, at least 95%, or at least 98% identity thereto. In some embodiments, the vector comprises SEQ ID NO: 62, or a sequence that shares at least 80%, at least 85%, at least 90%, at least 95%, or at least 98% identity thereto. In some embodiments, the vector comprises SEQ ID NO: 21803, or a sequence that shares at least 80%, at least 85%, at least 90%, at least 95%, or at least 98% identity thereto.

In some embodiments, the vector comprises SEQ ID NO: 75, or a sequence that shares at least 80%, at least 85%, at least 90%, at least 95%, or at least 98% identity thereto. In some embodiments, the vector comprises SEQ ID NO: 76, or a sequence that shares at least 80%, at least 85%, at least 90%, at least 95%, or at least 98% identity thereto. In some embodiments, the vector comprises SEQ ID NO: 77, or a sequence that shares at least 80%, at least 85%, at least 90%, at least 95%, or at least 98% identity thereto. In some embodiments, the vector comprises SEQ ID NO: 78, or a sequence that shares at least 80%, at least 85%, at least 90%, at least 95%, or at least 98% identity thereto. In some embodiments, the vector comprises SEQ ID NO: 79, or a sequence that shares at least 80%, at least 85%, at least 90%, at least 95%, or at least 98% identity thereto. In some embodiments, the vector comprises SEQ ID NO: 80, or a sequence that shares at least 80%, at least 85%, at least 90%, at least 95%, or at least 98% identity thereto. In some embodiments, the vector comprises SEQ ID NO: 81, or a sequence that shares at least 80%, at least 85%, at least 90%, at least 95%, or at least 98% identity thereto. In some embodiments, the vector comprises SEQ ID NO: 82, or a sequence that shares at least 80%, at least 85%, at least 90%, at least 95%, or at least 98% identity thereto. In some embodiments, the vector comprises SEQ ID NO: 83, or a sequence that shares at least 80%, at least 85%, at least 90%, at least 95%, or at least 98% identity thereto. In some embodiments, the vector comprises SEQ ID NO: 84, or a sequence that shares at least 80%, at least 85%, at least 90%, at least 95%, or at least 98% identity thereto. In some embodiments, the vector comprises SEQ ID NO: 85, or a sequence that shares at least 80%, at least 85%, at least 90%, at least 95%, or at least 98% identity thereto. In some embodiments, the vector comprises SEQ ID NO: 86, or a sequence that shares at least 80%, at least 85%, at least 90%, at least 95%, or at least 98% identity thereto. In some embodiments, the vector comprises SEQ ID NO: 208, or a sequence that shares at least 80%, at least 85%, at least 90%, at least 95%, or at least 98% identity thereto. In some embodiments, the vector comprises SEQ ID NO: 210, or a sequence that shares at least 80%, at least 85%, at least 90%, at least 95%, or at least 98% identity thereto. In some embodiments, the vector comprises SEQ ID NO: 212, or a sequence that shares at least 80%, at least 85%, at least 90%, at least 95%, or at least 98% identity thereto.

In some embodiments, the vector comprises SEQ ID NO: 224, 226, 227, 229, or 231, or a sequence that shares at least 80%, at least 85%, at least 90%, at least 95%, or at least 98% identity thereto. In some embodiments, the vector comprises SEQ ID NO: 292, 294, 296, 298, 300, 302, 304, 306, or 308, or a sequence that shares at least 80%, at least 85%, at least 90%, at least 95%, or at least 98% identity thereto.

In some embodiments, the vector encodes a polypeptide sequence comprising SEQ ID NO: 51, or a sequence that shares at least 80%, at least 85%, at least 90%, at least 95%, or at least 98% identity thereto. In some embodiments, the vector encodes a polypeptide sequence comprising SEQ ID NO: 53, or a sequence that shares at least 80%, at least 85%, at least 90%, at least 95%, or at least 98% identity thereto. In some embodiments, the vector encodes a polypeptide sequence comprising SEQ ID NO: 55, or a sequence that shares at least 80%, at least 85%, at least 90%, at least 95%, or at least 98% identity thereto. In some embodiments, the vector encodes a polypeptide sequence comprising SEQ ID NO: 57, or a sequence that shares at least 80%, at least 85%, at least 90%, at least 95%, or at least 98% identity thereto. In some embodiments, the vector encodes a polypeptide sequence comprising SEQ ID NO: 59, or a sequence that shares at least 80%, at least 85%, at least 90%, at least 95%, or at least 98% identity thereto. In some embodiments, the vector encodes a polypeptide sequence comprising SEQ ID NO: 61, or a sequence that shares at least 80%, at least 85%, at least 90%, at least 95%, or at least 98% identity thereto. In some embodiments, the vector encodes a polypeptide sequence comprising SEQ ID NO: 63, or a sequence that shares at least 80%, at least 85%, at least 90%, at least 95%, or at least 98% identity thereto. In some embodiments, the vector encodes a polypeptide sequence comprising SEQ ID NO: 64, or a sequence that shares at least 80%, at least 85%, at least 90%, at least 95%, or at least 98% identity thereto. In some embodiments, the vector encodes a polypeptide sequence comprising SEQ ID NO: 65, or a sequence that shares at least 80%, at least 85%, at least 90%, at least 95%, or at least 98% identity thereto. In some embodiments, the vector encodes a polypeptide sequence comprising SEQ ID NO: 66, or a sequence that shares at least 80%, at least 85%, at least 90%, at least 95%, or at least 98% identity thereto. In some embodiments, the vector encodes a polypeptide sequence comprising SEQ ID NO: 67, or a sequence that shares at least 80%, at least 85%, at least 90%, at least 95%, or at least 98% identity thereto. In some embodiments, the vector encodes a polypeptide sequence comprising SEQ ID NO: 68, or a sequence that shares at least 80%, at least 85%, at least 90%, at least 95%, or at least 98% identity thereto. In some embodiments, the vector encodes a polypeptide sequence comprising SEQ ID NO: 69, or a sequence that shares at least 80%, at least 85%, at least 90%, at least 95%, or at least 98% identity thereto. In some embodiments, the vector encodes a polypeptide sequence comprising SEQ ID NO: 70, or a sequence that shares at least 80%, at least 85%, at least 90%, at least 95%, or at least 98% identity thereto. In some embodiments, the vector encodes a polypeptide sequence comprising SEQ ID NO: 72, or a sequence that shares at least 80%, at least 85%, at least 90%, at least 95%, or at least 98% identity thereto. In some embodiments, the vector encodes a polypeptide sequence comprising SEQ ID NO: 73, or a sequence that shares at least 80%, at least 85%, at least 90%, at least 95%, or at least 98% identity thereto. In some embodiments, the vector encodes a polypeptide sequence comprising SEQ ID NO: 74, or a sequence that shares at least 80%, at least 85%, at least 90%, at least 95%, or at least 98% identity thereto.

In some embodiments, the vector encodes a polypeptide sequence comprising SEQ ID NO: 207, 209, or 211, or a sequence that shares at least 80%, at least 85%, at least 90%, at least 95%, or at least 98% identity thereto. In some embodiments, the vector encodes a polypeptide sequence comprising SEQ ID NO: 291, 293, 295, 297, 299, 301, 303, 305, 307, 21805, or a sequence that shares at least 80%, at least 85%, at least 90%, at least 95%, or at least 98% identity thereto.

In some embodiments, a polynucleotide sequence provided herein is codon-optimized. Codon-optimization is the process of introducing silent nucleotide changes into a nucleic acid sequence which increase the production of the protein encoded by the nucleic acid sequence without changing the amino acid sequence of the protein.

In some embodiments, the vector is an expression vector, i.e. for the expression of the engineered receptors of the disclosure in a suitable cell.

Vectors derived from retroviruses such as the lentivirus are suitable tools to achieve long-term gene transfer since they allow long-term, stable integration of a transgene and its propagation in daughter cells. Lentiviral vectors have the added advantage over vectors derived from onco-retroviruses such as murine leukemia viruses in that they can transduce non-proliferating cells, such as hepatocytes. They also have the added advantage of low immunogenicity.

The expression of natural or synthetic nucleic acids encoding engineered receptors is typically achieved by operably linking a nucleic acid encoding the fusion protein or portions thereof to a promoter, and incorporating the construct into an expression vector. The vectors can be suitable for replication and integration eukaryotes. Typical cloning vectors contain transcription and translation terminators, initiation sequences, and promoters useful for regulation of the expression of the desired nucleic acid sequence.

The polynucleotides encoding the fusion proteins can be cloned into a number of types of vectors. For example, the polynucleotides can be cloned into a vector including, but not limited to a plasmid, a phagemid, a phage derivative, an animal virus, and a cosmid. Vectors of particular interest include expression vectors, replication vectors, probe generation vectors, and sequencing vectors.

Further, the expression vector may be provided to cells, such as immune cells, in the form of a viral vector. Viral vector technology is well known in the art and is described, for example, in Sambrook et al. (2001, Molecular Cloning: A Laboratory Manual, Cold Spring Harbor Laboratory, New York), and in other virology and molecular biology manuals. Viruses, which are useful as vectors include, but are not limited to, retroviruses, adenoviruses, adeno-associated viruses, herpes viruses, and lentiviruses. In general, a suitable vector contains an origin of replication functional in at least one organism, a promoter sequence, convenient restriction endonuclease sites, and one or more selectable markers, (e.g., WO 01/96584; WO 01/29058; and U.S. Pat. No. 6,326,193).

A number of viral based systems have been developed for gene transfer into mammalian cells. For example, retroviruses provide a convenient platform for gene delivery systems. A selected gene can be inserted into a vector and packaged in retroviral particles using techniques known in the art. The recombinant virus can then be isolated and delivered to cells of the subject either in vivo or ex vivo. A number of retroviral systems are known in the art. In some embodiments, adenovirus vectors are used. A number of adenovirus vectors are known in the art. In one embodiment, lentivirus vectors are used.

Additional promoter elements, e.g., enhancers, regulate the frequency of transcriptional initiation. Typically, these are located in the region 30-110 basepairs (bp) upstream of the start site, although a number of promoters have recently been shown to contain functional elements downstream of the start site as well. The spacing between promoter elements frequently is flexible, so that promoter function is preserved when elements are inverted or moved relative to one another. In the thymidine kinase (tk) promoter, the spacing between promoter elements can be increased to 50 bp apart before activity begins to decline. Depending on the promoter, it appears that individual elements can function either cooperatively or independently to activate transcription.

One example of a suitable promoter is the immediate early cytomegalovirus (CMV) promoter sequence. This promoter sequence is a strong constitutive promoter sequence capable of driving high levels of expression of any polynucleotide sequence operatively linked thereto. Another example of a suitable promoter is Elongation Growth Factor-1α (EF-1α). Another example of a suitable promoter is the U6 promoter. Another example of a suitable promoter is the H1 promoter. However, other constitutive promoter sequences may also be used, including, but not limited to the simian virus 40 (SV40) early promoter, mouse mammary tumor virus (MMTV), human immunodeficiency virus (HIV) long terminal repeat (LTR) promoter, MoMuLV promoter, an avian leukemia virus promoter, an Epstein-Barr virus immediate early promoter, a Rous sarcoma virus promoter, as well as human gene promoters such as, but not limited to, the actin promoter, the myosin promoter, the hemoglobin promoter, and the creatine kinase promoter. Further, the invention should not be limited to the use of constitutive promoters. Inducible promoters are also contemplated as part of the invention. The use of an inducible promoter provides a molecular switch capable of turning on expression of the polynucleotide sequence which it is operatively linked when such expression is desired, or turning off the expression when expression is not desired. Examples of inducible promoters include, but are not limited to a metallothionine promoter, a glucocorticoid promoter, a progesterone promoter, and a tetracycline promoter. An exemplary sequence of the U6 promoter is set forth in SEQ ID NO: 21800. An exemplary sequence of the H1 promoter is set forth in SEQ ID NO: 21801.

In certain aspect, a vector comprises a termination sequence, for example, a T6 or T7 termination sequence.

In order to assess the expression of an engineered receptor, the expression vector to be introduced into a cell can also contain either a selectable marker gene or a reporter gene or both to facilitate identification and selection of expressing cells from the population of cells sought to be transfected or infected through viral vectors. In other aspects, the selectable marker may be carried on a separate piece of DNA and used in a co-transfection procedure. Both selectable markers and reporter genes may be flanked with appropriate regulatory sequences to enable expression in the host cells. Useful selectable markers include, for example, antibiotic-resistance genes, such as neo and the like.

Reporter genes are used for identifying potentially transfected or transduced cells and for evaluating the functionality of regulatory sequences. In general, a reporter gene is a gene that is not present in or expressed by the recipient organism or tissue and that encodes a polypeptide whose expression is manifested by some easily detectable property, e.g., enzymatic activity. Expression of the reporter gene is assayed at a suitable time after the DNA has been introduced into the recipient cells. Suitable reporter genes may include genes encoding luciferase, beta-galactosidase, chloramphenicol acetyl transferase, secreted alkaline phosphatase, or the green fluorescent protein gene (e.g., Ui-Tei et al., 2000 FEBS Letters 479: 79-82). Suitable expression systems are well known and may be prepared using known techniques or obtained commercially. In general, the construct with the minimal 5' flanking region showing the highest level of expression of reporter gene is identified as the promoter. Such promoter regions may be linked to a reporter gene and used to evaluate agents for the ability to modulate promoter-driven transcription.

Methods of introducing and expressing genes into a cell are known in the art. In the context of an expression vector, the vector can be readily introduced into a host cell, e.g., mammalian, bacterial, yeast, or insect cell by any method in the art. For example, the expression vector can be transferred into a host cell by physical, chemical, or biological means.

Physical methods for introducing a polynucleotide into a host cell include calcium phosphate precipitation, lipofection, particle bombardment, microinjection, electroporation, and the like. Methods for producing cells comprising vectors and/or exogenous nucleic acids are well-known in the art. See, for example, Sambrook et al. (2001, Molecular Cloning: A Laboratory Manual, Cold Spring Harbor Laboratory, New York). One method for the introduction of a polynucleotide into a host cell is calcium phosphate transfection.

Biological methods for introducing a polynucleotide of interest into a host cell include the use of DNA and RNA vectors. Viral vectors, and especially retroviral vectors, have become the most widely used method for inserting genes into mammalian, e.g., human cells. Other viral vectors can be derived from lentivirus, poxviruses, herpes simplex virus I, adenoviruses and adeno-associated viruses, and the like. See, for example, U.S. Pat. Nos. 5,350,674 and 5,585,362.

Chemical means for introducing a polynucleotide into a host cell include colloidal dispersion systems, such as macromolecule complexes, nanocapsules, microspheres, beads, and lipid-based systems including oil-in-water emulsions, micelles, mixed micelles, and liposomes. An exemplary colloidal system for use as a delivery vehicle in vitro and in vivo is a liposome (e.g., an artificial membrane vesicle).

Regardless of the method used to introduce exogenous nucleic acids into a host cell or otherwise expose a cell to the inhibitor of the present invention, in order to confirm the presence of the recombinant DNA sequence in the host cell, a variety of assays may be performed. Such assays include, for example, "molecular biological" assays well known to those of skill in the art, such as Southern and Northern blotting, RT-PCR and PCR; "biochemical" assays, such as detecting the presence or absence of a particular peptide, e.g., by immunological means (ELISAs and Western blots) or by assays described herein to identify agents falling within the scope of the invention.

Immune Cells

Provided herein are immune cells comprising the polynucleotides, vectors, fusion proteins and engineered receptors described herein.

The disclosure provides an immune cell responsive to loss of heterozygosity in a cancer cell, comprising: an activator receptor comprising an extracellular ligand binding domain specific to an erb-b2 receptor tyrosine kinase 2 (HER2) antigen; and an inhibitory receptor comprising an extracellular ligand binding domain specific to a non-target antigen that is not expressed by the cancer cell due to a loss of heterozygosity in the cancer cell. In some embodiments, the non-target antigen is an HLA class I allele or a minor histocompatibility antigen (MiHA). In some embodiments, the HLA class I allele comprises HLA-A, HLA-B, HLA-C or HLA-E. In some embodiments, the non-target antigen is selected from CXCL16, COLEC12 and APCDD1, HLA-A*01, HLA-A*02, HLA-A*03, HLA-A*11, HLA-B*07, HLA-C*07, or an antigen peptide thereof. In some embodiments, the HLA class I allele is HLA-A*02. In some embodiments, the target antigen is HER2. In some embodiments, the target antigen is a peptide antigen of HER2 in a complex with a major histocompatibility class I complex (MHC I) or MHC II. In some embodiments, the cancer cell expresses HER2. In some embodiments, the cancer cell is a breast cancer cell, bladder cancer cell, ovarian cancer cell, gastric cancer cell, a salivary duct carcinoma cell, a non-small cell lung cancer cell, a pancreatic cancer cell, or a colon cancer cell. In some embodiments, the cancer cell is a breast cancer cell or gastric cancer cell.

In some embodiments, the HLA-A*02 non-target antigen is expressed by healthy cells of a subject. In some embodiments, the healthy cells of the subject express both the target antigen and the HLA-A*02 non-target antigen. In some embodiments, the activator receptor and the inhibitory receptor together specifically activate the immune cell in the presence of the cancer cell.

In some embodiments, the immune cell is a T cell. In some embodiments, the T cell is a CD8+ CD4− T cell. In some embodiments, the immune cell is autologous. In some embodiments, the immune cell is allogeneic.

As used herein, the term "immune cell" refers to a cell involved in the innate or adaptive (acquired) immune systems. Exemplary innate immune cells include phagocytic cells such as neutrophils, monocytes and macrophages, Natural Killer (NK) cells, polymorphonuclear leukocytes such as neutrophils eosinophils and basophils and mononuclear cells such as monocytes, macrophages and mast cells. Immune cells with roles in acquired immunity include lymphocytes such as T-cells and B-cells.

As used herein, a "T-cell" refers to a type of lymphocyte that originates from a bone marrow precursor that develops in the thymus gland. There are several distinct types of T-cells which develop upon migration to the thymus, which include, helper CD4+ T-cells, cytotoxic CD8+ T cells, memory T cells, regulatory CD4+ T-cells and stem memory T-cells. Different types of T-cells can be distinguished by the ordinarily skilled artisan based on their expression of markers. Methods of distinguishing between T-cell types will be readily apparent to the ordinarily skilled artisan.

In some embodiments, the engineered immune cell expresses the first and second receptors at a ratio of about 100:1 to 1:100 of first receptor to second receptor. In some embodiments, the engineered immune cell expresses the first and second receptors at a ratio of about 50:1 to 1:50 of first receptor to second receptor. In some embodiments, the engineered immune cell expresses the first and second receptors at a ratio of about 10:1 to 1:10 of first receptor to second receptor. In some embodiments, the engineered immune cell expresses the first and second receptors at a ratio of about 5:1 to 1:5 of first receptor to second receptor. In some embodiments, the engineered immune cell expresses the first and second receptors at a ratio of about 3:1 to 1:3 of first receptor to second receptor. In some embodiments, the engineered immune cell expresses the first and second receptors at a ratio of about 2:1 to 1:2 of first receptor to second receptor. In some embodiments, the engineered immune cell expresses the first and second receptors at a ratio of about 1:1.

In some embodiments, the first receptor comprises SEQ ID NO: 291, or a sequence sharing at least 75%, at least 80%, at least 85%, at least 90%, at least 95%, or at least 98% identity thereto; and the second receptor comprises SEQ ID NO: 303 or a sequence sharing at least 75%, at least 80%, at least 85%, at least 90%, at least 95%, or at least 98% identity thereto. In some embodiments, the first receptor comprises SEQ ID NO: 291, or a sequence sharing at least 75%, at least 80%, at least 85%, at least 90%, at least 95%, or at least 98% identity thereto; and the second receptor comprises SEQ ID NO: 305, or a sequence sharing at least 75%, at least 80%, at least 85%, at least 90%, at least 95%, or at least 98% identity thereto. In some embodiments, the first receptor comprises SEQ ID NO: 291, or a sequence sharing at least 75%, at least 80%, at least 85%, at least 90%, at least 95%, or at least 98% identity thereto; and the second receptor comprises SEQ ID NO: 307, or a sequence sharing at least 75%, at least 80%, at least 85%, at least 90%, at least 95%, or at least 98% identity thereto. In some embodiments, the first receptor comprises SEQ ID NO: 291, or a sequence sharing at least 75%, at least 80%, at least 85%, at least 90%, at least 95%, or at least 98% identity thereto; and the second receptor comprises SEQ ID NO: 21805, or a sequence sharing at least 75%, at least 80%, at least 85%, at least 90%, at least 95%, or at least 98% identity thereto.

In some embodiments, the first receptor comprises SEQ ID NO: 295, or a sequence sharing at least 75%, at least 80%, at least 85%, at least 90%, at least 95%, or at least 98% identity thereto; and the second receptor comprises SEQ ID NO: 303, or a sequence sharing at least 75%, at least 80%, at least 85%, at least 90%, at least 95%, or at least 98% identity thereto. In some embodiments, the first receptor comprises SEQ ID NO: 295, or a sequence sharing at least 75%, at least 80%, at least 85%, at least 90%, at least 95%, or at least 98% identity thereto; and the second receptor comprises SEQ ID NO: 305, or a sequence sharing at least 75%, at least 80%, at least 85%, at least 90%, at least 95%, or at least 98% identity thereto. In some embodiments, the first receptor comprises SEQ ID NO: 295, or a sequence sharing at least 75%, at least 80%, at least 85%, at least 90%, at least 95%, or at least 98% identity thereto; and the second receptor comprises SEQ ID NO: 307, or a sequence sharing at least 75%, at least 80%, at least 85%, at least 90%, at least 95%, or at least 98% identity thereto. In some embodiments, the first receptor comprises SEQ ID NO: 295, or a sequence sharing at least 75%, at least 80%, at least 85%, at least 90%, at least 95%, or at least 98% identity thereto; and the second receptor comprises SEQ ID NO: 21805, or a sequence sharing at least 75%, at least 80%, at least 85%, at least 90%, at least 95%, or at least 98% identity thereto.

In some embodiments, the first receptor comprises SEQ ID NO: 299, or a sequence sharing at least 75%, at least 80%, at least 85%, at least 90%, at least 95%, or at least 98% identity thereto; and the second receptor comprises SEQ ID NO: 303, or a sequence sharing at least 75%, at least 80%, at least 85%, at least 90%, at least 95%, or at least 98% identity thereto. In some embodiments, the first receptor comprises SEQ ID NO: 299, or a sequence sharing at least 75%, at least 80%, at least 85%, at least 90%, at least 95%, or at least 98% identity thereto; and the second receptor comprises SEQ ID NO: 305, or a sequence sharing at least 75%, at least 80%, at least 85%, at least 90%, at least 95%, or at least 98% identity thereto. In some embodiments, the first receptor comprises SEQ ID NO: 299, or a sequence sharing at least 75%, at least 80%, at least 85%, at least 90%, at least 95%, or at least 98% identity thereto; and the second receptor comprises SEQ ID NO: 307, or a sequence sharing at least 75%, at least 80%, at least 85%, at least 90%, at least 95%, or at least 98% identity thereto. In some embodiments, the first receptor comprises SEQ ID NO: 299, or a sequence sharing at least 75%, at least 80%, at least 85%, at least 90%, at least 95%, or at least 98% identity thereto; and the second receptor comprises SEQ ID NO: 21805, or a sequence sharing at least 75%, at least 80%, at least 85%, at least 90%, at least 95%, or at least 98% identity thereto.

In some embodiments, the immune cell further comprises a T2A self-cleaving peptide, wherein the T2A self-cleaving peptide comprises SEQ ID NO: 288 or 557, or a sequence sharing at least 75%, at least 80%, at least 85%, at least 90%, at least 95%, or at least 98% identity thereto.

In some embodiments, the engineered immune cell comprising the engineered receptors of the disclosure is a T cell. In some embodiments, the T cell is an effector T cell or a regulatory T cell. As used herein, a "T-cell" refers to a type of lymphocyte that originates from a bone marrow precursor that develops in the thymus gland. There are several distinct types of T-cells which develop upon migration to the thymus, which include, helper CD4+ T-cells, cytotoxic CD8+ T cells, memory T cells, regulatory CD4+ T-cells, NK T cells, γδ T cells, Mucosal-associated invariant T (MAIT) cells, and stem memory T-cells. Different types of T-cells can be distinguished by the ordinarily skilled artisan based on their expression of markers. Methods of distinguishing between T-cell types will be readily apparent to the ordinarily skilled artisan.

In some embodiments, the immune cell is selected form the group consisting of T cells, B cells and Natural Killer (NK) cells. In some embodiments, the immune cell is a T cell. In some embodiments, the immune cell is a B cell. In some embodiments, the immune cell is a Natural Killer (NK) cell. In some embodiments, the immune cell is CD8−. In some embodiments, the immune cell is CD8+. In some embodiments, the immune cell is CD4+. In some embodiments, the immune cell is CD4−. In some embodiments, the immune cell is CD8−/CD4+. In some embodiments, the immune cell is CD8+ CD4− T cell.

In some embodiments, the immune cell is a gamma delta (γδ) T cell. In some embodiments, the immune cell is an invariant T cell. In some embodiments, the immune cell is an invariant natural killer T cell (iNKT cell).

In some embodiments, the immune cell comprises a modification to an MHC Class I gene or a B2M gene. In some embodiments, the MHC Class I gene is HLA-A*02, or an allelic variant thereof. In some embodiments, the modification reduces or eliminates expression of the MHC Class I gene or the B2M gene.

In some embodiments, the immune cell comprises a polynucleotide or polynucleotide system described herein. In some embodiments, the polynucleotide or polynucleotide system comprises a sequence encoding a first receptor described herein. In some embodiments, the polynucleotide or polynucleotide system comprises a sequence encoding a second receptor described herein. In some embodiments, the polynucleotide or polynucleotide systems encodes an shRNA described herein. In some embodiments, the polynucleotide or polynucleotide system comprises a sequence encoding a first receptor described herein and a second receptor described herein. In some embodiments, the polynucleotide or polynucleotide system comprises a sequence encoding a first receptor described herein, a second receptor described herein, and an shRNA described herein.

Methods transforming populations of immune cells, such as T cells, with the vectors of the instant disclosure will be readily apparent to the person of ordinary skill in the art. For example, CD3+ T cells can be isolated from PBMCs using a CD3+ T cell negative isolation kit (Miltenyi), according to manufacturer's instructions. T cells can be cultured at a density of 1×10^6 cells/mL in X-Vivo 15 media supplemented with 5% human A/B serum and 1% Pen/strep in the presence of CD3/28 Dynabeads (1:1 cell to bead ratio) and 300 Units/mL of IL-2 (Miltenyi). After 2 days, T cells can be transduced with viral vectors, such as lentiviral vectors using methods known in the art. In some embodiments, the viral vector is transduced at a multiplicity of infection (MOI) of 5. Cells can then be cultured in IL-2 or other cytokines such as combinations of IL-7/15/21 for an additional 5 days prior to enrichment. Methods of isolating and culturing other populations of immune cells, such as B cells, or other populations of T cells, will be readily apparent to the person of ordinary skill in the art. Although this method outlines a potential approach it should be noted that these methodologies are rapidly evolving. For example excellent viral transduction of peripheral blood mononuclear cells can be achieved after 5 days of growth to generate a >99% CD3+ highly transduced cell population.

Methods of activating and culturing populations of T cells comprising the engineered TCRs, CARs, fusion proteins or vectors encoding the fusion proteins of the instant disclosure, will be readily apparent to the person of ordinary skill in the art.

Whether prior to or after genetic modification of T cells to express an engineered TCR, the T cells can be activated and expanded generally using methods as described, for example, in U.S. Pat. Nos. 6,352,694; 6,534,055; 6,905,680; 6,692,964; 5,858,358; 6,887,466; 6,905,681; 7,144,575; 7,067,318; 7,172,869; 7,232,566; 7,175,843; 5,883,223; 6,905,874; 6,797,514; 6,867,041, 10,040,846; and U.S. Pat. Appl. Pub. No. 2006/0121005.

In some embodiments, T cells of the instant disclosure are expanded and activated in vitro. Generally, the T cells of the instant disclosure are expanded in vitro by contact with a surface having attached thereto an agent that stimulates a CD3/TCR complex associated signal and a ligand that stimulates a co-stimulatory molecule on the surface of the T cells. In particular, T cell populations may be stimulated as described herein, such as by contact with an anti-CD3 antibody. For co-stimulation of an accessory molecule on the surface of the T cells, a ligand that binds the accessory molecule is used. For example, a population of T cells can be contacted with an anti-CD3 antibody and an anti-CD28 antibody, under conditions appropriate for stimulating proliferation of the T cells. To stimulate proliferation of either CD4+ T cells or CD8+ T cells, an anti-CD3 antibody and an anti-CD28 antibody can be used. Examples of an anti-CD28 antibody include 9.3, B-T3, XR-CD28 (Diaclone, Besançon, France) can be used as can other methods commonly known in the art (Berg et al., Transplant Proc. 30(8):3975-3977, 1998; Haanen et al., J. Exp. Med. 190(9):13191328, 1999; Garland et al., J. Immunol Meth. 227(1-2):53-63, 1999).

In some embodiments, the primary stimulatory signal and the co-stimulatory signal for the T cell may be provided by different protocols. For example, the agents providing each signal may be in solution or coupled to a surface. When coupled to a surface, the agents may be coupled to the same surface (i.e., in "cis" formation) or to separate surfaces (i.e., in "trans" formation). Alternatively, one agent may be coupled to a surface and the other agent in solution. In some embodiments, the agent providing the co-stimulatory signal is bound to a cell surface and the agent providing the primary activation signal is in solution or coupled to a surface. In certain embodiments, both agents can be in solution. In another embodiment, the agents may be in soluble form, and then cross-linked to a surface, such as a cell expressing Fc receptors or an antibody or other binding agent which will bind to the agents. In this regard, see for example, U.S. Patent Application Publication Nos. 20040101519 and 20060034810 for artificial antigen presenting cells (aAPCs) that are contemplated for use in activating and expanding T cells in the present invention.

In some embodiments, the two agents are immobilized on beads, either on the same bead, i.e., "cis," or to separate beads, i.e., "trans." By way of example, the agent providing the primary activation signal is an anti-CD3 antibody or an antigen-binding fragment thereof and the agent providing the co-stimulatory signal is an anti-CD28 antibody or antigen-binding fragment thereof; and both agents are co-immobilized to the same bead in equivalent molecular amounts. In one embodiment, a 1:1 ratio of each antibody bound to the beads for CD4+ T cell expansion and T cell growth is used. In some embodiments, the ratio of CD3:CD28 antibody bound to the beads ranges from 100:1 to 1:100 and all integer values there between. In one aspect of the present invention, more anti-CD28 antibody is bound to the particles than anti-CD3 antibody, i.e., the ratio of CD3:CD28 is less than one. In certain embodiments of the invention, the ratio of anti CD28 antibody to anti CD3 antibody bound to the beads is greater than 2:1.

Ratios of particles to cells from 1:500 to 500:1 and any integer values in between may be used to stimulate T cells or other target cells. As those of ordinary skill in the art can readily appreciate, the ratio of particles to cells may depend on particle size relative to the target cell. For example, small sized beads could only bind a few cells, while larger beads could bind many. In certain embodiments the ratio of cells to particles ranges from 1:100 to 100:1 and any integer values in-between and in further embodiments the ratio comprises 1:9 to 9:1 and any integer values in between, can also be used to stimulate T cells. In some embodiments, a ratio of 1:1 cells to beads is used. One of skill in the art will appreciate that a variety of other ratios may be suitable for use in the present invention. In particular, ratios will vary depending on particle size and on cell size and type.

In further embodiments of the present invention, the cells, such as T cells, are combined with agent-coated beads, the beads and the cells are subsequently separated, and then the cells are cultured. In an alternative embodiment, prior to culture, the agent-coated beads and cells are not separated but are cultured together. In a further embodiment, the beads and cells are first concentrated by application of a force, such as a magnetic force, resulting in increased ligation of cell surface markers, thereby inducing cell stimulation.

By way of example, cell surface proteins may be ligated by allowing paramagnetic beads to which anti-CD3 and anti-CD28 are attached to contact the T cells. In one embodiment the cells (for example, CD4+ T cells) and beads (for example, DYNABEADS CD3/CD28 T paramagnetic beads at a ratio of 1:1) are combined in a buffer. Again, those of ordinary skill in the art can readily appreciate any cell concentration may be used. In certain embodiments, it may be desirable to significantly decrease the volume in which particles and cells are mixed together (i.e., increase the concentration of cells), to ensure maximum contact of cells and particles. For example, in one embodiment, a concentration of about 2 billion cells/ml is used. In another embodiment, greater than 100 million cells/ml is used. In a further embodiment, a concentration of cells of 10, 15, 20, 25, 30, 35, 40, 45, or 50 million cells/ml is used. In yet another embodiment, a concentration of cells from 75, 80, 85, 90, 95, or 100 million cells/ml is used. In further embodiments, concentrations of 125 or 150 million cells/ml can be used. In some embodiments, cells that are cultured at a density of 1×106 cells/mL are used.

In some embodiments, the mixture may be cultured for several hours (about 3 hours) to about 14 days or any hourly integer value in between. In another embodiment, the beads and T cells are cultured together for 2-3 days. Conditions appropriate for T cell culture include an appropriate media (e.g., Minimal Essential Media or RPMI Media 1640 or, X-vivo 15, (Lonza)) that may contain factors necessary for proliferation and viability, including serum (e.g., fetal bovine or human serum), interleukin-2 (IL-2), insulin, IFN-γ, IL-4, IL-7, GM-CSF, IL-10, IL-12, IL-15, TGFβ, and TNF-α or any other additives for the growth of cells known to the skilled artisan. Other additives for the growth of cells include, but are not limited to, surfactant, plasmanate, and reducing agents such as N-acetyl-cysteine and 2-mercaptoethanol. Media can include RPMI 1640, AIM-V, DMEM, MEM, α-MEM, F-12, X-Vivo 15, and X-Vivo 20, Optimizer, with added amino acids, sodium pyruvate, and vitamins, either serum-free or supplemented with an appropriate amount of serum (or plasma) or a defined set of hormones, and/or an amount of cytokine(s) sufficient for the growth and expansion of T cells. In some embodiments, the media comprises X-VIVO-15 media supplemented with 5% human A/B serum, 1% penicillin/streptomycin (pen/strep) and 300 Units/ml of IL-2 (Miltenyi).

The T cells are maintained under conditions necessary to support growth, for example, an appropriate temperature (e.g., 37° C.) and atmosphere (e.g., air plus 5% CO2).

In some embodiments, the T cells comprising engineered TCRs, CARs, and/or inhibitory receptors of the disclosure are autologous. Prior to expansion and genetic modification, a source of T cells is obtained from a subject. Immune cells such as T cells can be obtained from a number of sources, including peripheral blood mononuclear cells, bone marrow, lymph node tissue, cord blood, thymus tissue, tissue from a site of infection, ascites, pleural effusion, spleen tissue, and tumors. In certain embodiments of the present invention, any number of T cell lines available in the art, may be used. In certain embodiments of the present invention, T cells can be obtained from a unit of blood collected from a subject using any number of techniques known to the skilled artisan, such as Ficoll™ separation.

In some embodiments, cells from the circulating blood of an individual are obtained by apheresis. The apheresis product typically contains lymphocytes, including T cells, monocytes, granulocytes, B cells, other nucleated white blood cells, red blood cells, and platelets. In some embodiments, the cells collected by apheresis may be washed to remove the plasma fraction and to place the cells in an appropriate buffer or media for subsequent processing steps. In some embodiments, the cells are washed with phosphate buffered saline (PBS). In alternative embodiments, the wash solution lacks calcium and may lack magnesium or may lack many if not all divalent cations. As those of ordinary skill in the art would readily appreciate a washing step may be accomplished by methods known to those in the art, such as by using a semi-automated "flow-through" centrifuge (for example, the Cobe 2991 cell processor, the Baxter Cyto-Mate, or the Haemonetics Cell Saver 5) according to the manufacturer's instructions. After washing, the cells may be resuspended in a variety of biocompatible buffers, such as, for example, Ca2+-free, Mg2+-free PBS, PlasmaLyte A, or other saline solution with or without buffer. Alternatively, the undesirable components of the apheresis sample may be removed and the cells directly resuspended in culture media.

In some embodiments, immune cells such as T cells are isolated from peripheral blood lymphocytes by lysing the red blood cells and depleting the monocytes, for example, by centrifugation through a PERCOLL™ gradient or by counterflow centrifugal elutriation. Specific subpopulations of immune cells, such as T cells, B cells, or CD4+ T cells can be further isolated by positive or negative selection techniques. For example, in one embodiment, T cells are isolated by incubation with anti-CD4-conjugated beads, for a time period sufficient for positive selection of the desired T cells.

Enrichment of an immune cell population, such as a T cell population, by negative selection can be accomplished with a combination of antibodies directed to surface markers unique to the negatively selected cells. One method is cell sorting and/or selection via negative magnetic immune-adherence or flow cytometry that uses a cocktail of monoclonal antibodies directed to cell surface markers present on the cells negatively selected. For example, to enrich for CD4+ cells by negative selection, a monoclonal antibody cocktail typically includes antibodies to CD 14, CD20, CD 11b, CD 16, HLA-DR, and CD8.

For isolation of a desired population of immune cells by positive or negative selection, the concentration of cells and surface (e.g., particles such as beads) can be varied. In certain embodiments, it may be desirable to significantly decrease the volume in which beads and cells are mixed together (i.e., increase the concentration of cells), to ensure maximum contact of cells and beads.

In some embodiments, the cells may be incubated on a rotator for varying lengths of time at varying speeds at either 2-10° C. or at room temperature.

T cells for stimulation, or PBMCs from which immune cells such as T cells are isolated, can also be frozen after a washing step. Wishing not to be bound by theory, the freeze and subsequent thaw step provides a more uniform product by removing granulocytes and to some extent monocytes in the cell population. After the washing step that removes plasma and platelets, the cells may be suspended in a freezing solution. While many freezing solutions and parameters are known in the art and will be useful in this context, one method involves using PBS containing 20% DMSO and 8% human serum albumin, or culture media containing 10% Dextran 40 and 5% Dextrose, 20% Human Serum Albumin and 7.5% DMSO, or 31.25% Plasmalyte-A, 31.25% Dextrose 5%, 0.45% NaCl, 10% Dextran 40 and 5% Dextrose, 20% Human Serum Albumin, and 7.5% DMSO or other suitable cell freezing media containing for example, Hespan and PlasmaLyte A, the cells then are frozen to −80° C. at a rate of 1° per minute and stored in the vapor phase of a liquid nitrogen storage tank. Other methods of controlled freezing may be used as well as uncontrolled freezing immediately at −20° C. or in liquid nitrogen.

The disclosure provides an immune cell expressing the activator and/or inhibitory receptors described herein, wherein the immune cell has reduced expression and/or function the major histocompatibility (MHC) class I complex.

In some embodiments, the immune cell is autologous. For example, the immune cells is isolated or derived from same subject who will receive the cell as part of a therapeutic regimen. It can be advantageous to modify autologous immune cells to have reduced expression and/or function of MHC class I with the inhibitory receptor is specific to an MHC class I antigen. Without wishing to be bound by theory, modification of autologous immune cells to have reduced expression and/or function of MHC class I reduces binding of the inhibitory receptor by MHC class I expressed by the immune cells, either in cis or in trans.

In some embodiments, the immune cell is all allogeneic. Allogeneic immune cells can be derived from a donor other than the subject to which the immune cells will be administered. Allogeneic immune cells have been commonly referred to in cell therapy as "off-the-shelf" or "universal" because of the possibility for allogeneic cells to be prepared and stored for use in subjects of a variety of genotypes.

Any suitable methods of reducing expression and/or function the MHC class I complex are envisaged as within the scope of the instant disclosure, and include, inter alia, expression of interfering RNAs that knock down one or more RNAs encoding MHC class I components, or modifications of genes encoding MHC class I components.

The major histocompatibility complex (MHC) is a locus on the vertebrate genome that encodes a set of polypeptides required for the adaptive immune system. Among these are MHC class I polypeptides that include HLA-A, HLA-B, and HLA-C and alleles thereof. MHC class I alleles are highly polymorphic and expressed in all nucleated cells. MHC class I polypeptides encoded by HLA-A, HLA-B, and HLA-C and alleles thereof form heterodimers with (32 microglobulin (B2M) and present in complex with antigens on the surface of cells. As referred to herein, an MHC class I gene or polypeptide may refer to any polypeptide found in the MHC or the corresponding gene encoding said polypeptide. In some embodiments, the immune cells of the disclosure are inactivated by an inhibitor ligand comprising an MHC class I polypeptide, e.g. HLA-A, HLA-B, and HLA-C and alleles thereof. HLA-A alleles can be, for example and without limitation, HLA-A*02, HLA-A*02:01, HLA-A*02:01:01, HLA-A*02:01:01:01, and/or any gene that encodes protein identical or similar to HLA-A*02 protein. Thus, to prevent autocrine signaling/binding as described herein, it is desirable to eliminate or reduce expression of polypeptides encoded by HLA-A, HLA-B, and HLA-C and alleles thereof in the immune cells.

Immune Cells with Reduced MHC Class I Polypeptide Expression

In some embodiments, the immune cells described herein are modified to inactivate, or reduce or eliminate expression or function of an endogenous gene encoding an allele of an endogenous MHC class I polypeptide. In some embodiments, the gene encoding the MHC class I polypeptide is HLA-A, HLA-B, and/or HLA-C. HLA-A, HLA-B and HLA-C are encoded by the HLA-A, HLA-B and HLA-C loci. Each of HLA-A, HLA-B and HLA-C includes many variant alleles, all of which are envisaged as within the scope of the instant disclosure. In some embodiments, the gene encoding the MHC class I polypeptide is HLA-A. In some embodiments, the gene encoding the MHC class I polypeptide is HLA-A*02. In some embodiments, the gene encoding the MHC class I polypeptide is HLA-A*02:01. In some embodiments, the gene encoding the MHC class I polypeptide is HLA-A*02:01:01. In some embodiments, the gene encoding the MHC class I polypeptide is HLA-A*02:01:01:01.

In some embodiments, the genetically engineered immune cells described herein are modified to reduce or eliminate expression of the B2M gene product. The beta-2 microglobulin (B2M) gene encodes a protein that associates with the major histocompatibility complex (MHC) class I, i.e. MHC-I complex. The MHC-I complex is required for presentation of antigens on the cell surface. The MHC-I complex is disrupted and non-functional when the B2M is deleted (Wang D et al. Stem Cells Transl Med. 4:1234-1245 (2015)). Furthermore, the B2M gene can be disrupted with high efficiency using gene editing techniques known in the art (Ren et al. Clin. Cancer Res. 23:2255-2266 (2017)). Reducing or eliminating B2M can reduce, or eliminate functional MHC I on the surface of the immune cell.

The disclosure provides gene editing systems for editing an endogenous target gene in an immune cell. The disclosure provides interfering RNAs specific to sequences of target genes. Gene editing systems such as CRISPR/Cas systems, TALENs and zinc fingers can be used to generate double strand breaks, which, through gene repair mechanisms such as homology directed repair or non-homologous end joining (NHEJ), can be used to introduce mutations. NHEJ after resection of the ends of the break, or improper end joining, can be used to introduce deletions. In some embodiments, the target gene comprises a gene encoding a subunit of the MHC-I complex.

Target gene sequences include, but are not limited to, promoters, enhancers, introns, exons, intron/exon junctions, transcription products (pre-mRNA, mRNA, and splice variants), and/or 3' and 5' untranslated regions (UTRs). Any gene element or combination of gene elements may be targeted for the purpose of genetic editing in the immune cells described herein. Modifications to the target genes can be accomplished using any method known in the art to edit the target gene that results in altered or disrupted expression or function the target gene or gene product.

In some embodiments, modifying the gene encoding the MHC class I polypeptide comprises deleting all or a portion of the gene. In some embodiments, modifying the gene encoding the MHC class I polypeptide comprises introducing a mutation in the gene. In some embodiments, the mutation comprises a deletion, insertion, substitution, or frameshift mutation. In some embodiments, modifying the gene comprises using a nucleic acid guided endonuclease.

Gene sequences for the target genes described herein are known in the art. The sequences can be found at public databases, such as NCBI GenBank or the NCBI nucleotide database. Sequences may be found using gene identifiers, for example, the HLA-A gene has NCBI Gene ID: 3105, the HLA-B gene has NCBI Gene ID: 3106, the HLA-C gene has NCBI Gene ID: 3107, and the B2M gene has NCBI Gene ID: 567 and NCBI Reference Sequence: NC_000015.10. Gene sequences may also be found by searching public databases using keywords. For example, HLA-A alleles may be found in the NCBI nucleotide database by searching keywords, "HLA-A*02", "HLA-A*02:01", "HLA-A*02:01:01", or "HLA-A*02:01:01:01." These sequences can be used for targeting in various gene editing techniques known in the art. Table 18 provides non-limiting illustrative sequences of HLA-A allele and B2M gene sequences targeted for modification as described herein.

TABLE 18

Exemplary Target Gene Sequences

| Target | Sequence |
|---|---|
| B2M mRNA | AUUCCUGAAGCUGACAGCAUUCGGGCCGAGAUGUCUCGCUCCGUGG<br>CCUUAGCUGUGCUCGCGCUACUCUCUCUUUCUGGCCUGGAGGCUAU<br>CCAGCGUACUCCAAAGAUUCAGGUUUACUCACGUCAUCCAGCAGAG<br>AAUGGAAAGUCAAAUUUCCUGAAUUGCUAUGUGUCUGGGUUUCAUC<br>CAUCCGACAUUGAAGUUGACUUACUGAAGAAUGGAGAGAGAAUUGA<br>AAAAGUGGAGCAUUCAGACUUGUCUUUCAGCAAGGACUGGUCUUUC<br>UAUCUCUUGUACUACACUGAAUUCACCCCCACUGAAAAAGAUGAGU<br>AUGCCUGCCGUGUGAACCAUGUGACUUUGUCACAGCCCAAGAUAGU<br>UAAGUGGGAUCGAGACAUGUAAGCAGCAUCAUGGAGGUUUGAAGAU<br>GCCGCAUUUGGAUUGGAUGAAUUCCAAAUUCUGCUUGCUUGCUUUU<br>UAAUAUUGAUAUGCUUAUACACUUACACUUUAUGCACAAAAUGUAG<br>GGUUAUAAUAAUGUUAACAUGGACAUGAUCUUCUUUAUAAUUCUAC<br>UUUGAGUGCUGUCUCCAUGUUUGAUGUAUCUGAGCAGGUUGCUCCA<br>CAGGUAGCUCUAGGAGGGCUGGCAACUUAGAGGUGGGGAGCAGAGA<br>AUUCUCUUAUCCAACAUCAACAUCUUGGUCAGAUUUGAACUCUUCA<br>AUCUCUUGCACUCAAAGCUUGUUAAGAUAGUUAAGCGUGCAUAAGU<br>UAACUUCCAAUUUACAUACUCUGCUUAGAAUUUGGGGGAAAAUUUA<br>GAAAUAUAAUUGACAGGAUUAUUGGAAAUUUGUUAUAAUGAAUGAA<br>ACAUUUUGUCAUAUAAGAUUCAUAUUUACUUCUUAUACAUUUGAUA<br>AAGUAAGGCAUGGUUGUGGUUAAUCUGGUUUAUUUUUGUUCCACAA<br>GUUAAAUAAAUCAUAAAACUUGA (SEQ ID NO: 571) |
| B2M Gene<br>(GenBank: 567) | AAGTGGAGGCGTCGCGCTGGCGGGCATTCCTGAAGCTGACAGCATT<br>CGGGCCGAGATGTCTCGCTCCGTGGCCTTAGCTGTGCTCGCGCTAC<br>TCTCTCTTTCTGGCCTGGAGGCTATCCAGCGTGAGTCTCTCCTACC<br>CTCCCGCTCTGGTCCTTCCTCTCCCGCTCTGCACCCTCTGTGGCCC<br>TCGCTGTGCTCTCTCGCTCCGTGACTTCCCTTCTCCAAGTTCTCCT<br>TGGTGGCCCGCCGTGGGGCTAGTCCAGGGCTGGATCTCGGGGAAGC<br>GGCGGGGTGGCCTGGGAGTGGGGAAGGGGGTGCGCACCCGGGACGC |

TABLE 18-continued

Exemplary Target Gene Sequences

| Target | Sequence |
|---|---|
| | GCGCTACTTGCCCCTTTCGGCGGGGAGCAGGGGAGACCTTTGGCCT |
| | ACGGCGACGGGAGGGTCGGGACAAAGTTTAGGGCGTCGATAAGCGT |
| | CAGAGCGCCGAGGTTGGGGGAGGGTTTCTCTTCCGCTCTTTCGCGG |
| | GGCCTCTGGCTCCCCCAGCGCAGCTGGAGTGGGGGACGGGTAGGCT |
| | CGTCCCAAAGGCGCGGCGCTGAGGTTTGTGAACGCGTGGAGGGGCG |
| | CTTGGGGTCTGGGGGAGGCGTCGCCCGGGTAAGCCTGTCTGCTGCG |
| | GCTCTGCTTCCCTTAGACTGGAGAGCTGTGGACTTCGTCTAGGCGC |
| | CCGCTAAGTTCGCATGTCCTAGCACCTCTGGGTCTATGTGGGGCCA |
| | CACCGTGGGGAGGAAACAGCACGCGACGTTTGTAGAATGCTTGGCT |
| | GTGATACAAAGCGGTTTCGAATAATTAACTTATTTGTTCCCATCAC |
| | ATGTCACTTTTAAAAAATTATAAGAACTACCCGTTATTGACATCTT |
| | TCTGTGTGCCAAGGACTTTATGTGCTTTGCGTCATTTAATTTTGAA |
| | AACAGTTATCTTCCGCCATAGATAACTACTATGGTTATCTTCTGCC |
| | TCTCACAGATGAAGAAACTAAGGCACCGAGATTTTAAGAAACTTAA |
| | TTACACAGGGGATAAATGGCAGCAATCGAGATTGAAGTCAAGCCTA |
| | ACCAGGGCTTTTGCGGGAGCGCATGCCTTTTGGCTGTAATTCGTGC |
| | ATTTTTTTTTAAGAAAAACGCCTGCCTTCTGCGTGAGATTCTCCAG |
| | AGCAAACTGGGCGGCATGGGCCCTGTGGTCTTTTCGTACAGAGGGC |
| | TTCCTCTTTGGCTCTTTGCCTGGTTGTTTCCAAGATGTACTGTGCC |
| | TCTTACTTTCGGTTTTGAAAACATGAGGGGGTTGGGCGTGGTAGCT |
| | TACGCCTGTAATCCCAGCACTTAGGGAGGCCGAGGCGGGAGGATGG |
| | CTTGAGGTCCGTAGTTGAGACCAGCCTGGCCAACATGGTGAAGCCT |
| | GGTCTCTACAAAAAATAATAACAAAAATTAGCCGGGTGTGGTGGCT |
| | CGTGCCTGTGGTCCCAGCTGCTCCGGTGGCTGAGGCGGGAGGATCT |
| | CTTGAGCTTAGGCTTTTGAGCTATCATGGCGCCAGTGCACTCCAGC |
| | GTGGGCAACAGAGCGAGACCCTGTCTCTCAAAAAAGAAAAAAAAAA |
| | AAAAGAAAGAGAAAGAAAAGAAAGAAAGAAGTGAAGGTTTGTCA |
| | GTCAGGGGAGCTGTAAAACCATTAATAAAGATAATCCAAGATGGTT |
| | ACCAAGACTGTTGAGGACGCCAGAGATCTTGAGCACTTTCTAAGTA |
| | CCTGGCAATACACTAAGCGCGCTCACCTTTTCCTCTGGCAAAACAT |
| | GATCGAAAGCAGAATGTTTGATCATGAGAAAATTGCATTTAATTT |
| | GAATACAATTTATTTACAACATAAAGGATAATGTATATATCACCAC |
| | CATTACTGGTATTTGCTGGTTATGTTAGATGTCATTTTAAAAAATA |
| | ACAATCTGATATTTAAAAAAAAATCTTATTTTGAAAATTTCCAAAG |
| | TAATACATGCCATGCATAGACCATTTCTGGAAGATACCACAAGAAA |
| | CATGTAATGATGATTGCCTCTGAAGGTCTATTTTCCTCCTCTGACC |
| | TGTGTGTGGGTTTTGTTTTTGTTTTACTGTGGGCATAAATTAATTT |
| | TTCAGTTAAGTTTTGGAAGCTTAAATAACTCTCCAAAAGTCATAAA |
| | GCCAGTAACTGGTTGAGCCCAAATTCAAACCCAGCCTGTCTGATAC |
| | TTGTCCTCTTCTTAGAAAAGATTACAGTGATGCTCTCACAAAATCT |
| | TGCCGCCTTCCCTCAAACAGAGAGTTCCAGGCAGGATGAATCTGTG |
| | CTCTGATCCCTGAGGCATTTAATATGTTCTTATTATTAGAAGCTCA |
| | GATGCAAAGAGCTCTCTTAGCTTTTAATGTTATGAAAAAAATCAGG |
| | TCTTCATTAGATTCCCCAATCCACCTCTTGATGGGGCTAGTAGCCT |
| | TTCCTTAATGATAGGGTGTTTCTAGAGAGATATATCTGGTCAAGGT |
| | GGCCTGGTACTCCTCCTTCTCCCCACAGCCTCCCAGACAAGGAGGA |
| | GTAGCTGCCTTTTAGTGATCATGTACCCTGAATATAAGTGTATTTA |
| | AAAGAATTTTATACACATATATTTAGTGTCAATCTGTATATTTAGT |
| | AGCACTAACACTTCTCTTCATTTTCAATGAAAAATATAGAGTTTAT |
| | AATATTTTCTTCCCACTTCCCCATGGATGGTCTAGTCATGCCTCTC |
| | ATTTTGGAAAGTACTGTTTCTGAAACATTAGGCAATATATTCCCAA |
| | CCTGGCTAGTTTACAGCAATCACCTGTGGATGCTAATTAAAACGCA |
| | AATCCCACTGTCACATGCATTACTCCATTTGATCATAATGGAAAGT |
| | ATGTTCTGTCCCATTTGCCATAGTCCTCACCTATCCCTGTTGTATT |
| | TTATCGGGTCCAACTCAACCATTTAAGGTATTTGCCAGCTCTTGTA |
| | TGCATTTAGGTTTTGTTTCTTTGTTTTTTAGCTCATGAAATTAGGT |
| | ACAAAGTCAGAGAGGGGTCTGGCATATAAAACCTCAGCAGAAATAA |
| | AGAGGTTTTGTTGTTTGGTAAGAACATACCTTGGGTTGGTTGGGCA |
| | CGGTGGCTCGTGCCTGTAATCCCAACACTTTGGGAGGCCAAGGCAG |
| | GCTGATCACTTGAAGTTGGGAGTTCAAGACCAGCCTGGCCAACATG |
| | GTGAAATCCCGTCTCTACTGAAAATACAAAAATTAACCAGGCATGG |
| | TGGTGTGTGCCTGTAGTCCCAGGAATCACTTGAACCCAGGAGGCGG |
| | AGGTTGCAGTGAGCTGAGATCTCACCACTGCACTCCAGC |
| | CTGGGCAATGGAATGAGATTCCATCCCAAAAAATAAAAAAATAAAA |
| | AAATAAAGAACATACCTTGGGTTGATCCACTTAGGAACCTCAGATA |
| | ATAACATCTGCCACGTATAGAGCAATTGCTATGTCCCAGGCACTCT |
| | ACTAGACACTTCATACAGTTTAGAAAATCAGATGGGTGTAGATCAA |
| | GGCAGGAGCAGGAACCAAAAAGAAAGGCATAAACATAAGAAAAAAA |
| | ATGGAAGGGGTGGAAACAGAGTACAATAACATGAGTAATTTGATGG |
| | GGGCTATTATGAACTGAGAAATGAACTTTGAAAAGTATCTTGGGGC |
| | CAAATCATGTAGACTCTTGAGTGATGTGTTAAGGAATGCTATGAGT |
| | GCTGAGAGGGCATCAGAAGTCCTTGAGAGCCTCCAGAGAAAGGCTC |
| | TTAAAAATGCAGCGCAATCTCCAGTGACAGAAGATACTGCTAGAAA |
| | TCTGCTAGAAAAAAAACAAAAAAGGCATGTATAGAGGAATTATGAG |
| | GGAAAGATACCAAGTCACGGTTTATTCTTCAAAATGGAGGTGGCTT |
| | GTTGGGAAGGTGGAAGCTCATTTGGCCAGAGTGGAAATGGAATTGG |

TABLE 18-continued

Exemplary Target Gene Sequences

| Target | Sequence |
|---|---|
| | GAGAAATCGATGACCAAATGTAAACACTTGGTGCCTGATATAGCTT<br>GACACCAAGTTAGCCCCAAGTGAAATACCCTGGCAATATTAATGTG<br>TCTTTTCCCGATATTCCTCAGGTACTCCAAAGATTCAGGTTTACTC<br>ACGTCATCCAGCAGAGAATGGAAAGTCAAATTTCCTGAATTGCTAT<br>GTGTCTGGGTTTCATCCATCCGACATTGAAGTTGACTTACTGAAGA<br>ATGGAGAGAGAATTGAAAAAGTGGAGCATTCAGACTTGTCTTTCAG<br>CAAGGACTGGTCTTTCTATCTCTTGTACTACACTGAATTCACCCCC<br>ACTGAAAAAGATGAGTATGCCTGCCGTGTGAACCATGTGACTTTGT<br>CACAGCCCAAGATAGTTAAGTGGGGTAAGTCTTACATTCTTTTGTA<br>AGCTGCTGAAAGTTGTGTATGAGTAGTCATATCATAAAGCTGCTTT<br>GATATAAAAAGGTCTATGGCCATACTACCCTGAATGAGTCCCATC<br>CCATCTGATATAAACAATCTGCATATTGGGATTGTCAGGGAATGTT<br>CTTAAAGATCAGATTAGTGGCACCTGCTGAGATACTGATGCACAGC<br>ATGGTTTCTGAACCAGTAGTTTCCCTGCAGTTGAGCAGGGAGCAGC<br>AGCAGCACTTGCACAAATACATATACACTCTTAACACTTCTTACCT<br>ACTGGCTTCCTCTAGCTTTTGTGGCAGCTTCAGGTATATTTAGCAC<br>TGAACGAACATCTCAAGAAGGTATAGGCCTTTGTTTGTAAGTCCTG<br>CTGTCCTAGCATCCTATAATCCTGGACTTCTCCAGTACTTTCTGGC<br>TGGATTGGTATCTGAGGCTAGTAGGAAGGGCTTGTTCCTGCTGGGT<br>AGCTCTAAACAATGTATTCATGGGTAGGAACAGCAGCCTATTCTGC<br>CAGCCTTATTTCTAACCATTTTAGACATTTGTTAGTACATGGTATT<br>TTAAAAGTAAAACTTAATGTCTTCCTTTTTTTTCTCCACTGTCTTT<br>TTCATAGATCGAGACATGTAAGCAGCATCATGGAGGTAAGTTTTTG<br>ACCTTGAGAAAATGTTTTTGTTTCACTGTCCTGAGGACTATTTATA<br>GACAGCTCTAACATGATAACCCTCACTATGTGGAGAACATTGACAG<br>AGTAACATTTTAGCAGGGAAAGAAGAATCCTACAGGGTCATGTTCC<br>CTTCTCCTGTGGAGTGGCATGAAGAAGGTGTATGGCCCCAGGTATG<br>GCCATATTACTGACCCTCTACAGAGAGGGCAAAGGAACTGCCAGTA<br>TGGTATTGCAGGATAAAGGCAGGTGGTTACCCACATTACCTGCAAG<br>GCTTTGATCTTTCTTCTGCCATTTCCACATTGGACATCTCTGCTGA<br>GGAGAGAAAATGAACCACTCTTTTCCTTTGTATAATGTTGTTTTAT<br>TCTTCAGACAGAAGAGAGGAGTTATACAGCTCTGCAGACATCCCAT<br>TCCTGTATGGGACTGTGTTTGCCTCTTAGAGGTTCCCAGGCCACT<br>AGAGGAGATAAAGGGAAACAGATTGTTATAACTTGATATAATGATA<br>CTATAATAGATGTAACTACAAGGAGCTCCAGAAGCAAGAGAGAGGG<br>AGGAACTTGGACTTCTCTGCATCTTTAGTTGGAGTCCAAAGGCTTT<br>TCAATGAAATTCTACTGCCCAGGGTACATTGATGCTGAAACCCCAT<br>TCAAATCTCCTGTTATATTCTAGAACAGGGAATTGATTTGGGAGAG<br>CATCAGGAAGGTGGATGATCTGCCCAGTCACACTGTTAGTAAATTG<br>TAGAGCCAGGACCTGAACTCTAATATAGTCATGTGTTACTTAATGA<br>CGGGGACATGTTCTGAGAAATGCTTACACAAACCTAGGTGTTGTAG<br>CCTACTACACGCATAGGCTACATGGTATAGCCTATTGCTCCTAGAC<br>TACAAACCTGTACAGCCTGTTACTGTACTGAATACTGTGGGCAGTT<br>GTAACACAATGGTAAGTATTTGTGTATCTAAACATAGAAGTTGCAG<br>TAAAAATATGCTATTTTAATCTTATGAGACCACTGTCATATATACA<br>GTCCATCATTGACCAAAACATCATATCAGCATTTTTTCTTCTAAGA<br>TTTTGGGAGCACCAAAGGGATACACTAACAGGATATACTCTTTATA<br>ATGGGTTTGGAGAACTGTCTGCAGCTACTTCTTTTAAAAAGGTGAT<br>CTACACAGTAGAAATTAGACAAGTTTGGTAATGAGATCTGCAATCC<br>AAATAAAATAAATTCATTGCTAACCTTTTTCTTTTCTTTTCAGGTT<br>TGAAGATGCCGCATTTGGATTGGATGAATTCCAAATTCTGCTTGCT<br>TGCTTTTTAATATTGATATGCTTATACACTTACACTTTATGCACAA<br>AATGTAGGGTTATAATAATGTTAACATGGACATGATCTTCTTTATA<br>ATTCTACTTTGAGTGCTGTCTCCATGTTTGATGTATCTGAGCAGGT<br>TGCTCCACAGGTAGCTCTAGGAGGGCTGGCAACTTAGAGGTGGGGA<br>GCAGAGAATTCTCTTATCCAACATCAACATCTTGGTCAGATTTGAA<br>CTCTTCAATCTCTTGCACTCAAAGCTTGTTAAGATAGTTAAGCGTG<br>CATAAGTTAACTTCCAATTTACATACTCTGCTTAGAATTTGGGGGA<br>AAATTTAGAAATATAATTGACAGGATTATTGGAAATTTGTTATAAT<br>GAATGAAACATTTTGTCATATAAGATTCATATTTACTTCTTATACA<br>TTTGATAAAGTAAGGCATGGTTGTGGTTAATCTGGTTTATTTTTGT<br>TCCACAAGTTAAATAAATCATAAAACTTGA (SEQ ID NO: 572) |
| HLA-<br>A*02:01:01:01<br>sequence<br>encoding mRNA | CAGAAGCAGAGGGGTCAGGGCGAAGTCCCAGGGCCCCAGGCGTGGC<br>TCTCAGGGTCTCAGGCCCCGAAGGCGGTGTATGGATTGGGGAGTCC<br>CAGCCTTGGGGATTCCCCAACTCCGCAGTTTCTTTTCTCCCTCTCC<br>CAACCTATGTAGGGTCCTTCTTCCTGGATACTCACGACGCGGACCC<br>AGTTCTCACTCCCATTGGGTGTCGGGTTTCCAGAGAAGCCAATCAG<br>TGTCGTCGCGGTCGCGGTTCTAAAGTCCGCACGCACCCACCGGGAC<br>TCAGATTCTCCCCAGACGCCGAGGATGGCCGTCATGGCGCCCCGAA<br>CCCTCGTCCTGCTACTCTCGGGGGCTCTGGCCCTGACCCAGACCTG<br>GGCGGGCTCTCACTCCATGAGGTATTTCTTCACATCCGTGTCCCGG<br>CCCGGCCGCGGGGAGCCCCGCTTCATCGCAGTGGGCTACGTGGACG<br>ACACGCAGTTCGTGCGGTTCGACAGCGACGCCGCGAGCCAGAGGAT<br>GGAGCCGCGGGCGCCGTGGATAGAGCAGGAGGGTCCGGAGTATTGG |

TABLE 18-continued

Exemplary Target Gene Sequences

| Target | Sequence |
|---|---|
| | GACGGGGAGACACGGAAAGTGAAGGCCCACTCACAGACTCACCGAG<br>TGGACCTGGGGACCCTGCGCGGCTACTACAACCAGAGCGAGGCCGG<br>TTCTCACACCGTCCAGAGGATGTATGGCTGCGACGTGGGGTCGGAC<br>TGGCGCTTCCTCCGCGGGTACCACCAGTACGCCTACGACGGCAAGG<br>ATTACATCGCCCTGAAAGAGGACCTGCGCTCTTGGACCGCGGCGGA<br>CATGGCAGCTCAGACCACCAAGCACAAGTGGGAGGCGGCCCATGTG<br>GCGGAGCAGTTGAGAGCCTACCTGGAGGGCACGTGCGTGGAGTGGC<br>TCCGCAGATACCTGGAGAACGGGAAGGAGACGCTGCAGCGCACGGA<br>CGCCCCCAAAACGCATATGACTCACCACGCTGTCTCTGACCATGAA<br>GCCACCCTGAGGTGCTGGGCCCTGAGCTTCTACCCTGCGGAGATCA<br>CACTGACCTGGCAGCGGGATGGGGAGGACCAGACCCAGGACACGGA<br>GCTCGTGGAGACCAGGCCTGCAGGGGATGGAACCTTCCAGAAGTGG<br>GCGGCTGTGGTGGTGCCTTCTGGACAGGAGCAGAGATACACCTGCC<br>ATGTGCAGCATGAGGGTTTGCCCAAGCCCCTCACCCTGAGATGGGA<br>GCCGTCTTCCCAGCCCACCATCCCCATCGTGGGCATCATTGCTGGC<br>CTGGTTCTCTTTGGAGCTGTGATCACTGGAGCTGTGGTCGCTGCTG<br>TGATGTGGAGGAGGAAGAGCTCAGATAGAAAAGGAGGGAGCTACTC<br>TCAGGCTGCAAGCAGTGACAGTGCCCAGGGCTCTGATGTGTCTCTC<br>ACAGCTTGTAAAGTGTGAGACAGCTGCCTTGTGTGGGACTGAGAGG<br>CAAGAGTTGTTCCTGCCCTTCCCTTTGTGACTTGAAGAACCCTGAC<br>TTTGTTTCTGCAAAGGCACCTGCATGTGTCTGTGTTCGTGTAGGCA<br>TAATGTGAGGAGGTGGGGAGACCACCCCACCCCCATGTCCACCATG<br>ACCCTCTTCCCACGCTGACCTGTGCTCCCTCCCCAATCATCTTTCC<br>TGTTCCAGAGAGGTGGGGCTGAGGTGTCTCCATCTCTGTCTCAACT<br>TCATGGTGCACTGAGCTGTAACTTCTTCCTTCCCTATTAAAA<br>(SEQ ID NO: 573) |
| HLA-A*02<br>(GenBank:<br>LK021978.1) | ATGGCCGTCATGGCGCCCCGAACCCTCGTCCTGCTACTCTCGGGGG<br>CTCTGGCCCTGACCCAGACCTGGGCGGGTGAGTGCGGGGTCGGGAG<br>GGAAACGGCCTCTGTGGGGAGAAGCAACGGGCCCGCCTGGCGGGGG<br>CGCAGGACCCGGGAAGCCGCGCCGGGAGGAGGGTCGGGCGGGTCTC<br>AGCCACTCCTCGTCCCCAGGCTCTCACTCCATGAGGTATTTCTTCA<br>CATCCGTGTCCCGGCCCGGCCGCGGGGAGCCCCGCTTCATCGCAGT<br>GGGCTACGTGGACGACACGCAGTTCGTGCGGTTCGACAGCGACGCC<br>GCGAGCCAGAGGATGGAGCCGCGGGCGCCGTGGATAGAGCAGGAGG<br>GTCCGGAGTATTGGGACGGGGAGACACGGAAAGTGAAGGCCCACTC<br>ACAGACTCACCGAGTGGACCTGGGGACCCTGCGCGGCTACTACAAC<br>CAGAGCGAGGCCGGTGAGTGACCCCGGCCCGGGGCGCAGGTCACGA<br>CCTCTCATCCCCCACGGACGGGCCAGGTCGCCCACAGTCTCCGGGT<br>CCGAGATCCGCCCCGAAGCCGCGGGACCCCGAGACCCTTGCCCCGG<br>GAGAGGCCCAGGCGCCTTTACCCGGTTTCATTTTCAGTTTAGGCCA<br>AAAATCCCCCCAGGTTGGTCGGGGCGGGGCGGGGCTCGGGGGACCG<br>GGCTGACCGCGGGGTCCGGGCCAGGTTCTCACACCGTCCAGAGGAT<br>GTATGGCTGCGACGTGGGGTCGGACTGGCGCTTCCTCCGCGGGTAC<br>CACCAGTACGCCTACGACGGCAAGGATTACATCGCCCTGAAAGAGG<br>ACCTGCGCTCTTTGACCGCGGCGGACATGGCAGCTCAGACCACCAA<br>GCACAAGTGGGAGGCGGCCCATGTGGCGGAGCAGTTGAGAGCCTAC<br>CTGGAGGGCACGTGCGTGGAGTGGCTCCGCAGATACCTGGAGAACG<br>GGAAGGAGACGCTGCAGCGCACGGGTACCAGGGGCACGGGGCGCC<br>TCCCTGATCGCCTGTAGATCTCCCGGGCTGGCCTCCCACAAGGAGG<br>GGAGACAATTGGGACCAACACTAGAATATCGCCCTCCCTCTGGTCC<br>TGAGGGAGAGGAATCCTCCTGGGTTTCCAGATCCTGTACCAGAGAG<br>TGACTCTGAGGTTCCGCCCTGCTCTCTGACACAATTAAGGGATAAA<br>ATCTCTGAAGGAATGACGGGAAGACGATCCCTCGAATACTGATGAG<br>TGGTTCCCTTTGACACACACAGGCAGCAGCCTTGGGCCCGTGACTT<br>TTCCTCTCAGGCCTTGTTCTCTGCTTCACACTCAATGTGTGTGGGG<br>GTCTGAGTCCAGCACTTCTGAGTCCTTCAGCCTCCACTCAGGTCAG<br>GACCAGAAGTCGCTGTTCCCTCTTCAGGGACTAGAATTTTCCACGG<br>AATAGGAGATTATCCCAGGTGCCTGTGTCCAGGCTGGTGTCTGGGT<br>TCTGTGCTCCCTTCCCCATCCCAGGTGTCCTGTCCATTCTCAAGAT<br>AGCCACATGTGTGCTGGAGGAGTGTCCCATGACAGATGCAAAATGC<br>CTGAATGATCTGACTCTTCCTGACAGAGCCCCCAAAACGCATATG<br>ACTCACCACGCTGTCTCTGACCATGAAGCCACCCTGAGGTGCTGGG<br>CCCTGAGCTTCTACCCTGCGGAGATCACACTGACCTGGCAGCGGGA<br>TGGGGAGGACCAGACCCAGGACACGGAGCTCGTGGAGACCAGGCCT<br>GCAGGGGATGGAACCTTCCAGAAGTGGGCGGCTGTGGTGGTGCCTT<br>CTGGACAGGAGCAGAGATACACCTGCCATGTGCAGCATGAGGGTTT<br>GCCCAAGCCCCTCACCCTGAGATGGGTAAGGAGGGAGACGGGGGT<br>GTCATGTCTTTTAGGGAAAGCAGGAGCCTCTCTGACCTTTAGCAGG<br>GTCAGGGCCCCTCACCTTCCCCTCTTTTCCCAGAGCCGTCTTCCCA<br>GCCCACCATCCCCATCGTGGGCATCATTGCTGGCCTGGTTCTCTTT<br>GGAGCTGTGATCACTGGAGCTGTGGTCGCTGCTGTGATGTGGAGGA<br>GGAAGAGCTCAGGTGGGAAGGGGTGAAGGGTGGGTCTGAGATTTC<br>TTGTCTCACTGAGGGTTCCAAGACCCAGGTAGAAGTGTGCCCTGCC<br>TCGTTACTGGGAAGCACCACCCACAATTATGGGCCTACCCAGCCTG<br>GGCCCTGTGTGCCAGCACTTACTCTTTTGTAAAGCACCTGTTAAAA |

TABLE 18-continued

Exemplary Target Gene Sequences

| Target | Sequence |
|---|---|
| | TGAAGGACAGATTTATCACCTTGATTACAGCGGTGATGGGACCTGA<br>TCCCAGCAGTCACAAGTCACAGGGGAAGGTCCCTGAGGACCTTCAG<br>GAGGGCGGTTGGTCCAGGACCCACACCTGCTTTCTTCATGTTTCCT<br>GATCCCGCCCTGGGTCTGCAGTCACACATTTCTGGAAACTTCTCTG<br>AGGTCCAAGACTTGGAGGTTCCTCTAGGACCTTAAGGCCCTGACTC<br>CTTTCTGGTATCTCACAGGACATTTTCTTCCCACAGATAGAAAAGG<br>AGGGAGCTACTCTCAGGCTGCAAGTAAGTATGAAGGAGGCTGATGC<br>CTGAGGTCCTTGGGATATTGTGTTTGGGAGCCCATGGGGGAGCTCA<br>CCCACCCCACAATTCCTCCTCTAGCCACATCTTCTGTGGGATCTGA<br>CCAGGTTCTGTTTTTGTTCTACCCCAGGCAGTGACAGTGCCCAGGG<br>CTCTGATGTGTCTCTCACAGCTTGTAAAGGTGAGAGCCTGGAGGGC<br>CTGATGTGTGTTGGGTGTTGGGCGGAACAGTGGACACAGCTGTGCT<br>ATGGGGTTTCTTTCCATTGGATGTATTGAGCATGCGATGGGCTGTT<br>TAAAGTGTGACCCCTCACTGTGACAGATACGAATTTGTTCATGAAT<br>ATTTTTTTCTATAGTGTGAGACAGCTGCCTTGTGTGGGACTGAGAG<br>GCAAGAGTTGTTCCTGCCCTTCCCTTTGTGACTTGAAGAACCCTGA<br>CTTTGTTTCTGCAAAGGCACCTGCATGTGTCTGTGTTCGTGTAGGC<br>ATAATGTGAGGAGGTGGGGAGACCACCCCACCCCCATGTCCACCAT<br>GACCCTCTTCCCACGCTGACCTGTGCTCCCTCCCCAATCATCTTTC<br>CTGTTCCAGAGAGGTGGGGCTGAGGTGTCTCCATCTCTGTCTCAAC<br>TTCATGGTGCACTGAGCTGTAACTTCTTCCTTCCCTATTAAAA<br>(SEQ ID NO: 574) |

The person of ordinary skill in the art will appreciate that T can be substituted for U to convert an RNA sequence to a DNA sequence and vice versa, and both are envisaged as target gene sequences of the disclosure.

In some embodiments, a target gene is edited in the immune cells described herein using a nucleic acid guided endonuclease. Exemplary nucleic acid guided endonucleases include Class II endonucleases, such as CRISPR/Cas9.

"CRISPR" or "CRISPR gene editing" as used herein refers to a set of clustered regularly interspaced short palindromic repeats, or a system comprising such a set of repeats. "Cas", as used herein, refers to a CRISPR-associated protein. A "CRISPR/Cas" system refers to a system derived from CRISPR and Cas which can be used to silence, knock out, or mutate a target gene. This system is a type of prokaryotic immune system that confers resistance to foreign genetic elements such as plasmids and phages and provides a form of acquired immunity. The CRISPR/Cas system has been modified for use in gene editing. This is accomplished by introducing into the eukaryotic cell a one or more specifically designed guide nucleic acids (gNAs), typically guide RNAs (gRNAs), and an appropriate Cas endonuclease which forms a ribonucleoprotein complex with the gNA. The gNA guides the gNA-endonuclease protein complex to a target genomic location, and the endonuclease introduces a strand break at the target genomic location. This double strand break can be repaired by cellular mechanisms such non-homologous end joining (leading to deletions) or homologous repair (which can generate insertions), thereby introducing genetic modifications into the host cell genome.

CRISPR/Cas systems are classified by class and by type. Class 2 systems currently represent a single interference protein that is categorized into three distinct types (types II, V and VI). Any class 2 CRISPR/Cas system suitable for gene editing, for example a type II, a type V or a type VI system, is envisaged as within the scope of the instant disclosure. Exemplary Class 2 type II CRISPR systems include Cas9, Csn2 and Cas4. Exemplary Class 2, type V CRISPR systems include, Cas12, Cas12a (Cpf1), Cas12b (C2c1), Cas12c (C2c3), Cas12d (CasY), Cas12e (CasX), Cas12f, Cas12g, Cas12h, Cas12i and Cas12k (C2c5). Exemplary Class 2 Type VI systems include Cas13, Cas13a (C2c2) Cas13b, Cas13c and Cas13d.

The CRISPR sequence, sometimes called a CRISPR locus, comprises alternating repeats and spacers. In a naturally-occurring CRISPR, the spacers usually comprise sequences foreign to the bacterium such as a plasmid or phage sequence. As described herein, spacer sequences may also be referred to as "targeting sequences." In CRISPR/Cas systems for a genetic engineering, the spacers are derived from the target gene sequence (the gNA).

An exemplary Class 2 type II CRISPR system relies on the protein Cas9, which is a nuclease with two active cutting sites, one for each strand of the double helix. Combining Cas9 and modified CRISPR locus RNA can be used in a system for gene editing. Pennisi (2013) Science 341: 833-836. In some embodiments, the Cas protein used to modify the immune cells is Cas9.

The CRISPR/Cas system can thus be used to edit a target gene, such as a gene targeted for editing in the immune cells described herein, by adding or deleting a base pair, or introducing a premature stop which thus decreases expression of the target. The CRISPR/Cas system can alternatively be used like RNA interference, turning off a target gene in a reversible fashion. In a mammalian cell, for example, the RNA can guide the Cas protein to a target gene promoter, sterically blocking RNA polymerases.

A Cas protein may be derived from any bacterial or archaeal Cas protein. Any suitable CRISPR/Cas system is envisaged as within the scope of the instant disclosure. In other aspects, Cas protein comprises one or more of Cas1, Cas1B, Cas2, Cas3, Cas4, Cas5, Cas6, Cas7, Cas8, Cas9, Cas10, Cas12a (Cpf1), Cas13, Csy1, Csy2, Csy3, Cse1, Cse2, Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx15, Csf1, Csf2, Csf3, Csf4, CasX, CasY, homologs thereof, or modified versions thereof. In some embodiments, the Cas protein is a Cas9 protein, a Cpf1 protein, a C2c1 protein, a C2c2 protein, a C2c3 protein, Cas3, Cas3-HD, Cas 5, Cas7, Cas8, Cas10, or combinations or complexes of these. In some embodiments, the Cas protein is a Cas9 protein.

Artificial CRISPR/Cas systems can be generated which inhibit a target gene, using technology known in the art, e.g., that described in U.S. Publication No. 20140068797, and Cong (2013) Science 339: 819-823. Other artificial CRISPR/Cas systems that are known in the art may also be generated which inhibit a target gene, e.g., that described in Tsai (2014) Nature Biotechnol., 32:6 569-576, U.S. Pat. Nos. 8,871,445; 8,865,406; 8,795,965; 8,771,945; and 8,697,359. Methods of designing suitable gNAs for a particular Cas protein will be known by persons of ordinary skill in the art.

The present disclosure provides gene-targeting guide nucleic acids (gNAs) that can direct the activities of an associated polypeptide (e.g., nucleic acid guided endonuclease) to a specific target gene sequence within a target nucleic acid genome. The genome-targeting nucleic acid can be an RNA. A genome-targeting RNA is referred to as a "guide RNA" or "gRNA" herein. A guide RNA can comprise at least a targeting sequence that hybridizes to a target nucleic acid sequence of interest, and a CRISPR repeat sequence. In some Type II systems, the gRNA also comprises a second RNA called the tracrRNA sequence, also referred to herein as a "scaffold" sequence. In the Type II guide RNA (gRNA), the CRISPR repeat sequence and scaffold sequence hybridize to each other to form a duplex. In the Type V guide RNA (gRNA), the crRNA forms a duplex. In both systems, the duplex can bind a site-directed polypeptide, such that the guide RNA and site-directed polypeptide form a complex. The gene-targeting nucleic acid can provide target specificity to the complex by virtue of its association with the site-directed polypeptide. The gene-targeting nucleic acid thus can direct the activity of the site-directed polypeptide.

In some embodiments, the disclosure provides a guide RNA comprising a targeting sequence and a guide RNA scaffold sequence, wherein the targeting sequence is complementary to the sequence of a target gene.

Exemplary guide RNAs include targeting sequences of about 15-20 bases. As is understood by the person of ordinary skill in the art, each gRNA can be designed to include a targeting sequence complementary to its genomic target sequence. For example, each of the targeting sequences, e.g., the RNA version of the DNA sequences presented in Table 19, minus the three 3' nucleotides which represent that PAM site, can be put into a single RNA chimera or a crRNA.

The gene targeting nucleic acid can be a double-molecule guide RNA. The gene targeting nucleic acid can be a single-molecule guide RNA. The gene targeting nucleic acid can be any known configuration of guide RNA known in the art, such as, for example, including paired gRNA, or multiple gRNAs used in a single step. Although it is clear from genomic sequences where the coding sequences and splice junctions are, other features required for gene expression may be idiosyncratic and unclear.

A double-molecule guide RNA can comprise two strands of RNA. The first strand comprises a sequence in the 5' to 3' direction, an optional spacer extension sequence, a targeting sequence and a minimum CRISPR repeat sequence. The second strand can comprise a minimum tracrRNA sequence (complementary to the minimum CRISPR repeat sequence), a 3' tracrRNA sequence and an optional tracrRNA extension sequence.

A single-molecule guide RNA (sgRNA) in a Type II system can comprise, in the 5' to 3' direction, an optional spacer extension sequence, a targeting sequence, a minimum CRISPR repeat sequence, a single-molecule guide linker, a minimum tracrRNA sequence, a 3' tracrRNA sequence and an optional tracrRNA extension sequence. The optional tracrRNA extension can comprise elements that contribute additional functionality (e.g., stability) to the guide RNA. The single-molecule guide linker can link the minimum CRISPR repeat and the minimum tracrRNA sequence to form a hairpin structure. The optional tracrRNA extension can comprise one or more hairpins.

In some embodiments, guide RNA or single-molecule guide RNA (sgRNA) can comprise a targeting sequence and a scaffold sequence. In some embodiments, the scaffold sequence is a Cas9 gRNA sequence. In some embodiments, the scaffold sequence is encoded by a DNA sequence that comprises a sequence that shares at least 90%, at least 95%, at least 96%, at least 97%, at least 98%, or at least 99% identity to GTTTTAGAGCTAGAAATAGCAAGT-TAAAATAAGGCTAGTCCGTTATCAACTTGAA AAAGTGGCACCGAGTCGGTGCTTTTTTT (SEQ ID NO: 575). In some embodiments, the scaffold sequence is encoded by a DNA sequence that comprises (SEQ ID NO: 575)
GTTTTAGAGCTAGAAATAGCAAGTTAAAATAAGGCTAGTCCGTTATCAAC

TTGAAAAAGTGGCACCGAGTCGGTGCTTTTTTT.

In some embodiments, for example those embodiments where the CRISPR/Cas system is a Cas9 system, the sgRNA can comprise a 20 nucleotide targeting sequence at the 5' end of the sgRNA sequence. The sgRNA can comprise a less than a 20 nucleotide targeting sequence at the 5' end of the sgRNA sequence. The sgRNA can comprise a more than 20 nucleotide targeting sequence at the 5' end of the sgRNA sequence. The sgRNA can comprise a variable length targeting sequence with 17-30 nucleotides at the 5' end of the sgRNA sequence.

Suitable scaffold sequences, and arrangement of scaffold targeting sequences, will depend on choice of endonuclease, and will be known to persons of skill in the art.

A single-molecule guide RNA (sgRNA) in a Type II system, e.g. Cas9, can comprise, in the 5' to 3' direction, a minimum CRISPR repeat sequence and a targeting sequence.

By way of illustration, guide RNAs used in the CRISPR/Cas9 or CRISPR/Cpf1 system, or other smaller RNAs can be readily synthesized by chemical means, as illustrated below and described in the art. While chemical synthetic procedures are continually expanding, purifications of such RNAs by procedures such as high performance liquid chromatography (HPLC, which avoids the use of gels such as PAGE) tends to become more challenging as polynucleotide lengths increase significantly beyond a hundred or so nucleotides. One approach used for generating RNAs of greater length is to produce two or more molecules that are ligated together. Much longer RNAs, such as those encoding a Cas9 or Cpf1 endonuclease, are more readily generated enzymatically. Various types of RNA modifications can be introduced during or after chemical synthesis and/or enzymatic generation of RNAs, e.g., modifications that enhance stability, reduce the likelihood or degree of innate immune response, and/or enhance other attributes, as described in the art.

The targeting sequence of a gRNA hybridizes to a sequence in a target nucleic acid of interest. The targeting sequence of a genome-targeting nucleic acid can interact with a target nucleic acid in a sequence-specific manner via hybridization (i.e., base pairing). The nucleotide sequence of the targeting sequence can vary depending on the sequence of the target nucleic acid of interest.

In a Cas9 system described herein, the targeting sequence can be designed to hybridize to a target nucleic acid that is located 5' of the reverse complement of a PAM of the Cas9 enzyme used in the system. The targeting sequence may perfectly match the target sequence or may have mismatches. Each CRISPR/Cas system protein may have a particular PAM sequence, in a particular orientation and position, that it recognizes in a target DNA. For example, S. pyogenes Cas9 recognizes in a target nucleic acid a PAM that comprises the sequence 5'-NRG-3', where R comprises either A or G, where N is any nucleotide and N is immediately 3' of the target nucleic acid sequence targeted by the targeting sequence. Selection of appropriate PAM sequences will be apparent to the person of ordinary skill in the art.

The target sequence is complementary to, and hybridizes with, the targeting sequence of the gRNA. The target nucleic acid sequence can comprise 20 nucleotides. The target nucleic acid can comprise less than 20 nucleotides. The target nucleic acid can comprise more than 20 nucleotides. The target nucleic acid can comprise at least: 5, 10, 15, 16, 17, 18, 19, 20, 21, 22, 23, 24, 25, 30 or more nucleotides. In some embodiments, for example those embodiments where the CRISPR/Cas system is a Cas9 system, the target nucleic acid sequence can comprise 20 nucleotides immediately 5' of the first nucleotide of the reverse complement of the PAM sequence. This target nucleic acid sequence is often referred to as the PAM strand or a target strand, and the complementary nucleic acid sequence is often referred to the non-PAM strand or non-target strand. One of skill in the art would recognize that the targeting sequence hybridizes to the non-PAM strand of the target nucleic acid, see e.g., US20190185849A1.

In some examples, the percent complementarity between the targeting sequence and the target nucleic acid is at least about 30%, at least about 40%, at least about 50%, at least about 60%, at least about 65%, at least about 70%, at least about 75%, at least about 80%, at least about 85%, at least about 90%, at least about 95%, at least about 97%, at least about 98%, at least about 99%, or 100%. In some examples, the percent complementarity between the targeting sequence and the target nucleic acid is at most about 30%, at most about 40%, at most about 50%, at most about 60%, at most about 65%, at most about 70%, at most about 75%, at most about 80%, at most about 85%, at most about 90%, at most about 95%, at most about 97%, at most about 98%, at most about 99%, or 100%. In some examples, the percent complementarity between the targeting sequence and the target nucleic acid is 100% over the six contiguous 5'-most nucleotides of the target sequence of the complementary strand of the target nucleic acid. The percent complementarity between the targeting sequence and the target nucleic acid can be at least 60% over about 20 contiguous nucleotides. The length of the targeting sequence and the target nucleic acid can differ by 1 to 6 nucleotides, which may be thought of as a bulge or bulges.

The targeting sequence can be designed or chosen using computer programs known to persons of ordinary skill in the art. The computer program can use variables, such as predicted melting temperature, secondary structure formation, predicted annealing temperature, sequence identity, genomic context, chromatin accessibility, % GC, frequency of genomic occurrence (e.g., of sequences that are identical or are similar but vary in one or more spots as a result of mismatch, insertion or deletion), methylation status, presence of SNPs, and the like. Available computer programs can take as input NCBI gene IDs, official gene symbols, Ensembl Gene IDs, genomic coordinates, or DNA sequences, and create an output file containing sgRNAs targeting the appropriate genomic regions designated as input. The computer program may also provide a summary of statistics and scores indicating on- and off-target binding of the sgRNA for the target gene (Doench et al. Nat Biotechnol. 34:184-191 (2016)). The disclosure provides guide RNAs comprising a targeting sequence. In some embodiments, the guide RNA further comprises a guide RNA scaffold sequence. In some embodiments, the targeting sequence is complementary to the sequence of a target gene selected from the group consisting of HLA-A, HLA-B, HLA-C, B2M or an allele thereof. In some embodiments, the target gene is an HLA-A gene. In some embodiments, the target gene is an HLA-B gene. In some embodiments, the target gene is an HLA-C gene. In some embodiments the target gene is HLA-A, HLA-B, HLA-C, or a combination thereof. In some embodiments, targeting sequence comprises a sequence that shares about 90%, about 95%, about 96%, about 97%, about 98%, about 99% identity to or is identical to a sequence disclosed in Table 18

Table 19.

In some embodiments, the gNAs specifically target the sequence of an endogenous HLA-A. In some embodiments, the gNAs that specifically target the sequence of an HLA-A locus comprise a sequence that shares about 90%, about 95%, about 96%, about 97%, about 98%, or about 99% identity to a sequence selected from the sequences disclosed in Table 19. In some embodiments, the gNAs that specifically target the sequence of an HLA-A locus comprise a sequence selected from the sequences disclosed in Table 19. In some embodiments, the gNAs that specifically target the sequence of an HLA-A locus comprise a sequence set forth in any one of SEQ ID NO: 576-8650.

In some embodiments, the gNAs specifically target a sequence of HLA-A*02 alleles. For example, the gRNAs specifically target, and hybridize to, a sequence shared by all HLA-A*02 alleles, but that is not shared by HLA-A*02 and HLA-A*03. In some embodiments, the gNAs specifically target a sequence of HLA-A*02:01 alleles. In some embodiments, the gNAs specifically target a sequence of HLA-A*02:01:01 alleles. In some embodiments, the gNAs specifically target a sequence of HLA-A*02:01:01:01 alleles. In some embodiments, the gNAs specifically target a sequence of HLA-A*02:01:01:01 alleles. In some embodiments, the gNAs specifically target a coding DNA sequence of HLA-A*02.

In some embodiments, the gNAs specifically target a coding DNA sequence that is shared by more than 1000 HLA-A*02 alleles.

TABLE 19

Illustrative Sequences Targeting HLA-A and HLA-Alleles

| SEQ ID NO | Guide Nucleic Acid Targeting Sequences |
|---|---|
| 576 | TGGACGACACGCAGTTCGTG |
| 577 | CAGATACCTGGAGAACGGGA |
| 578 | TCCCGTTCTCCAGGTATCTG |

TABLE 19-continued

Illustrative Sequences Targeting HLA-A and HLA-Alleles

| SEQ ID NO | Guide Nucleic Acid Targeting Sequences |
|---|---|
| 579 | CCGCCGCGGTCCAAGAGCGC |
| 580 | CCTGCGCTCTTGGACCGCGG |
| 581 | GGACCTGCGCTCTTGGACCGC |
| 582 | AAGGAGACGCTGCAGCGCACGGG |
| 583 | GAAGGAGACGCTGCAGCGCACGG |
| 584 | GCGGGCGCCGTGGATAGAGCAGG |
| 585 | TGCTCTATCCACGGCGCCCGCGG |
| 586 | CGATGAAGCGGGGCTCCCCGCGG |
| 587 | CGTGTCCCGGCCCGGCCGCGGGG |
| 588 | CGGCTCCATCCTCTGGCTCGCGG |
| 589 | GATGTAATCCTTGCCGTCGTAGG |
| 590 | ACAGCGACGCCGCGAGCCAGAGG |
| 591 | GGATGGAGCCGCGGGCGCCGTGG |
| 592 | GGCGCCGTGGATAGAGCAGGAGG |
| 593 | GCGCCGTGGATAGAGCAGGAGGG |
| 594 | CGGCTACTACAACCAGAGCGAGG |
| 595 | CTGGTTGTAGTAGCCGCGCAGGG |
| 596 | TACTACAACCAGAGCGAGGCCGG |
| 597 | CTACCTGGAGGGCACGTGCGTGG |
| 598 | CACGCACGTGCCCTCCAGGTAGG |
| 599 | GCAGGGTCCCCAGGTCCACTCGG |
| 600 | GTGGACCTGGGGACCCTGCGCGG |
| 601 | TGGAGGGCACGTGCGTGGAGTGG |
| 602 | GTATGGCTGCGACGTGGGGTCGG |
| 603 | CTGAGCTGCCATGTCCGCCGCGG |
| 604 | GGATTACATCGCCCTGAAAGAGG |
| 605 | CAAGTGGGAGGCGGCCCATGTGG |
| 606 | GTGGGAGGCGGCCCATGTGGCGG |
| 607 | CAGTTGAGAGCCTACCTGGAGGG |
| 608 | GCAGTTGAGAGCCTACCTGGAGG |
| 609 | TACCACCAGTACGCCTACGACGG |
| 610 | TGCCGTCGTAGGCGTACTGGTGG |
| 611 | CCAGTACGCCTACGACGGCAAGG |
| 612 | GGATGTGAAGAAATACCTCATGG |
| 613 | ATTTCTTCACATCCGTGTCCCGG |
| 614 | AGGCGTACTGGTGGTACCCGCGG |
| 615 | CGTACTGGTGGTACCCGCGGAGG |
| 616 | GAGGATGTATGGCTGCGACGTGG |
| 617 | GGATGTATGGCTGCGACGTGGGG |
| 618 | CTCAGACCACCAAGCACAAGTGG |
| 619 | TCAGACCACCAAGCACAAGTGGG |
| 620 | CACCAAGCACAAGTGGGAGGCGG |
| 621 | GACCACCAAGCACAAGTGGGAGG |
| 622 | GAGCCCCGCTTCATCGCAGTGGG |
| 623 | GTAGCCCACTGCGATGAAGCGGG |
| 624 | TAGCCCACTGCGATGAAGCGGGG |
| 625 | CGTAGCCCACTGCGATGAAGCGG |
| 626 | CTTCATCGCAGTGGGCTACGTGG |
| 627 | GGAGCCCCGCTTCATCGCAGTGG |
| 628 | CGGGGAGACACGGAAAGTGAAGG |
| 629 | AGTATTGGGACGGGGAGACACGG |
| 630 | AGGGTCCGGAGTATTGGGACGGG |
| 631 | GAGGGTCCGGAGTATTGGGACGG |
| 632 | GGACCCTCCTGCTCTATCCACGG |
| 633 | GTGGATAGAGCAGGAGGGTCCGG |
| 634 | AGACTCACCGAGTGGACCTGGGG |
| 635 | CACTCGGTGAGTCTGTGAGTGGG |
| 636 | CAGACTCACCGAGTGGACCTGGG |
| 637 | CCACTCACAGACTCACCGAGTGG |
| 638 | CCACTCGGTGAGTCTGTGAGTGG |
| 639 | TCGGACTGGCGCTTCCTCCGCGG |
| 640 | GCAGCCATACATCCTCTGGACGG |
| 641 | TCTCAACTGCTCCGCCACATGGG |
| 642 | ACCCTCATGCTGCACATGGCAGG |
| 643 | ACCTGCCATGTGCAGCATGAGGG |
| 644 | CACCTGCCATGTGCAGCATGAGG |
| 645 | GGAGGACCAGACCCAGGACACGG |
| 646 | GGATGGGAGGACCAGACCCAGG |
| 647 | GACCTGGCAGCGGGATGGGGAGG |
| 648 | AGATCACACTGACCTGGCAGCGG |
| 649 | GATCACACTGACCTGGCAGCGGG |
| 650 | AGGTCAGTGTGATCTCCGCAGGG |
| 651 | AAGCCCCTCACCCTGAGATGGGG |

TABLE 19-continued

Illustrative Sequences Targeting HLA-A and HLA-Alleles

| SEQ ID NO | Guide Nucleic Acid Targeting Sequences |
|---|---|
| 652 | CTGCGGAGATCACACTGACCTGG |
| 653 | CAGCAATGATGCCCACGATGGGG |
| 654 | CCAGCAATGATGCCCACGATGGG |
| 655 | GCCAGCAATGATGCCCACGATGG |
| 656 | GGATGGAACCTTCCAGAAGTGGG |
| 657 | GGGATGGAACCTTCCAGAAGTGG |
| 658 | ATGCCCACGATGGGGATGGTGGG |
| 659 | CAGCCCACCATCCCCATCGTGGG |
| 660 | CCAGCCCACCATCCCCATCGTGG |
| 661 | GATGCCCACGATGGGGATGGTGG |
| 662 | CAGGGCCCAGCACCTCAGGGTGG |
| 663 | AATGATGCCCACGATGGGGATGG |
| 664 | GGCCCTGACCCAGACCTGGGCGG |
| 665 | GACCCAGGACACGGAGCTCGTGG |
| 666 | ACACGGAGCTCGTGGAGACCAGG |
| 667 | CGTGGAGACCAGGCCTGCAGGGG |
| 668 | TCGTGGAGACCAGGCCTGCAGGG |
| 669 | AGCTGTGATCACTGGAGCTGTGG |
| 670 | AAAAGGAGGGAGCTACTCTCAGG |
| 671 | ATGTGGAGGAGGAAGAGCTCAGG |
| 672 | GTGTCTCTCACAGCTTGTAAAGG |
| 673 | GAGAGACACATCAGAGCCCTGGG |
| 674 | CTCCGCAGGGTAGAAGCTCAGGG |
| 675 | GGCCCTGAGCTTCTACCCTGCGG |
| 676 | GCTCAGGGCCCAGCACCTCAGGG |
| 677 | TATCTCTGCTCCTGTCCAGAAGG |
| 678 | AGTAGCAGGACGAGGGTTCGGGG |
| 679 | CCCCGAGAGTAGCAGGACGAGGG |
| 680 | CCCTCGTCCTGCTACTCTCGGGG |
| 681 | CCTCGTCCTGCTACTCTCGGGGG |
| 682 | CTGTGGTCGCTGCTGTGATGTGG |
| 683 | TCGCTGCTGTGATGTGGAGGAGG |
| 684 | TGGTCGCTGCTGTGATGTGGAGG |
| 685 | CACAGCCGCCCACTTCTGGAAGG |
| 686 | CCAGAAGTGGGCGGCTGTGGTGG |
| 687 | TGGAACCTTCCAGAAGTGGGCGG |
| 688 | TCACAGCTCCAAAGAGAACCAGG |
| 689 | CTGACCATGAAGCCACCCTGAGG |
| 690 | GCAAACCCTCATGCTGCACATGG |
| 691 | TGAAGCCACCCTGAGGTGCTGGG |
| 692 | GGTGAGTCATATGCGTTTTGGGG |
| 693 | GTGAGTCATATGCGTTTTGGGGG |
| 694 | CTTCATGGTCAGAGACAGCGTGG |
| 695 | TCTGGCCCTGACCCAGACCTGGG |

The sequences disclosed in Table 19 include the corresponding genomic sequences, inclusive of the PAM sequence. The skilled artisan will understand that the targeting sequence of the gRNA does not include three 3' terminal nucleotides of the sequences in Table 19, which represent the corresponding PAM site for the gRNA.

The disclosure provides gRNAs comprising a targeting sequence specific to the B2M gene. In some embodiments, the gRNAs specifically target the coding sequence (CDS) sequence of the B2M gene. In some embodiments, the gRNA comprises a sequence that targets the B2M gene promoter sequence.

In some embodiments the gRNA comprise a targeting sequence and a gRNA scaffold sequence. In some embodiments, the targeting sequence comprises a sequence set forth in Table 20, or a sequence shares about 90%, about 95%, about 96%, about 97%, about 98%, about 99% identity thereto.

In some embodiments, the targeting sequence is complementary to a sequence of the B2M gene. In some embodiments, the B2M gene comprises a sequence that shares about 90%, about 95%, about 96%, about 97%, about 98%, about 99% identity to the B2M sequence set forth in Table 18.

TABLE 20

Illustrative Sequences Targeting B2M

| SEQ ID NO | Sequence |
|---|---|
| 8657 | CGCGAGCACAGCTAAGGCCA |
| 8658 | GAGTAGCGCGAGCACAGCTA |
| 8659 | AGGGTAGGAGAGACTCACGC |
| 8660 | CTGAATCTTTGGAGTACCTG |
| 8661 | TCACGTCATCCAGCAGAGAA |
| 8662 | TCCTGAATTGCTATGTGTCT |
| 8663 | AAGTCAACTTCAATGTCGGA |
| 8664 | GTCTTTTCCCGATATTCCTC |
| 8665 | TGGAGTACCTGAGGAATATC |

TABLE 20-continued

Illustrative Sequences Targeting B2M

| SEQ ID NO | Sequence |
|---|---|
| 8666 | CAGCCCAAGATAGTTAAGTG |
| 8667 | ACAAAGTCACATGGTTCACA |
| 8668 | ACTCTCTCTTTCTGGCCTGG |
| 8669 | TGGGCTGTGACAAAGTCACA |
| 8670 | GGCCGAGATGTCTCGCTCCG |
| 8671 | CAGTAAGTCAACTTCAATGT |
| 8672 | ACTCACGCTGGATAGCCTCC |
| 8673 | CATACTCATCTTTTTCAGTG |
| 8674 | CACAGCCCAAGATAGTTAAG |
| 8675 | TTCAGACTTGTCTTTCAGCA |
| 8676 | AGTCACATGGTTCACACGGC |
| 8677 | ATACTCATCTTTTTCAGTGG |
| 8678 | GGCATACTCATCTTTTTCAG |
| 8679 | ACAGCCCAAGATAGTTAAGT |
| 8680 | GCTACTCTCTCTTTCTGGCC |
| 8681 | TGGAGAGAGAATTGAAAAAG |
| 8682 | ACTTGTCTTTCAGCAAGGAC |
| 8683 | GAAGTTGACTTACTGAAGAA |
| 8684 | GGCCACGGAGCGAGACATCT |
| 8685 | GCATACTCATCTTTTTCAGT |
| 8686 | CGTGAGTAAACCTGAATCTT |
| 8687 | TTACCCCACTTAACTATCTT |
| 8688 | TTGGAGTACCTGAGGAATAT |
| 8689 | ACCCAGACACATAGCAATTC |
| 8690 | TTTGACTTTCCATTCTCTGC |
| 8691 | TTCCTGAATTGCTATGTGTC |
| 8692 | CTCAGGTACTCCAAAGATTC |
| 8693 | CTTACCCCACTTAACTATCT |
| 8694 | CTCGCGCTACTCTCTCTTTC |
| 8695 | TCGATCTATGAAAAGACAG |
| 8696 | GAGACATGTAAGCAGCATCA |
| 8697 | ACATGTAAGCAGCATCATGG |
| 8698 | GAAGTCCTAGAATGAGCGCC |
| 8699 | GAGCGCCGGTGTCCCAAGC |
| 8700 | AGCGCCGGTGTCCCAAGCT |
| 8701 | GCGCCGGTGTCCCAAGCTG |
| 8702 | CTGGGGCGCGCACCCCAGAT |
| 8703 | GGGCGCGCACCCCAGATCGG |
| 8704 | GGCGCGCACCCCAGATCGGA |
| 8705 | CATCACGAGACTCTAAGAAA |
| 8706 | TAAGAAAAGGAAACTGAAAA |
| 8707 | AAGAAAAGGAAACTGAAAAC |
| 8708 | GAAAGTCCCTCTCTCTAACC |
| 8709 | CTAACCTGGCACTGCGTCGC |
| 8710 | CTGGCACTGCGTCGCTGGCT |
| 8711 | TGCGTCGCTGGCTTGGAGAC |
| 8712 | GCTGGCTTGGAGACAGGTGA |
| 8713 | GAGACAGGTGACGGTCCCTG |
| 8714 | AGACAGGTGACGGTCCCTGC |
| 8715 | CCTGCGGGCCTTGTCCTGAT |
| 8716 | CGGGCCTTGTCCTGATTGGC |
| 8717 | GGGCCTTGTCCTGATTGGCT |
| 8718 | GGGCACGCGTTTAATATAAG |
| 8719 | CACGCGTTTAATATAAGTGG |
| 8720 | TATAAGTGGAGGCGTCGCGC |
| 8721 | AAGTGGAGGCGTCGCGCTGG |
| 8722 | AGTGGAGGCGTCGCGCTGGC |
| 8723 | TTCCTGAAGCTGACAGCATT |
| 8724 | TCCTGAAGCTGACAGCATTC |
| 8725 | GCCCGAATGCTGTCAGCTTC |
| 8726 | AAACGCGTGCCCAGCCAATC |
| 8727 | GTGCCCAGCCAATCAGGACA |
| 8728 | CCAATCAGGACAAGGCCCGC |
| 8729 | CAATCAGGACAAGGCCCGCA |
| 8730 | CAAGCCAGCGACGCAGTGCC |
| 8731 | CGCAGTGCCAGGTTAGAGAG |
| 8732 | GCAGTGCCAGGTTAGAGAGA |
| 8733 | GAGTCTCGTGATGTTTAAGA |
| 8734 | TAAGAAGGCATGCACTAGAC |
| 8735 | AAGAAGGCATGCACTAGACT |
| 8736 | TGAGTTTGCTGTCTGTACAT |
| 8737 | TACATCGGCGCCCTCCGATC |
| 8738 | ACATCGGCGCCCTCCGATCT |
| 8739 | CATCGGCGCCCTCCGATCTG |

TABLE 20-continued

Illustrative Sequences Targeting B2M

| SEQ ID NO | Sequence |
|---|---|
| 8740 | CTGGGGTGCGCGCCCCAGCT |
| 8741 | TGGGGTGCGCGCCCCAGCTT |
| 8742 | CGCGCCCCAGCTTGGGACAC |
| 8743 | GCGCCCCAGCTTGGGACACC |
| 8744 | CAAGTCACTTAGCATCTCTG |
| 8745 | ACAGAAGTTCTCCTTCTGCT |
| 8746 | ATTCAAAGATCTTAATCTTC |
| 8747 | TTCAAAGATCTTAATCTTCT |
| 8748 | TTTTCTCGAATGAAAAATGC |
| 8749 | TGCAGGTCCGAGCAGTTAAC |
| 8750 | GGTCCGAGCAGTTAACTGGC |
| 8751 | GTCCGAGCAGTTAACTGGCT |
| 8752 | TCCGAGCAGTTAACTGGCTG |
| 8753 | AGCAAGTCACTTAGCATCTC |
| 8754 | GCAAGTCACTTAGCATCTCT |
| 8755 | TGGGGCCAGTCTGCAAAGCG |
| 8756 | GGGGCCAGTCTGCAAAGCGA |
| 8757 | GGGCCAGTCTGCAAAGCGAG |
| 8758 | GGCCAGTCTGCAAAGCGAGG |
| 8759 | GGACACCGGGCGCTCATTCT |
| 8760 | GGCGCTCATTCTAGGACTTC |
| 8761 | CTCATTCTAGGACTTCAGGC |
| 8762 | ATTCTAGGACTTCAGGCTGG |
| 8763 | TTCAGGCTGGAGGCACATTA |
| 8764 | TGCCCCCTCGCTTTGCAGAC |
| 8765 | GATGCTAAGTGACTTGCTAA |
| 8766 | GCCCCAGCCAGTTAACTGCT |
| 8767 | GCATTTTCATTCGAGAAAA |
| 8768 | TTTGAATGCTACCTAGCAGA |
| 8769 | TTCTGTTTATAACTACAGCT |
| 8770 | TCTGTTTATAACTACAGCTT |

In some embodiments, the immune cells described herein are edited using TALEN gene editing.

"TALEN" or "TALEN gene editing" refers to a transcription activator-like effector nuclease, which is an artificial nuclease used to edit a target gene.

TALENs are produced artificially by fusing a TAL effector DNA binding domain to a DNA cleavage domain. Transcription activator-like effectors (TALEs) derived from Xanthomonas bacteria can be engineered to bind any desired DNA sequence, including a portion of target genes such as TCR subunits, MHC class I complex components, or CD52. By combining an engineered TALE with a DNA cleavage domain, a restriction enzyme can be produced which is specific to any desired DNA sequence, including a target gene sequence. These can then be introduced into a cell, wherein they can be used for genome editing.

To produce a TALEN, a TALE protein is fused to a nuclease (N), which is a wild-type or mutated FokI endonuclease. Several mutations to FokI have been made for its use in TALENs; these, for example, improve cleavage specificity or activity.

The FokI domain functions as a dimer, requiring two constructs with unique DNA binding domains for sites in the target genome with proper orientation and spacing. Both the number of amino acid residues between the TALE DNA binding domain and the FokI cleavage domain and the number of bases between the two individual TALEN binding sites appear to be important parameters for achieving high levels of activity.

TALENs specific to sequences in a target gene can be constructed using any method known in the art, including various schemes using modular components.

In some embodiments, a target gene is edited in the immune cells described herein using ZFN gene editing.

"ZFN" or "Zinc Finger Nuclease" or "ZFN gene editing" refer to a zinc finger nuclease, an artificial nuclease which can be used to edit a target gene.

Like a TALEN, a ZFN comprises a FokI nuclease domain (or derivative thereof) fused to a DNA-binding domain. In the case of a ZFN, the DNA-binding domain comprises one or more zinc fingers.

A zinc finger is a small protein structural motif stabilized by one or more zinc ions. A zinc finger can comprise, for example, Cys2His2, and can recognize an approximately 3-bp sequence. Various zinc fingers of known specificity can be combined to produce multi-finger polypeptides which recognize about 6, 9, 12, 15 or 18-bp sequences. Various selection and modular assembly techniques are available to generate zinc fingers (and combinations thereof) recognizing specific sequences, including phage display, yeast one-hybrid systems, bacterial one-hybrid and two-hybrid systems, and mammalian cells.

Like a TALEN, a ZFN must dimerize to cleave DNA. Thus, a pair of ZFNs are required to target non-palindromic DNA sites. The two individual ZFNs must bind opposite strands of the DNA with their nucleases properly spaced apart.

Also like a TALEN, a ZFN can create a double-stranded break in the DNA, which can create a frame-shift mutation if improperly repaired, leading to a decrease in the expression and amount of a target gene or gene product in a cell. ZFNs can also be used with homologous recombination to mutate in a target gene.

ZFNs specific to sequences in a target gene can be constructed using any method known in the art.

In some embodiments, the expression and of function of one or more MCH-I components are reduced using RNA interference. "RNAi" or "RNA interference" refers to the process of sequence-specific post-transcriptional gene silencing, mediated by double-stranded RNA (dsRNA). Duplex RNAs such as siRNA (small interfering RNA), miRNA (micro RNA), shRNA (short hairpin RNA), ddRNA (DNA-directed RNA), piRNA (Piwi-interacting RNA), or rasiRNA (repeat associated siRNA) and modified forms thereof are all capable of mediating RNA interference. These dsRNA molecules may be commercially available or may be designed and prepared based on known sequence information. The anti-sense strand of these molecules can include RNA, DNA, PNA, or a combination thereof.

DNA/RNA chimeric polynucleotides include, but are not limited to, a double-strand polynucleotide composed of DNA and RNA that inhibits the expression of a target gene. dsRNA molecules can also include one or more modified nucleotides, as described herein, which can be incorporated on either or both strands.

In RNAi gene silencing or knockdown, dsRNA comprising a first (anti-sense) strand that is complementary to a portion of a target gene and a second (sense) strand that is fully or partially complementary to the first anti-sense strand is introduced into an organism. After introduction into the organism, the target gene-specific dsRNA is processed into relatively small fragments (siRNAs) and can subsequently become distributed throughout the organism, decrease messenger RNA of target gene, leading to a phenotype that may come to closely resemble the phenotype arising from a complete or partial deletion of the target gene.

Certain dsRNAs in cells can undergo the action of Dicer enzyme, a ribonuclease III enzyme. Dicer can process the dsRNA into shorter pieces of dsRNA, i.e. siRNAs. RNAi also involves an endonuclease complex known as the RNA induced silencing complex (RISC). Following cleavage by Dicer, siRNAs enter the RISC complex and direct cleavage of a single stranded RNA target having a sequence complementary to the anti-sense strand of the siRNA duplex. The other strand of the siRNA is the passenger strand. Cleavage of the target RNA takes place in the middle of the region complementary to the anti-sense strand of the siRNA duplex. siRNAs can thus down regulate or knock down gene expression by mediating RNA interference in a sequence-specific manner.

As used herein with respect to RNA interference, "target gene" or "target sequence" refers to a gene or gene sequence whose corresponding RNA is targeted for degradation through the RNAi pathway using dsRNAs or siRNAs as described herein. Exemplary target gene sequences are shown in Table 18. To target a gene, for example using an siRNA, the siRNA comprises an anti-sense region complementary to, or substantially complementary to, at least a portion of the target gene or sequence, and sense strand complementary to the anti-sense strand. Once introduced into a cell, the siRNA directs the RISC complex to cleave an RNA comprising a target sequence, thereby degrading the RNA. The disclosure provides interfering RNAs. The double stranded RNA molecule of the disclosure may be in the form of any type of RNA interference molecule known in the art. In some embodiments, the double stranded RNA molecule is a small interfering RNA (siRNA). In other embodiments, the double stranded RNA molecule is a short hairpin RNA (shRNA) molecule. In other embodiments, the double stranded RNA molecule is a Dicer substrate that is processed in a cell to produce an siRNA. In other embodiments the double stranded RNA molecule is part of a microRNA precursor molecule.

In some embodiments, the shRNA is a length to be suitable as a Dicer substrate, which can be processed to produce a RISC active siRNA molecule. See, e.g., Rossi et al., US2005/0244858.

A Dicer substrate double stranded RNA (e.g. a shRNA) can be of a length sufficient that it is processed by Dicer to produce an active siRNA, and may further include one or more of the following properties: (i) the Dicer substrate shRNA can be asymmetric, for example, having a 3' overhang on the anti-sense strand, (ii) the Dicer substrate shRNA can have a modified 3' end on the sense strand to direct orientation of Dicer binding and processing of the dsRNA to an active siRNA, for example the incorporation of one or more DNA nucleotides, and (iii) the first and second strands of the Dicer substrate ds RNA can be from 21-30 bp in length.

In some embodiments, the interfering RNAs comprise a sequence complementary to a sequence of a B2M mRNA. In some embodiments, the interfering RNA is capable of inducing RNAi-mediated degradation of the B2M mRNA. In some embodiments, the B2M mRNA sequence comprises a coding sequence. In some embodiments, the B2M mRNA sequence comprises an untranslated region In some embodiments, the interfering RNAs comprise a sequence complementary to a sequence of an HLA-A*02 mRNA. In some embodiments, the interfering RNA is capable of inducing RNAi-mediated degradation of the HLA-A*02 mRNA. In some embodiments, the HLA-A*02 mRNA sequence comprises a coding sequence. In some embodiments, the HLA-A*02 mRNA sequence comprises an untranslated region.

In some embodiments, the interfering RNA is a short hairpin RNA (shRNA). In some embodiments, the shRNA comprises a first sequence, having from 5' to 3' end a sequence complementary to the B2M mRNA; and a second sequence, having from 5' to 3' end a sequence complementary to the first sequence, wherein the first sequence and second sequence form the shRNA.

In some embodiments, the first sequence is 18, 19, 20, 21, or 22 nucleotides. In some embodiments, the first sequence is complementary to a sequence selected from the sequences set forth in Table 21 and Table 22. In some embodiments, the first sequence has GC content greater than or equal to 25% and less than 60%. In some embodiments, the first sequence is complementary to a sequence selected from the sequences set forth in Table 21 and Table 22. In some embodiments, the first sequence does not comprise four nucleotides of the same base or a run of seven C or G nucleotide bases. In some embodiments, the first sequence is 21 nucleotides.

In some embodiments, the first sequence is complementary to a sequence selected from SEQ ID NOs 8771-13382. In some embodiments, the first sequence has GC content greater than or equal to 25% and less than 60%. In some embodiments, the first sequence is complementary to a sequence selected from SEQ ID NOs: 8771-13382. In some embodiments, the first sequence does not comprise four nucleotides of the same base or a run of seven C or G nucleotide bases. In some embodiments, the first sequence is complementary to a sequence selected from SEQ ID NOs: 8771-13382. In some embodiments, the first sequence is 21 nucleotides. In some embodiments, the first sequence is complementary to a sequence selected from SEQ ID NOs: 8771-9352. In some embodiments, the first sequence is complementary to a sequence selected from SEQ ID NOs: 8771-9052. In some embodiments, the first sequence is complementary to a sequence selected from SEQ ID NOs: 8771-8908. Illustrative target B2M sequences complementary to the first sequence are set forth in SEQ ID NOs: 8771-8908.

Illustrative target B2M sequences complementary to the first sequence are shown in Table 21. In some embodiments, the first sequence targeting B2M comprises a sequence set forth in any one of SEQ ID NOs: 8771-13382.

In some cases, the first sequence may have 100% identity, i.e. complete identity, homology, complementarity to the target nucleic acid sequence. In other cases, there may be one or more mismatches between the first sequence and the target nucleic acid sequence. For example, there may be 1, 2, 3, 4, 5, 6, or 7 mismatches between the sense region and the target nucleic acid sequence.

The sequences set forth in Table 21 are presented as DNA sequences. In all sequences set forth in Table 21, thymine (T) may be replaced by uracil (U) to arrive at the sequence of the target mRNA sequence.

TABLE 21

Illustrative target B2M sequences complementary to first sequence.

| SEQ ID NO | Sequence |
|---|---|
| 8771 | AGAGAATGGAAAGTCAAATTT |
| 8772 | ATGGACATGATCTTCTTTATA |
| 8773 | TGGACATGATCTTCTTTATAA |
| 8774 | GGACATGATCTTCTTTATAAT |
| 8775 | TGACAGGATTATTGGAAATTT |
| 8776 | TTGTGGTTAATCTGGTTTATT |
| 8777 | TGTGGTTAATCTGGTTTATTT |
| 8778 | GCAGAGAATGGAAAGTCAAAT |
| 8779 | CAGAGAATGGAAAGTCAAATT |
| 8780 | GAGAATGGAAAGTCAAATTTC |
| 8781 | GTCACAGCCCAAGATAGTTAA |
| 8782 | TGCTTATACACTTACACTTTA |
| 8783 | GCTTATACACTTACACTTTAT |
| 8784 | CTTTATACACTTACACTTTATG |
| 8785 | ACATGGACATGATCTTCTTTA |
| 8786 | CATGGACATGATCTTCTTTAT |
| 8787 | ATCAACATCTTGGTCAGATTT |
| 8788 | CTTGCACTCAAAGCTTGTTAA |
| 8789 | AGTTAAGCGTGCATAAGTAA |
| 8790 | GCATAAGTTAACTTCCAATTT |
| 8791 | TACATACTCTGCTTAGAATTT |
| 8792 | ACATACTCTGCTTAGAATTTG |
| 8793 | TTGACAGGATTATTGGAAATT |
| 8794 | GACAGGATTATTGGAAATTTG |
| 8795 | TAAGGCATGGTTGTGGTTAAT |
| 8796 | GTTGTGGTTAATCTGGTTTAT |
| 8797 | GTTCCACAAGTTAAATAAATC |
| 8798 | TCCAGCGTACTCCAAAGATTC |
| 8799 | TACTCCAAAGATTCAGGTTTA |
| 8800 | ACTCCAAAGATTCAGGTTTAC |
| 8801 | CACGTCATCCAGCAGAGAATG |
| 8802 | GGTTTCATCCATCCGACATTG |

TABLE 21-continued

Illustrative target B2M sequences complementary to first sequence.

| SEQ ID NO | Sequence |
|---|---|
| 8803 | CCGACATTGAAGTTGACTTAC |
| 8804 | TGAAGAATGGAGAGAGAATTG |
| 8805 | GAGCATTCAGACTTGTCTTTC |
| 8806 | TTCAGCAAGGACTGGTCTTTC |
| 8807 | GCAAGGACTGGTCTTTCTATC |
| 8808 | CGTGTGAACCATGTGACTTTG |
| 8809 | CTTTGTCACAGCCCAAGATAG |
| 8810 | TCACAGCCCAAGATAGTTAAG |
| 8811 | AGTGGGATCGAGACATGTAAG |
| 8812 | AGGTTTGAAGATGCCGCATTT |
| 8813 | GGTTTGAAGATGCCGCATTTG |
| 8814 | TTGATATGCTTATACACTTAC |
| 8815 | TGAGTGCTGTCTCCATGTTTG |
| 8816 | TGTCTCCATGTTTGATGTATC |
| 8817 | TCAACATCTTGGTCAGATTTG |
| 8818 | TCAGATTTGAACTCTTCAATC |
| 8819 | TTCAATCTCTTGCACTCAAAG |
| 8820 | TTGCACTCAAAGCTTGTTAAG |
| 8821 | ACTCAAAGCTTGTTAAGATAG |
| 8822 | AGATAGTTAAGCGTGCATAAG |
| 8823 | TGCATAAGTTAACTTCCAATT |
| 8824 | GTTAACTTCCAATTTACATAC |
| 8825 | ATTGACAGGATTATTGGAAAT |
| 8826 | GTAAGGCATGGTTGTGGTTAA |
| 8827 | GGTTGTGGTTAATCTGGTTTA |
| 8828 | TTCCTGAAGCTGACAGCATTC |
| 8829 | GCTATCCAGCGTACTCCAAAG |
| 8830 | CATCCAGCAGAGAATGGAAAG |
| 8831 | CAAATTTCCTGAATTGCTATG |
| 8832 | ATTGCTATGTGTCTGGGTTTC |
| 8833 | GAAGATGCCGCATTTGGATTG |
| 8834 | CAATTTACATACTCTGCTTAG |
| 8835 | TATCCAGCGTACTCCAAAGAT |
| 8836 | ATCCAGCGTACTCCAAAGATT |
| 8837 | CTCCAAAGATTCAGGTTTACT |
| 8838 | TGCTATGTGTCTGGGTTTCAT |
| 8839 | TTTCATCCATCCGACATTGAA |

TABLE 21-continued

Illustrative target B2M sequences complementary to first sequence.

| SEQ ID NO | Sequence |
|---|---|
| 8840 | GAAGTTGACTTACTGAAGAAT |
| 8841 | GAAGAATGGAGAGAGAATTGA |
| 8842 | AGAATGGAGAGAGAATTGAAA |
| 8843 | CAGCAAGGACTGGTCTTTCTA |
| 8844 | AGCAAGGACTGGTCTTTCTAT |
| 8845 | ACTTTGTCACAGCCCAAGATA |
| 8846 | TTGTCACAGCCCAAGATAGTT |
| 8847 | TGTCACAGCCCAAGATAGTTA |
| 8848 | CACAGCCCAAGATAGTTAACT |
| 8849 | GCAGCATCATGGAGGTTTGAA |
| 8850 | CCGCATTTGGATTGGATGAAT |
| 8851 | TTGAGTGCTGTCTCCATGTTT |
| 8852 | AGTGCTGTCTCCATGTTTGAT |
| 8853 | CTGTCTCCATGTTTGATGTAT |
| 8854 | TCTAGGAGGGCTGGCAACTTA |
| 8855 | CAACATCTTGGTCAGATTTGA |
| 8856 | GTCAGATTTGAACTCTTCAAT |
| 8857 | TCTTGCACTCAAAGCTTGTTA |
| 8858 | TGCACTCAAAGCTTGTTAAGA |
| 8859 | GCACTCAAAGCTTGTTAAGAT |
| 8860 | CACTCAAAGCTTGTTAAGATA |
| 8861 | TCAAAGCTTGTTAAGATAGTT |
| 8862 | CAAAGCTTGTTAAGATAGTTA |
| 8863 | GATAGTTAAGCGTGCATAAGT |
| 8864 | ATAGTTAAGCGTGCATAAGTT |
| 8865 | TAGTTAAGCGTGCATAAGTTA |
| 8866 | TTAAGCGTGCATAAGTTAACT |
| 8867 | TAAGCGTGCATAAGTTAACTT |
| 8868 | ATTTACATACTCTGCTTAGAA |
| 8869 | TTTACATACTCTGCTTAGAAT |
| 8870 | ACAGGATTATTGGAAATTTGT |
| 8871 | CAGGATTATTGGAAATTTGTT |
| 8872 | AGGCATGGTTGTGGTTAATCT |
| 8873 | CAGCAGAGAATGGAAAGTCAA |
| 8874 | TCCGACATTGAAGTTGACTTA |
| 8875 | CTGGTCTTTCTATCTCTTGTA |

TABLE 21-continued

Illustrative target B2M sequences complementary to first sequence.

| SEQ ID NO | Sequence |
|---|---|
| 8876 | CCGTGTGAACCATGTGACTTT |
| 8877 | CCCAAGATAGTTAAGTGGGAT |
| 8878 | GGTTGCTCCACAGGTAGCTCT |
| 8879 | GCTCCACAGGTAGCTCTAGGA |
| 8880 | GGGAGCAGAGAATTCTCTTAT |
| 8881 | GGAGCAGAGAATTCTCTTATC |
| 8882 | GAGCAGAGAATTCTCTTATCC |
| 8883 | GAGAATTCTCTTATCCAACAT |
| 8884 | GAATTCTCTTATCCAACATCA |
| 8885 | AAGTGGAGCATTCAGACTTGT |
| 8886 | AAGGACTGGTCTTTCTATCTC |
| 8887 | AAGCTTGTTAAGATAGTTAAG |
| 8888 | AAGCGTGCATAAGTTAACTTC |
| 8889 | AAGATGCCGCATTTGGATTGG |
| 8890 | AAGAATGGAGAGAGAATTGAA |
| 8891 | AACATCAACATCTTGGTCAGA |
| 8892 | AAGGCATGGTTGTGGTTAATC |
| 8893 | AAGCAGCATCATGGAGGTTTG |
| 8894 | AAGATGAGTATGCCTGCCGTG |
| 8895 | AAGTTGACTTACTGAAGAATG |
| 8896 | AAGATAGTTAAGCGTGCATAA |
| 8897 | AACTTCCAATTTACATACTCT |
| 8898 | AACATCTTGGTCAGATTTGAA |
| 8899 | AACTCTTCAATCTCTTGCACT |
| 8900 | AATTTCCTGAATTGCTATGTG |
| 8901 | AATGGAAAGTCAAATTTCCTG |
| 8902 | AACCATGTGACTTTGTCACAG |
| 8903 | AATTGACAGGATTATTGGAAA |
| 8904 | AATTCTCTTATCCAACATCAA |
| 8905 | AAAGTGGAGCATTCAGACTTG |
| 8906 | AAAGTCAAATTTCCTGAATTG |
| 8907 | GTTGCTCCACAGGTAGCTCTA |
| 8908 | AATTTACATACTCTGCTTAGA |

An exemplary sequence encoding a B2M shRNA comprises a sequence of GCACTCAAAGCTTGTTAA-GATCGAAATCTTAACAAGCTTTGAGTGC (SEQ ID NO: 13383), or a sequence having at least 90%, at least 95%, at least 97% or at least 99% identity thereto. A further exemplary sequence encoding a B2M shRNA comprises a sequence of GTTAACTTCCAATTTACAT-
ACCGAAGTATGTAAATTGGAAGTTAAC (SEQ ID NO:
13384), or a sequence having at least 90%, at least 95%, at
least 97% or at least 99% identity thereto.

In some embodiments, the shRNA comprises a first sequence, having from 5' end to 3' end a sequence complementary to an HLA-A*02 mRNA; and a second sequence, having from 5' end to 3' end a sequence complementary to the first sequence. In some embodiments, the HLA-A*02 mRNA sequence comprises a coding sequence. In some embodiments, the HLA-A*02 mRNA sequence comprises an untranslated region. In some embodiments, the first and second sequence are present on a polynucleotide, wherein the first sequence and the second sequence are separated by 4, 5, 6, 7, 8, 9, 10, 11, 12, 13, 14, or 15 nucleotides, wherein the 4, 5, 6, 7, 8, 9, 10, 11, 12, 13, 14, or 15 nucleotides form a loop region in the shRNA. In some embodiments, the shRNA further comprises a 5' flank sequence and a 3' flank sequence, wherein the 5' flank sequence is joined to the 5' end of the first sequence, and wherein the 3' flank sequence is joined to the 3' end of the second sequence.

In some embodiments, the polynucleotide encoding an shRNA has from 5' end to 3' end, a 5' flank sequence, a first sequence, a loop sequence, a second sequence, a 3' flank sequence. In some embodiments, the polynucleotide encoding an shRNA has from 5' end to 3' end, a 5' flank sequence, a second sequence, a loop sequence, a first sequence, and a 3' flank sequence.

In some embodiments, the first sequences is 18, 19, 20, 21, or 22 nucleotides. In some embodiments, the first sequence is complementary to a sequence selected from SEQ ID NOs: 13385-21779. In some embodiments, the first sequence has GC content greater than or equal to 25% and less than 60%. In some embodiments, the first sequence is complementary to a sequence selected from SEQ ID NOs: 13385-16975. In some embodiments, the first sequence does not comprise four nucleotides of the same base or a run of seven C or G nucleotide bases. In some embodiments, the first sequence is complementary to a sequence selected from SEQ ID NOs: 13385-16493. In some embodiments, the first sequence is complementary to a sequence selected from SEQ ID NOs: 13385-13663. In some embodiments, the first sequence is complementary to a sequence selected from SEQ ID NOs: 13385-13470.

Illustrative target HLA sequences complementary to the first sequence are shown in Table 22.

TABLE 22

Illustrative target HLA sequences complementary to first sequence

| SEQ ID NO | Sequence |
|---|---|
| 13385 | CTTCTTCCTTCCCTATTAAAA |
| 13386 | TCTCACTCCATGAGGTATTTC |
| 13387 | CTCTCACTCCATGAGGTATTT |
| 13388 | GAGGAGGAAGAGCTCAGATAG |
| 13389 | GCTCTCACTCCATGAGGTATT |
| 13390 | AGGATTACATCGCCCTGAAAG |
| 13391 | ACACCGTCCAGAGGATGTATG |
| 13392 | AGGGTCCTTCTTCCTGGATAC |

TABLE 22-continued

Illustrative target HLA sequences complementary to first sequence

| SEQ ID NO | Sequence |
|---|---|
| 13393 | CCTACGACGGCAAGGATTACA |
| 13394 | TCACTCCATGAGGTATTTCTT |
| 13395 | CTACGACGGCAAGGATTACAT |
| 13396 | CTCACTCCATGAGGTATTTCT |
| 13397 | GGAGGAAGAGCTCAGATAGAA |
| 13398 | CACACCGTCCAGAGGATGTAT |
| 13399 | CACGCTGTCTCTGACCATGAA |
| 13400 | CTGGACAGGAGCAGAGATACA |
| 13401 | TGGAGGAGGAAGAGCTCAGAT |
| 13402 | GGCTCTCACTCCATGAGGTAT |
| 13403 | CATCTCTGTCTCAACTTCATG |
| 13404 | TACGACGGCAAGGATTACATC |
| 13405 | GGATTACATCGCCCTGAAAGA |
| 13406 | GATTACATCGCCCTGAAAGAG |
| 13407 | CTCAGACCACCAAGCACAAGT |
| 13408 | TCACACCGTCCAGAGGATGTA |
| 13409 | ACTCCATGAGGTATTTCTTCA |
| 13410 | CACTCCATGAGGTATTTCTTC |
| 13411 | CCATGAGGTATTTCTTCACAT |
| 13412 | ACTTCTTCCTTCCCTATTAAA |
| 13413 | GTGTCTCTCACAGCTTGTAAA |
| 13414 | CTGTGTTCGTGTAGGCATAAT |
| 13415 | TGTGTTCGTGTAGGCATAATG |
| 13416 | TAACTTCTTCCTTCCCTATTA |
| 13417 | TCTGGACAGGAGCAGAGATAC |
| 13418 | TTGCTGGCCTGGTTCTCTTTG |
| 13419 | TGTCTCTCACAGCTTGTAAAG |
| 13420 | ACTTGAAGAACCCTGACTTTG |
| 13421 | GAAGAACCCTGACTTTGTTTC |
| 13422 | TCTGTGTTCGTGTAGGCATAA |
| 13423 | CATGGTGCACTGAGCTGTAAC |
| 13424 | GTAACTTCTTCCTTCCCTATT |
| 13425 | CATGTGCAGCATGAGGGTTTG |
| 13426 | TTGTTCCTGCCCTTCCCTTTG |
| 13427 | ACCCAGTTCTCACTCCCATTG |
| 13428 | GGGTTTCCAGAGAAGCCAATC |
| 13429 | TTCTCCCTCTCCCAACCTATG |

TABLE 22-continued

Illustrative target HLA sequences complementary to first sequence

| SEQ ID NO | Sequence |
|---|---|
| 13430 | GTCTCTCACAGCTTGTAAAGT |
| 13431 | TGTGTCTCACAGCTTGTAA |
| 13432 | GAGGAAGAGCTCAGATAGAAA |
| 13433 | TGAAGAACCCTGACTTTGTTT |
| 13434 | TTGAAGAACCCTGACTTTGTT |
| 13435 | GTGTTCGTGTAGGCATAATGT |
| 13436 | TGGTGCACTGAGCTGTAACTT |
| 13437 | CTCCCTCTCCCAACCTATGTA |
| 13438 | AGGAGGAAGAGCTCAGATAGA |
| 13439 | ACCTATGTAGGGTCCTTCTTC |
| 13440 | GGGTCCTTCTTCCTGGATACT |
| 13441 | GGTCCTTCTTCCTGGATACTC |
| 13442 | GTCCTTCTTCCTGGATACTCA |
| 13443 | AAGCCAATCAGTGTCGTCGCG |
| 13444 | AAGAGGACCTGCGCTCTTGGA |
| 13445 | AAGTGTGAGACAGCTGCCTTG |
| 13446 | AAGGCACCTGCATGTGTCTGT |
| 13447 | AATCATCTTTCCTGTTCCAGA |
| 13448 | AAAGGCACCTGCATGTGTCTG |
| 13449 | AAAGAGGACCTGCGCTCTTGG |
| 13450 | AAACGCATATGACTCACCACG |
| 13451 | GGAAGAGCTCAGATAGAAA |
| 13452 | GGGAGACACGGAAAGTGAA |
| 13453 | CACCTGCCATGTGCAGCATGA |
| 13454 | GGAGATCACACTGACCTGGCA |
| 13455 | GGATTACATCGCCCTGAAAG |
| 13456 | GCAGGAGGGTCCGGAGTATT |
| 13457 | GGACGGGGAGACACGGAAAG |
| 13458 | GAAAGTGAAGGCCCACTCA |
| 13459 | GATACCTGGAGAACGGGAAG |
| 13460 | GCTGTGGTGGTGCCTTCTGG |
| 13461 | GCTACTACAACCAGAGCGAG |
| 13462 | GTGGCTCCGCAGATACCTG |
| 13463 | GCCAATCAGTGTCGTCGCG |
| 13464 | GAGGACCTGCGCTCTTGGA |
| 13465 | GTGTGAGACAGCTGCCTTG |
| 13466 | GGCACCTGCATGTGTCTGT |
| 13467 | TCATCTTTCCTGTTCCAGA |
| 13468 | AGGCACCTGCATGTGTCTG |
| 13469 | AGAGGACCTGCGCTCTTGG |
| 13470 | ACGCATATGACTCACCACG |

In some embodiments, the first sequence and second sequence are separated by a linker, sometimes referred to as a loop. In some embodiments, both the first sequence and the second sequence are encoded by one single-stranded RNA or DNA vector. In some embodiments, the loop is between the first and second sequences. In these embodiments, and the first sequence and the second sequence hybridize to form a duplex region. The first sequence and second sequence are joined by a linker sequence, forming a "hairpin" or "stem-loop" structure. The shRNA can have complementary first sequences and second sequences at opposing ends of a single stranded molecule, so that the molecule can form a duplex region with the complementary sequence portions, and the strands are linked at one end of the duplex region by a linker (i.e. loop sequence). The linker, or loop sequence, can be either a nucleotide or non-nucleotide linker. The linker can interact with the first sequence, and optionally, second sequence through covalent bonds or non-covalent interactions.

Any suitable nucleotide loop sequence is envisaged as within the scope of the disclosure. An shRNA of this disclosure may include a nucleotide, non-nucleotide, or mixed nucleotide/non-nucleotide linker that joins the first sequence of the shRNA to the second sequence of the shRNA. A nucleotide loop sequence can be ≥2 nucleotides in length, for example about 4, 5, 6, 7, 8, 9, 10, 11, 12, 13, 14, or 15 nucleotides in length. Illustrative loop sequences are disclosed in Table 23.

In some embodiments, the shRNA further comprises a 5' flank sequence and a 3' flank sequence. In some embodiments, wherein the 5' flank sequence is joined to the 5' end of the first sequence, and wherein the 3' flank sequence is joined to the 3' end of the second sequence.

Without wishing to be bound by theory, it is thought that flanking shRNA stem loop sequence with 5' and 3' sequences similar to those found in microRNAs can target the shRNA for processing by the endogenous microRNA processing machinery, increasing the effectiveness of shRNA processing. Alternatively, or in addition, flanking sequences may increase shRNA compatibility with polymerase II or polymerase III promoters, leading to more effective regulation of shRNA expression.

In some embodiments, the 5' flank sequence is selected from the sequences set forth in Table 23. Illustrative flank sequence are shown in Table 23.

TABLE 23

Illustrative flank sequences

| SEQ ID NO | 5' Flank Sequence |
|---|---|
| 21780 | GG |
| 21781 | ACACCAUGUUGCCAGUCUCUAGG |
| 21782 | UGAUAGCAAUGUCAGCAGUGCCU |
| 21783 | UAUUGCUGUUGACAGUGAGCGAC |

| SEQ ID NO | 3' Flank Sequence |
|---|---|
| 21784 | UGGCGUCUGGCCCAACCACAC |
| 21785 | GUAAGGUUGACCAUACUCUAC |

In some embodiments, the first and second sequence are present on a single stranded polynucleotide, wherein the first sequence and second sequence are separated by 4, 5, 6, 7, 8, 9, 10, 11, 12, 13, 14, or 15 nucleotides, wherein the 4, 5, 6, 7, 8, 9, 10, 11, 12, 13, 14, or 15 nucleotides form a loop region in the shRNA. In some embodiments, the loop region comprises a sequence selected from the sequences set forth in Table 24.

TABLE 24

Illustrative loop region sequences

| SEQ ID NO | Loop Region Sequence |
|---|---|
| 21786 | CGAA |
| 21787 | UUCAAGA |
| 21788 | AUAUUCA |
| 21789 | UGUGCUGUC |
| 21790 | CUCGAG |
| 21791 | CUUCCUGUCAGA |
| 21792 | CUUCCCUUUGUCAGA |
| 21793 | GUGUUAUUCUUG |
| 21794 | GUGUCUUAAUUG |
| 21795 | GUGUUAGUCUUG |
| 21796 | UCAAGAG |
| 21797 | GGACAUCCAGGG |
| 21798 | GUGAAGCCACAGAUG |
| 21799 | GAUUCUAAAA | shRNAs of the disclosure may be generated exogenously by chemical synthesis, by in vitro transcription, or by cleavage of longer double-stranded RNA with Dicer or another appropriate nuclease with similar activity. Chemically synthesized siRNAs, produced from protected ribonucleoside phosphoramidites using a conventional DNA/RNA synthesizer, may be obtained from commercial suppliers such as Millipore Sigma (Houston, Tex.), Ambion Inc. (Austin, Tex.). Invitrogen (Carlsbad, Calif.), or Dharmacon (Lafayette, Colo.). siRNAs can be purified by extraction with a solvent or resin, precipitation, electrophoresis, chromatography, or a combination thereof, for example. Alternatively, siRNAs may be used with little if any purification to avoid losses due to sample processing. In some embodiments, shRNAs of the disclosure can be produced using an expression vector into which a nucleic acid encoding the double stranded RNA has been cloned, for example under control of a suitable promoter.

Pharmaceutical Compositions

The disclosure provides pharmaceutical compositions comprising immune cells expressing the engineered receptors of the disclosure and a pharmaceutically acceptable diluent, carrier or excipient. In some embodiments, the pharmaceutical composition is for use as a medicament in the treatment of cancer. In some embodiments, the cancer is breast cancer, bladder cancer, ovarian cancer, gastric cancer, salivary duct carcinoma, non-small cell lung cancer, pancreatic cancer, or colon cancer. In some embodiments, the cancer is breast cancer. In some embodiments, the cancer is gastric cancer.

Such compositions may comprise buffers such as neutral buffered saline, phosphate buffered saline and the like; carbohydrates such as glucose, mannose, sucrose or dextrans, mannitol; proteins; polypeptides or amino acids such as glycine; antioxidants; chelating agents such as EDTA or glutathione; and preservatives.

In some embodiments, the immune cell expresses both the first receptor and the second receptor. In some embodiments, at least about 50%, about 55%, about 60%, about 65%, about 70%, about 75%, about 80%, about 85%, about 90%, or about 95% of the immune cells express both the first receptor and the second receptor. In some embodiments, at least 90% of the immune cells express both the first receptor and the second receptor.

The disclosure provides pharmaceutical compositions comprising a plurality of immune cells of the disclosure, and a pharmaceutically acceptable carrier, diluent or excipient.

Formulations of a pharmaceutical composition suitable for parenteral administration typically generally comprise of immune cells combined with a pharmaceutically acceptable carrier, such as sterile water or sterile isotonic saline. Such formulations may be prepared, packaged, or sold in a form suitable for bolus administration or for continuous administration. Injectable formulations may be prepared, packaged, or sold in unit dosage form, such as in ampoules or in multi-dose containers containing a preservative. Formulations for parenteral administration include, but are not limited to, suspensions, solutions, emulsions in oily or aqueous vehicles, pastes, and the like. Such formulations may further comprise one or more additional ingredients including, but not limited to, suspending, stabilizing, or dispersing agents. Parenteral formulations also include aqueous solutions which may contain excipients such as salts, carbohydrates and buffering agents. Exemplary parenteral administration forms include solutions or suspensions in sterile aqueous solutions, for example, aqueous propylene glycol or dextrose solutions. Such dosage forms can be suitably buffered, if desired. Formulations for parenteral administration may be formulated to be immediate and/or modified release. Modified release formulations include delayed-, sustained-, pulsed-, controlled-, targeted and programmed release.

In some embodiments, the formulated composition comprising the immune cells is suitable for administration via injection. In some embodiments, the formulated composition comprising the immune cells is suitable for administration via infusion.

The pharmaceutical compositions of the present disclosure, which may conveniently be presented in unit dosage form, may be prepared according to conventional techniques well known in the pharmaceutical industry. Such techniques include the step of bringing into association the immune cells with the pharmaceutical carrier(s) or excipient(s), such as liquid carriers.

Aqueous suspensions may further contain substances that increase the viscosity of the suspension including, for example, sodium carboxymethylcellulose, sorbitol and/or dextran. The suspension may also contain stabilizers.

The compositions of the present disclosure may additionally contain other adjunct components conventionally found in pharmaceutical compositions. Thus, for example, the compositions may contain additional, compatible, pharmaceutically-active materials such as, for example, antipruritics, astringents, local anesthetics or anti-inflammatory agents, or may contain additional materials useful in physically formulating various dosage forms of the compositions of the present disclosure, such as dyes, preservatives, antioxidants, opacifiers, thickening agents and stabilizers. However, such materials, when added, should not unduly interfere with the biological activities of the immune cells of the compositions of the present disclosure.

The formulation or composition may also contain more than one active ingredient useful for the particular indication, disease, or condition being treated with the immune cells, where the respective activities do not adversely affect one another. Such active ingredients are suitably present in combination in amounts that are effective for the purpose intended. Thus, in some embodiments, the pharmaceutical composition further includes other pharmaceutically active agents or drugs, such as chemotherapeutic agents.

The pharmaceutical composition in some aspects can employ time-released, delayed release, and sustained release delivery systems such that the delivery of the composition occurs prior to, and with sufficient time to cause, sensitization of the site to be treated. Many types of release delivery systems are available and known. Such systems can avoid repeated administrations of the composition, thereby increasing convenience to the subject and the physician.

Administration can be effected in one dose, continuously or intermittently throughout the course of treatment. Single or multiple administrations can be carried out with the dose level and pattern being selected by the treating physician.

The pharmaceutical composition in some embodiments contains the immune cells in amounts effective to treat or prevent a cancer, such as a therapeutically effective or prophylactically effective amount. Therapeutic or prophylactic efficacy in some embodiments is monitored by periodic assessment of treated subjects. For repeated administrations over days, weeks or months, depending on the condition, the treatment can be repeated until a desired suppression of cancer signs or symptoms occurs. However, other dosage regimens may be useful and can be determined. The desired dosage can be delivered by a single bolus administration or infusion of the composition or by multiple bolus administrations or infusions of the composition.

Methods of Use

Provided herein are methods for selectively killing HER2-positive tumor cells having loss of heterozygosity at an allele encoding a non-target antigen in the HER2-positive cancer, comprising contacting the HER2-positive tumor cells with an immune cell comprising the engineered receptors of the disclosure. The cells may be, for example, in a tissue (e.g., in vivo) or in a mixed culture. In some embodiments, the non-target antigen is an HLA class I allele or a minor histocompatibility antigen (MiHA). In some embodiments, the HLA class I allele comprises HLA-A, HLA-B, HLA-C or HLA-E. In some embodiments, the HLA class I allele is HLA-A*02. In some embodiments, the non-target antigen is selected from the group consisting of HLA-A*02, HLA-A*01, HLA-A*03, HLA-A*11, HLA-B*07, and HLA-C*07.

Provided herein are methods of treating a subject in need thereof, comprising administering to the subject a therapeutically effective amount of a composition comprising immune cells comprising the engineered receptors of the disclosure.

In some embodiments, the method comprises treating a HER2+ cancer in a subject identified as having or suspected of having a loss of heterozygosity at an allele encoding a non-target antigen in the HER2+ cancer, comprising administering to the subject the immune cells described herein. In some embodiments, the immune cells are autologous. In some embodiments, the immune cells are allogeneic. In some embodiments, the non-target antigen is an HLA class I allele or a minor histocompatibility antigen (MiHA). In some embodiments, the HLA class I allele comprises HLA-A, HLA-B, HLA-C or HLA-E. In some embodiments, the HLA class I allele is HLA-A*02. In some embodiments, the non-target antigen is selected from the group consisting of HLA-A*02, HLA-A*01, HLA-A*03, HLA-A*11, HLA-B*07, and HLA-C*07.

The disclosure provides methods of making an immune cell therapy. In some embodiments, the method comprises transforming immune cells with the polynucleotide system described herein. In some embodiments, the polynucleotide system comprises one or more polynucleotides comprising polynucleotide sequences encoding: an activator receptor comprising an extracellular ligand binding domain specific to an erb-b2 receptor tyrosine kinase 2 (HER2) antigen; and an inhibitory receptor comprising an extracellular ligand binding domain specific to a non-target antigen that is not expressed by the cancer cell due to a loss of heterozygosity in the cancer cell.

In some embodiments, the method of treating a subject comprises providing immune cells from a subject suffering from or at risk for a HER2 positive (HER2+) cancer. In some embodiments, the method comprises transducing the immune cell with the polynucleotide system described herein.

The current method for adoptive cell therapy using autologous cells includes isolating immune cells from patient blood, performing a series of modifications on the isolated cells, and administering the cells to a patient (Papathanasiou et al. Cancer Gene Therapy. 27:799-809 (2020)). Providing immune cells from a subject suffering from or at risk for cancer or a hematological malignancy requires isolation of immune cell from the patient's blood, and can be accomplished through methods known in the art, for example, by leukapheresis. During leukapheresis, blood from a subject is extracted and the peripheral blood mononuclear cells (PBMCs) are separated, and the remainder of the blood is returned to the subject's circulation. The PBMCs are stored either frozen or cryopreserved as a sample of immune cells and provided for further processing steps, such as, e.g. the modifications described herein.

In some embodiments, the method of treating a subject described herein comprises modifications to immune cells from the subject comprising a series of modifications comprising enrichment, activation, genetic modification, expansion, formulation, and cryopreservation.

The disclosure provides enrichment steps that can be, for example, washing and fractionating methods known in the art for preparation of subject PBMCs for downstream procedures, e.g. the modifications described herein. For example, without limitation, methods can include devices to remove gross red blood cells and platelet contaminants, systems for size-based cell fractionation for the depletion of monocytes and the isolation of lymphocytes, and/or systems that allow the enrichment of specific subsets of T cells, such as, e.g. CD4+, CD8+, CD25+, or CD62L+ T cells. Following the enrichment steps, a target sub-population of immune cells will be isolated from the subject PMBCs for further processing. Those skilled in the art will appreciate that enrichment steps, as provided herein, may also encompass any newly discovered method, device, reagent or combination thereof.

The disclosure provides activation steps that can be any method known in the art to induce activation of immune cells, e.g. T cells, required for their ex vivo expansion. Immune cell activation can be achieved, for example, by culturing the subject immune cells in the presence of dendritic cells, culturing the subject immune cells in the presence of artificial antigen-presenting cells (AAPCs), or culturing the immune cells in the presence of irradiated K562-derived AAPCs. Other methods for activating subject immune cells can be, for example, culturing the immune cells in the presence of isolated activating factors and compositions, e.g. beads, surfaces, or particles functionalized with activating factors. Activating factors can include, for example, antibodies, e.g. anti-CD3 and/or anti-CD28 antibodies. Activating factors can also be, for example, cytokines, e.g. interleukin (IL)-2 or IL-21. Activating factors can also be costimulatory molecules, such as, for example, CD40, CD40L, CD70, CD80, CD83, CD86, CD137L, ICOSL, GITRL, and CD134L. Those skilled in the art will appreciate that activating factors, as provided herein, may also encompass any newly discovered activating factor, reagent, composition, or combination thereof that can activate immune cells.

The disclosure provides genetic modification steps for modifying the subject immune cells. In some embodiments, the genetic modification comprises transducing the immune cell with an engineered receptor. In some embodiments, the method comprises transducing the immune cell with a first vector comprising a sequence encoding the activator receptor and a second vector comprising a sequence encoding the inhibitory receptor, thereby producing an immune cell expressing the activator and inhibitory receptors.

The disclosure provides expansion steps for the genetically modified subject immune cells. Genetically modified subject immune cells can be expanded in any immune cell expansion system known in the art to generate therapeutic doses of immune cells for administration. For example, bioreactor bags for use in a system comprising controller pumps, and probes that allow for automatic feeding and waste removal can be used for immune cell expansion. Cell culture flasks with gas-permeable membranes at the base may be used for immune cell expansion. Any such system known in the art that enables expansion of immune cells for clinical use is encompassed by the expansion step provided herein. Immune cells are expanded in culture systems in media formulated specifically for expansion. Expansion can also be facilitated by culturing the immune cell of the disclosure in the presence of activation factors as described herein. Those skilled in the art will appreciate that expansion steps, as provided herein, may also encompass any newly discovered culture systems, media, or activating factors that can be used to expand immune cells.

The disclosure provides formulation and cryopreservation steps for the expanded genetically modified subject immune cells. Formulation steps provided include, for example, washing away excess components used in the preparation and expansion of immune cells of the methods of treatment described herein. Any pharmaceutically acceptable formulation medium or wash buffer compatible with immune cell known in the art may be used to wash, dilute/concentration immune cells, and prepare doses for administration. Formulation medium can be acceptable for administration of the immune cells, such as, for example crystalloid solutions for intravenous infusion. Cryopreservation can optionally be used to store immune cells long-term. Cryopreservation can be achieved using known methods in the art, including for example, storing cells in a cryopreservation medium containing cryopreservation components. Cryopreservation components can include, for example, dimethyl sulfoxide or glycerol. Immune cells stored in cryopreservation medium can be cryopreserved by reducing the storage temperature to −80° C. to −180° C.

In some embodiments, the method comprises administering immune cells described herein. In some embodiments, the method comprises administering a conditioning regimen prior to administering the immune cells described herein. In some embodiments, the conditioning regimen is lymphodepletion. A lymphodepletion regimen can include, for example, administration of alemtuzumab, cyclophosphamide, benduamustin, rituximab, pentostatin, and/or fludarabine. Lymphodepletion regimen can be administered in one or more cycles until the desired outcome of reduced circulating immune cells.

In some embodiments, the conditioning regimen comprises administering an agent that specifically targets, and reduces or eliminates CD52+ cells in the subject, and the immune cells are modified to reduce or eliminate CD52 expression.

In some embodiments, the method of treatment comprises determining the HLA germline type of the subject. In some embodiments, determining the HLA germline type comprises determining the presence of HLA-A*02:01 heterozygosity. In some embodiments, the HLA germline type is determined in bone marrow.

In some embodiments, the method of treatment comprises determining the level of expression of an activator ligand, e.g. a HER2 antigen. In some embodiments, the level of expression of an activator ligand is determined in tumor tissue samples from the subject. In some embodiments, the expression level of an activator ligand is determined using next generation sequencing. In some embodiments, the expression level of an activator ligand is determined using RNA sequencing. In some embodiments, the level of an activator ligand is determined using immunohistochemistry.

In some embodiments, the method of treatment comprises administering a therapeutically effective dose of immune cells in a subject in need thereof, wherein the subject is determined to be HLA germline HLA-A*02:01 heterozygous and have tumor tissue with activator expression and loss of HLA-A*02:01.

In some embodiments, a therapeutically effective dose of the immune cells described herein are administered. In some embodiments, the immune cells of the disclosure are administered by intravenous injection. In some embodiments, the immune cells of the disclosure are administered by intraperitoneal injection. In some embodiments, a therapeutically effective dose comprises about $0.5 \times 10^6$ cells, about $1 \times 10^6$ cells, about $2 \times 10^6$ cells, about $3 \times 10^6$ cells, $4 \times 10^6$ cells, about $5 \times 10^6$ cells, about $6 \times 10^6$ cells, about $7 \times 10^6$ cells, about $8 \times 10^6$ cells, about $9 \times 10^6$ cells, about $1 \times 10^7$, about $2 \times 10^7$, about $3 \times 10^7$, about $4 \times 10^7$, about $5 \times 10^7$, about $6 \times 10^7$, about $7 \times 10^7$, about $8 \times 10^7$, about $9 \times 10^7$, $1 \times 10^8$ cells, about $2 \times 10^8$ cells, about $3 \times 10^8$ cells, about $4 \times 10^8$ cells, about $5 \times 10^8$ cells, or about $6 \times 10^8$ cells. In some embodiments, a therapeutically effective dose comprises about $0.5 \times 10^6$ cells to about $6 \times 10^8$ cells, about $1 \times 10^6$ cells to about $5 \times 10^8$ cells, about $2 \times 10^6$ cells to about $5 \times 10^8$ cells, about $3 \times 10^6$ cells to about $4 \times 10^8$ cells, about $4 \times 10^6$ cells to about $3 \times 10^8$ cells, about $5 \times 10^6$ cells to about $2 \times 10^8$ cells, about $6 \times 10^6$ cells to about $1 \times 10^8$ cells, about $7 \times 10^6$ cells to about $9 \times 10^7$ cells, about $8 \times 10^6$ cells to about $8 \times 10^7$ cells, about $9 \times 10^6$ cells to about $7 \times 10^7$ cells, about $1 \times 10^7$ cells to about $6 \times 10^7$ cells, or about $2 \times 10^7$ cells to about $5 \times 10^7$ cells. In some embodiments, a therapeutically effective dose comprises about $0.5 \times 10^6$ cells to about $6 \times 10^8$ cells. The term "about" as referred to in a therapeutically dose, can be, for example, $\pm 0.5 \times 10^6$ cells, $\pm 0.5 \times 10^7$ cells, or $\pm 0.5 \times 10^8$ cells.

In some embodiments, the subject in need thereof has cancer. In some embodiments, the cancer is a HER2 positive (HER2+) cancer. Cancer is a disease in which abnormal cells divide without control and spread to nearby tissue. In some embodiments, the cancer comprises a liquid tumor or a solid tumor. Exemplary liquid tumors include leukemias and lymphomas. Exemplary solid tumors include sarcomas and carcinomas. Cancers can arise in virtually an organ in the body, including blood, bone marrow, lung, breast, colon, bone, central nervous system, pancreas, prostate and ovary. Further cancers that are solid tumors include, for example, prostate cancer, testicular cancer, breast cancer, brain cancer, pancreatic cancer, colon cancer, thyroid cancer, stomach cancer, lung cancer, ovarian cancer, Kaposi's sarcoma, skin cancer, squamous cell skin cancer, renal cancer, head and neck cancers, throat cancer, squamous carcinomas that form on the moist mucosal linings of the nose, mouth, throat, bladder cancer, osteosarcoma, cervical cancer, endometrial cancer, esophageal cancer, liver cancer, and kidney cancer. In some embodiments, the condition treated by the methods described herein is metastasis of melanoma cells, prostate cancer cells, testicular cancer cells, breast cancer cells, brain cancer cells, pancreatic cancer cells, colon cancer cells, thyroid cancer cells, stomach cancer cells, lung cancer cells, ovarian cancer cells, Kaposi's sarcoma cells, skin cancer cells, renal cancer cells, head or neck cancer cells, throat cancer cells, squamous carcinoma cells, bladder cancer cells, osteosarcoma cells, cervical cancer cells, endometrial cancer cells, esophageal cancer cells, liver cancer cells, or kidney cancer cells.

Any cancer wherein a plurality of the cancer cells express the first, activator ligand and do not express the second, inhibitor ligand is envisaged as within the scope of the instant disclosure. For example, HER2 positive cancers that can be treated using the methods described herein include breast cancer cell, bladder cancer cell, ovarian cancer cell, gastric cancer cell, a salivary duct carcinoma cell, a non-small cell lung cancer cell, a pancreatic cancer cell, or a colon cancer cell.

In some embodiments, a plurality of cancer cells do not express a polymorphic allele of COLEC12, APCDD1 or CXCL16. In some embodiments, a plurality of cancer cells do not express a non-target antigen. In some embodiments, a plurality of cancer cells do not express HLA-A*02. In some embodiments, the plurality of cancer cells do not express an allelic variant of HLA-A*02. In some embodiments, the plurality of cancer cells do not express HLA-A*01. In some embodiments, the plurality of cancer cells do not express HLA-A*03. In some embodiments, the plurality of cancer cells do not expression HLA-A*11. In some embodiments, the plurality of cancer cells do not express HLA-B*07. In some embodiments, the plurality of cancer cells do not expression HLA-C*07. For example, the cancer cells have lost an allele of COLEC12, APCDD1 or CXCL16, or HLA-A*02 through loss of heterozygosity at that locus.

Treating cancer can result in a reduction in size of a tumor. A reduction in size of a tumor may also be referred to as "tumor regression". Preferably, after treatment, tumor size is reduced by 5% or greater relative to its size prior to treatment; more preferably, tumor size is reduced by 10% or greater; more preferably, reduced by 20% or greater; more preferably, reduced by 30% or greater; more preferably, reduced by 40% or greater; even more preferably, reduced by 50% or greater; and most preferably, reduced by greater than 75% or greater. Size of a tumor may be measured by any reproducible means of measurement. The size of a tumor may be measured as a diameter of the tumor.

Treating cancer can result in a reduction in tumor volume. Preferably, after treatment, tumor volume is reduced by 5% or greater relative to its size prior to treatment; more preferably, tumor volume is reduced by 10% or greater; more preferably, reduced by 20% or greater; more preferably, reduced by 30% or greater; more preferably, reduced by 40% or greater; even more preferably, reduced by 50% or greater; and most preferably, reduced by greater than 75% or greater. Tumor volume may be measured by any reproducible means of measurement.

Treating cancer results in a decrease in number of tumors. Preferably, after treatment, tumor number is reduced by 5% or greater relative to number prior to treatment; more preferably, tumor number is reduced by 10% or greater; more preferably, reduced by 20% or greater; more preferably, reduced by 30% or greater; more preferably, reduced by 40% or greater; even more preferably, reduced by 50% or greater; and most preferably, reduced by greater than 75%. Number of tumors may be measured by any reproducible means of measurement. The number of tumors may be measured by counting tumors visible to the naked eye or at a specified magnification. Preferably, the specified magnification is 2×, 3×, 4×, 5×, 10×, or 50×.

Treating cancer can result in a decrease in number of metastatic lesions in other tissues or organs distant from the primary tumor site. Preferably, after treatment, the number of metastatic lesions is reduced by 5% or greater relative to number prior to treatment; more preferably, the number of metastatic lesions is reduced by 10% or greater; more preferably, reduced by 20% or greater; more preferably, reduced by 30% or greater; more preferably, reduced by 40% or greater; even more preferably, reduced by 50% or greater; and most preferably, reduced by greater than 75%. The number of metastatic lesions may be measured by any reproducible means of measurement. The number of metastatic lesions may be measured by counting metastatic lesions visible to the naked eye or at a specified magnification. Preferably, the specified magnification is 2×, 3×, 4×, 5×, 10×, or 50×.

Treating cancer can result in an increase in average survival time of a population of treated subjects in comparison to a population receiving carrier alone. Preferably, the average survival time is increased by more than 30 days; more preferably, by more than 60 days; more preferably, by more than 90 days; and most preferably, by more than 120 days. An increase in average survival time of a population may be measured by any reproducible means. An increase in average survival time of a population may be measured, for example, by calculating for a population the average length of survival following initiation of treatment with an active compound. An increase in average survival time of a population may also be measured, for example, by calculating for a population the average length of survival following completion of a first round of treatment with an active compound.

Treating cancer can result in an increase in average survival time of a population of treated subjects in comparison to a population of untreated subjects. Preferably, the average survival time is increased by more than 30 days; more preferably, by more than 60 days; more preferably, by more than 90 days; and most preferably, by more than 120 days. An increase in average survival time of a population may be measured by any reproducible means. An increase in average survival time of a population may be measured, for example, by calculating for a population the average length of survival following initiation of treatment with an active compound. An increase in average survival time of a population may also be measured, for example, by calculating for a population the average length of survival following completion of a first round of treatment with an active compound.

Treating cancer can result in increase in average survival time of a population of treated subjects in comparison to a population receiving monotherapy with a drug that is not a compound of the present invention, or a pharmaceutically acceptable salt, prodrug, metabolite, analog or derivative thereof. Preferably, the average survival time is increased by more than 30 days; more preferably, by more than 60 days; more preferably, by more than 90 days; and most preferably, by more than 120 days. An increase in average survival time of a population may be measured by any reproducible means. An increase in average survival time of a population may be measured, for example, by calculating for a population the average length of survival following initiation of treatment with an active compound. An increase in average survival time of a population may also be measured, for example, by calculating for a population the average length of survival following completion of a first round of treatment with an active compound.

Treating cancer can result in a decrease in the mortality rate of a population of treated subjects in comparison to a population receiving carrier alone. Treating cancer can result in a decrease in the mortality rate of a population of treated subjects in comparison to an untreated population. Treating cancer can result in a decrease in the mortality rate of a population of treated subjects in comparison to a population receiving monotherapy with a drug that is not a compound of the present invention, or a pharmaceutically acceptable salt, prodrug, metabolite, analog or derivative thereof. Preferably, the mortality rate is decreased by more than 2%; more preferably, by more than 5%; more preferably, by more than 10%; and most preferably, by more than 25%. A decrease in the mortality rate of a population of treated subjects may be measured by any reproducible means. A decrease in the mortality rate of a population may be measured, for example, by calculating for a population the average number of disease-related deaths per unit time following initiation of treatment with an active compound. A decrease in the mortality rate of a population may also be measured, for example, by calculating for a population the average number of disease-related deaths per unit time following completion of a first round of treatment with an active compound.

Treating cancer can result in a decrease in tumor growth rate. Preferably, after treatment, tumor growth rate is reduced by at least 5% relative to number prior to treatment; more preferably, tumor growth rate is reduced by at least 10%; more preferably, reduced by at least 20%; more preferably, reduced by at least 30%; more preferably, reduced by at least 40%; more preferably, reduced by at least 50%; even more preferably, reduced by at least 50%; and most preferably, reduced by at least 75%. Tumor growth rate may be measured by any reproducible means of measurement. Tumor growth rate can be measured according to a change in tumor diameter per unit time.

Treating cancer can result in a decrease in tumor regrowth. Preferably, after treatment, tumor regrowth is less than 5%; more preferably, tumor regrowth is less than 10%; more preferably, less than 20%; more preferably, less than 30%; more preferably, less than 40%; more preferably, less than 50%; even more preferably, less than 50%; and most preferably, less than 75%. Tumor regrowth may be measured by any reproducible means of measurement. Tumor regrowth is measured, for example, by measuring an increase in the diameter of a tumor after a prior tumor shrinkage that followed treatment. A decrease in tumor regrowth is indicated by failure of tumors to reoccur after treatment has stopped.

Treating or preventing a cell proliferative disorder can result in a reduction in the rate of cellular proliferation. Preferably, after treatment, the rate of cellular proliferation is reduced by at least 5%; more preferably, by at least 10%; more preferably, by at least 20%; more preferably, by at least 30%; more preferably, by at least 40%; more preferably, by at least 50%; even more preferably, by at least 50%; and most preferably, by at least 75%. The rate of cellular proliferation may be measured by any reproducible means of measurement. The rate of cellular proliferation is measured, for example, by measuring the number of dividing cells in a tissue sample per unit time.

Treating or preventing a cell proliferative disorder can result in a reduction in the proportion of proliferating cells. Preferably, after treatment, the proportion of proliferating cells is reduced by at least 5%; more preferably, by at least 10%; more preferably, by at least 20%; more preferably, by at least 30%; more preferably, by at least 40%; more preferably, by at least 50%; even more preferably, by at least 50%; and most preferably, by at least 75%. The proportion of proliferating cells may be measured by any reproducible means of measurement. Preferably, the proportion of proliferating cells is measured, for example, by quantifying the number of dividing cells relative to the number of nondividing cells in a tissue sample. The proportion of proliferating cells can be equivalent to the mitotic index.

Treating or preventing a cell proliferative disorder can result in a decrease in size of an area or zone of cellular proliferation. Preferably, after treatment, size of an area or zone of cellular proliferation is reduced by at least 5% relative to its size prior to treatment; more preferably, reduced by at least 10%; more preferably, reduced by at least 20%; more preferably, reduced by at least 30%; more preferably, reduced by at least 40%; more preferably, reduced by at least 50%; even more preferably, reduced by at least 50%; and most preferably, reduced by at least 75%. Size of an area or zone of cellular proliferation may be measured by any reproducible means of measurement. The size of an area or zone of cellular proliferation may be measured as a diameter or width of an area or zone of cellular proliferation.

Treating or preventing a cell proliferative disorder can result in a decrease in the number or proportion of cells having an abnormal appearance or morphology. Preferably, after treatment, the number of cells having an abnormal morphology is reduced by at least 5% relative to its size prior to treatment; more preferably, reduced by at least 10%; more preferably, reduced by at least 20%; more preferably, reduced by at least 30%; more preferably, reduced by at least 40%; more preferably, reduced by at least 50%; even more preferably, reduced by at least 50%; and most preferably, reduced by at least 75%. An abnormal cellular appearance or morphology may be measured by any reproducible means of measurement. An abnormal cellular morphology can be measured by microscopy, e.g., using an inverted tissue culture microscope. An abnormal cellular morphology can take the form of nuclear pleomorphism.

The disclosure provides methods of treating a cancer in a subject comprising: (a) determining the genotype of normal cells and a plurality of cancer cells of the subject at a polymorphic locus selected from the group consisting of a polymorphic locus of COLEC12, a polymorphic locus of APCDD1 and a polymorphic locus of CXCL16, or the HLA-A*02 locus; (b) determining the expression of HER2 in a plurality of cancer cells; and (c) administering a plurality of immune cells to the subject if the normal cells are heterozygous for the polymorphic locus and the plurality of cancer cells are hemizygous for the polymorphic locus or have lost HLA-A*02, and the plurality of cancer cells are HER2-positive, wherein the plurality of immune cells comprise: (i) a first receptor, optionally a chimeric antigen receptor (CAR) or T cell receptor (TCR), comprising an extracellular ligand binding domain specific to HER2, or a peptide antigen thereof in a complex with a major histocompatibility complex class I (MHC-I); and (ii) a second receptor, optionally an inhibitory chimeric antigen receptor (i.e. inhibitory receptors), comprising an extracellular ligand binding specific to a non-target antigen selected from COLEC12, APCDD1, and CXCL16, or an antigen peptide thereof in a complex with an a major histocompatibility complex class I (MHC-I), or HLA-A*02, wherein the non-target antigen comprises a polymorphism.

Methods of genotyping cancer cells and normal cells from a subject for the presence or absence of SNPs will be readily apparent to persons of ordinary skill in the art. SNP genotyping methods include, inter alia, PCR based methods such as dual-probe TaqMan assays, array based hybridization methods and sequencing.

Methods of measuring the expression of the target antigen in cancer or normal cells from a subject will be readily apparent to persons of ordinary skill in the art. These include, inter alia, methods of measuring RNA expression such as RNA sequencing and reverse transcription polymerase chain reaction (RT-PCR), as well as methods of measuring protein expression such as immunohistochemistry based methods. Methods of measuring loss of heterozygosity in a plurality of cancer cells, include, inter alia, high throughput sequencing of genomic DNA extracted from cancer cells using methods known in the art.

Methods of measuring the expression of the target antigen in cancer or normal cells from a subject will be readily apparent to persons of ordinary skill in the art. These include, inter alia, methods of measuring RNA expression such as RNA sequencing and reverse transcription polymerase chain reaction (RT-PCR), as well as methods of measuring protein expression such as immunohistochemistry based methods.

In some embodiments, the immune cells are T cells.

In some embodiments, the immune cells are allogeneic or autologous.

In some embodiments, the second receptor increases the specificity of the immune cells for the HER2-positive cancer cells compared to immune cells that express the first receptor but do not express the second receptor. In some embodiments, the immune cells have reduced side effects compared to immune cells that express the first receptor but do not express the second receptor.

Dosage and Administration

The immune cells and of the present disclosure may be administered in a number of ways depending upon whether local or systemic treatment is desired.

In general, administration may be parenteral.

Methods for administration of cells for adoptive cell therapy are known and may be used in connection with the provided methods and compositions. For example, adoptive T cell therapy methods are described, e.g., in US Patent Application Publication No. 2003/0170238 to Gruenberg et al and U.S. Pat. No. 4,690,915 to Rosenberg.

The compositions of the disclosure are suitable for parenteral administration. As used herein, "parenteral administration" of a pharmaceutical composition includes any route of administration characterized by physical breaching of a tissue of a subject and administration of the pharmaceutical composition through the breach in the tissue, thus generally resulting in the direct administration into the blood stream, into muscle, or into an internal organ. Parenteral administration thus includes, but is not limited to, administration of a pharmaceutical composition by injection of the composition, by application of the composition through a surgical incision, by application of the composition through a tissue-penetrating non-surgical wound, and the like. In particular, parenteral administration is contemplated to include, but is not limited to, subcutaneous, intraperitoneal, intramuscular, intrasternal, intravenous, intraarterial, intrathecal, intraventricular, intraurethral, intracranial, intratumoral, intrasynovial injection or infusions; and kidney dialytic infusion techniques. In some embodiments, parenteral administration of the compositions of the present disclosure comprises intravenous or intraarterial administration.

The cells or population of cells can be administrated in one or more doses. In some embodiments, an effective amount of cells can be administrated as a single dose. In some embodiments, an effective amount of cells can be administrated as more than one doses over a period time. Timing of administration is within the judgment of a managing physician and depends on the clinical condition of the patient.

The cells or population of cells may be obtained from any source, such as a blood bank or a donor, or the patient themselves.

An effective amount means an amount which provides a therapeutic or prophylactic benefit. The dosage administered will be dependent upon the age, health and weight of the recipient, kind of concurrent treatment, if any, frequency of treatment and the nature of the effect desired. In some embodiments, an effective amount of cells or composition comprising those cells are administrated parenterally. In some embodiments, administration can be an intravenous administration. In some embodiments, administration can be directly done by injection within a tumor.

For purposes of the disclosure, an assay, which comprises, for example, comparing the extent to which target cells are lysed or one or more cytokines are secreted by immune cells expressing the receptors, upon administration of a given dose of such immune cells to a mammal, among a set of mammals of which is each given a different dose of the immune cells, can be used to determine a starting dose to be administered to a mammal.

In some embodiments, the cells are administered as part of a combination treatment, such as simultaneously with or sequentially with, in any order, another therapeutic intervention, such as an antibody or engineered cell or receptor or agent, such as a cytotoxic or therapeutic agent. The immune cells of the disclosure are in some embodiments are co-administered with one or more additional therapeutic agents or in connection with another therapeutic intervention, either simultaneously or sequentially in any order. In some contexts, the immune cells are co-administered with another therapy sufficiently close in time such that the immune cell populations enhance the effect of one or more additional therapeutic agents, or vice versa. In some embodiments, the immune cells are administered prior to the one or more additional therapeutic agents. In some embodiments, the immune cells are administered after to the one or more additional therapeutic agents.

In embodiments, a lymphodepleting chemotherapy is administered to the subject prior to, concurrently with, or after administration (e.g., infusion) of adoptive immune cells. In an example, the lymphodepleting chemotherapy is administered to the subject prior to administration of the immune cells. For example, the lymphodepleting chemotherapy ends 1-4 days (e.g., 1, 2, 3, or 4 days) prior to adoptive cell infusion. In embodiments, multiple doses of adoptive cells are administered, e.g., as described herein. In embodiments, a lymphodepleting chemotherapy is administered to the subject prior to, concurrently with, or after administration (e.g., infusion) of the immune cells described herein. Examples of lymphodepletion include, but may not be limited to, nonmyeloablative lymphodepleting chemotherapy, myeloablative lymphodepleting chemotherapy, total body irradiation, etc. Examples of lymphodepleting agents include, but are not limited to, antithymocyte globulin, anti-CD3 antibodies, anti-CD4 antibodies, anti-CD8 antibodies, anti-CD52 antibodies, anti-CD2 antibodies, TCRαβ blockers, anti-CD20 antibodies, anti-CD19 antibodies, Bortezomib, rituximab, anti-CD 154 antibodies, rapamycin, CD3 immunotoxin, fludarabine, cyclophosphamide, busulfan, melphalan, Mabthera, Tacrolimus, alefacept, alemtuzumab, OKT3, OKT4, OKT8, OKT11, fingolimod, anti-CD40 antibodies, anti-BR3 antibodies, Campath-1H, anti-CD25 antibodies, calcineurin inhibitors, mycophenolate, and steroids, which may be used alone or in combination. As a further example, a lymphodepletion regimen can include, administration of alemtuzumab, cyclophosphamide, benduamustin, rituximab, pentostatin, and/or fludarabine. Lymphodepletion regimen can be administered in one or more cycles until the desired outcome of reduced circulating immune cells. In some embodiments, the lymphodepletion comprises administering an agent that specifically targets, and reduces or eliminates CD52+ cells in the subject, and the immune cells are modified to reduce or eliminate CD52 expression.

In some embodiments, an immune stimulating therapy is administered to the subject prior to, concurrently with, or after administration (e.g. infusion) of adoptive immune cells. In some embodiments, the immune stimulating therapy comprises homeostatic cytokines. In some embodiments, the immune stimulating therapy comprises immune-stimulatory molecules. In some embodiments, the immune stimulating therapy comprises IL-2, IL-7, IL-12, IL-15, IL-21, IL-9, or a functional fragment thereof. In some embodiments, the immune stimulating therapy comprises IL-2, IL-7, IL-12, IL-15, IL-21, IL-9, or combinations thereof. In some embodiments, the immune stimulating therapy comprises IL-2, or a functional fragment thereof.

Methods for adoptive cell therapy using autologous cells includes isolating immune cells from patient blood, performing a series of modifications on the isolated cells including transducing the cells with one or more vectors encoding the dual receptor system described herein, and administering the cells to a patient. Providing immune cells from a subject suffering from or at risk for cancer or a hematological malignancy requires isolation of immune cell from the patient's blood, and can be accomplished through methods known in the art, for example, by leukapheresis. During leukapheresis, blood from a subject is extracted and the peripheral blood mononuclear cells (PBMCs) are separated, and the remainder of the blood is returned to the subject's circulation. The PBMCs are stored either frozen or cryopreserved as a sample of immune cells and provided for further processing steps, such as, e.g. the modifications described herein.

In some embodiments, the method of treating a subject described herein comprises modifications to immune cells from the subject comprising a series of modifications comprising enrichment and/or depletion, activation, genetic modification, expansion, formulation, and cryopreservation.

The disclosure provides enrichment and/or depletion steps that can be, for example, washing and fractionating methods known in the art for preparation of subject PBMCs for downstream procedures, e.g. the modifications described herein. For example, without limitation, methods can include devices to remove gross red blood cells and platelet contaminants, systems for size-based cell fractionation for the depletion of monocytes and the isolation of lymphocytes, and/or systems that allow the enrichment or depletion of specific subsets of T cells, such as, e.g. CD4+, CD8+, CD25+, or CD62L+ T cells. Following the enrichment steps, a target sub-population of immune cells will be isolated from the subject PMBCs for further processing. Those skilled in the art will appreciate that enrichment steps, as provided herein, may also encompass any newly discovered method, device, reagent or combination thereof.

The disclosure provides activation steps that can be any method known in the art to induce activation of immune cells, e.g. T cells, required for their ex vivo expansion. Immune cell activation can be achieved, for example, by culturing the subject immune cells in the presence of dendritic cells, culturing the subject immune cells in the presence of artificial antigen-presenting cells (AAPCs), or culturing the immune cells in the presence of irradiated K562-derived AAPCs. Other methods for activating subject immune cells can be, for example, culturing the immune cells in the presence of isolated activating factors and compositions, e.g. beads, surfaces, or particles functionalized with activating factors. Activating factors can include, for example, antibodies, e.g. anti-CD3 and/or anti-CD28 antibodies. Activating factors can also be, for example, cytokines, e.g. interleukin (IL)-2 or IL-21. Activating factors can also be costimulatory molecules, such as, for example, CD40, CD40L, CD70, CD80, CD83, CD86, CD137L, ICOSL, GITRL, and CD134L. Those skilled in the art will appreciate that activating factors, as provided herein, may also encompass any newly discovered activating factor, reagent, composition, or combination thereof that can activate immune cells.

The disclosure provides genetic modification steps for modifying the subject immune cells. In some embodiments, the genetic modification comprises transducing the immune cell with a vector comprising a shRNA described herein complementary to B2M or HLA-A. In some embodiments, the genetic modification comprises modifying the genome of the immune cells to induce mutations in B2M or HLA-A using CRISPR/Cas mediated genome engineering. In some embodiments, the method comprises transducing the immune cell with one or more vectors encoding the activator and inhibitory receptors, thereby producing immune cells expressing the activator and inhibitory receptors.

The disclosure provides expansion steps for the genetically modified subject immune cells. Genetically modified subject immune cells can be expanded in any immune cell expansion system known in the art to generate therapeutic doses of immune cells for administration. For example, bioreactor bags for use in a system comprising controller pumps, and probes that allow for automatic feeding and waste removal can be used for immune cell expansion. Cell culture flasks with gas-permeable membranes at the base may be used for immune cell expansion. Any such system known in the art that enables expansion of immune cells for clinical use is encompassed by the expansion step provided herein. Immune cells are expanded in culture systems in media formulated specifically for expansion. Expansion can also be facilitated by culturing the immune cell of the disclosure in the presence of activation factors as described herein. Those skilled in the art will appreciate that expansion steps, as provided herein, may also encompass any newly discovered culture systems, media, or activating factors that can be used to expand immune cells.

The disclosure provides formulation and cryopreservation steps for the expanded genetically modified subject immune cells. Formulation steps provided include, for example, washing away excess components used in the preparation and expansion of immune cells of the methods of treatment described herein. Any pharmaceutically acceptable formulation medium or wash buffer compatible with immune cell known in the art may be used to wash, dilute/concentration immune cells, and prepare doses for administration. Formulation medium can be acceptable for administration of the immune cells, such as, for example crystalloid solutions for intravenous infusion.

Cryopreservation can optionally be used to store immune cells long-term. Cryopreservation can be achieved using known methods in the art, including for example, storing cells in a cryopreservation medium containing cryopreservation components. Cryopreservation components can include, for example, dimethyl sulfoxide or glycerol. Immune cells stored in cryopreservation medium can be cryopreserved by reducing the storage temperature to −80° C. to −196° C.

In some embodiments, the method of treatment comprises determining the HLA germline type of the subject. In some embodiments, the HLA germline type is determined in bone marrow.

In some embodiments, the method of treatment comprises determining the level of expression of HER2. In some embodiments, the level of expression of HER2 is determined in tumor tissue samples from the subject. In some embodiments, the expression level of HER2 is determined using next generation sequencing. In some embodiments, the expression level of HER2 is determined using RNA sequencing. In some embodiments, the level of HER2 is determined using immunohistochemistry.

In some embodiments, the method of treatment comprises administering a therapeutically effective dose of immune cells comprising an HLA-A*02 inhibitory receptor to a subject in need thereof, wherein the subject is determined to be HLA germline HLA-A*02 heterozygous and have cancer cells with loss of HLA-A*02. In some embodiments, the method of treatment comprises administering a therapeutically effective dose of immune cells comprising an HLA-A*01 inhibitory receptor to a subject in need thereof, wherein the subject is determined to be HLA germline HLA-A*01 heterozygous and have cancer cells with loss of HLA-A*01. In some embodiments, the method of treatment comprises administering a therapeutically effective dose of immune cells comprising an HLA-A*03 to a subject in need thereof, wherein the subject is determined to be HLA germline HLA-A*03 heterozygous and have cancer cells with loss of HLA-A*03. In some embodiments, the method of treatment comprises administering a therapeutically effective dose of immune cells comprising an HLA-A*07 inhibitory receptor to a subject in need thereof, wherein the subject is determined to be HLA germline HLA-A*07 heterozygous and have cancer cells with loss of HLA-A*07. In some embodiments, the method of treatment comprises administering a therapeutically effective dose of immune cells comprising an HLA-C*07 inhibitory receptor to a subject in need thereof, wherein the subject is determined to be HLA germline HLA-C*07 heterozygous and have cancer cells with and loss of HLA-C*07. In some embodiments, the method of treatment comprises administering a therapeutically effective dose of immune cells comprising an HLA-B*07 inhibitory receptor in a subject in need thereof, wherein the subject is determined to be HLA germline HLA-B*07 heterozygous and have cancer cells with loss of HLA-B*07.

In various embodiments, the disclosure provides method of treatment of heterozygous HLA-A*02 patients with malignancies that express HER2 and have lost HLA-A*02 expression; and/or of treatment of heterozygous HLA-A*02 adult patients with recurrent unresectable or metastatic solid tumors that express HER2 and have lost HLA-A*02 expression.

In some embodiments, a therapeutically effective dose of the immune cells described herein are administered. In some embodiments, the immune cells of the disclosure are administered by intravenous injection. In some embodiments, the immune cells of the disclosure are administered by intraperitoneal injection. In some embodiments, a therapeutically effective dose comprises about $0.5 \times 10^6$ cells, about $1 \times 10^6$ cells, about $2 \times 10^6$ cells, about $3 \times 10^6$ cells, $4 \times 10^6$ cells, about $5 \times 10^6$ cells, about $6 \times 10^6$ cells, about $7 \times 10^6$ cells, about $8 \times 10^6$ cells, about $9 \times 10^6$ cells, about $1 \times 10^7$, about $2 \times 10^7$, about $3 \times 10^7$, about $4 \times 10^7$, about $5 \times 10^7$, about $6 \times 10^7$, about $7 \times 10^7$, about $8 \times 10^7$, about $9 \times 10^7$, about $1 \times 10^8$ cells, about $2 \times 10^8$ cells, about $3 \times 10^8$ cells, about $4 \times 10^8$ cells, about $5 \times 10^8$ cells, about $6 \times 10^8$ cells, about $7 \times 10^8$ cells, about $8 \times 10^8$ cells, about $9 \times 10^8$ cells, about $1 \times 10^9$ cells, about $2 \times 10^9$ cells, about $3 \times 10^9$ cells, about $3 \times 10^9$ cells, about $4 \times 10^9$ cells, about $5 \times 10^9$ cells, about $5 \times 10^9$ cells, about $6 \times 10^9$ cells, about $7 \times 10^9$ cells, about $8 \times 10^9$ cells, about $9 \times 10^9$ cells, about $1 \times 10^{10}$ cells, about $2 \times 10^{10}$ cells, about $3 \times 10^{10}$ cells, about $4 \times 10^{10}$ cells, about $5 \times 10^{10}$ cells, about $6 \times 10^{10}$ cells, about $7 \times 10^{10}$ cells, about $8 \times 10^{10}$ cells, or about $9 \times 10^{10}$ cells.

In some embodiments, a therapeutically effective dose comprises about $0.5 \times 106$ cells to about $9 \times 10^{10}$ cells, about $1 \times 10^6$ cells to about $5 \times 10^{10}$ cells, about $2 \times 10^6$ cells to about $5 \times 10^9$ cells, about $3 \times 10^6$ cells to about $5 \times 10^9$ cells, $4 \times 10^6$ cells to about $3 \times 10^9$ cells, about $5 \times 10^6$ cells to about $2 \times 10^9$ cells, about $6 \times 10^6$ cells to about $1 \times 10^9$ cells, $0.5 \times 10^6$ cells to about $6 \times 10^9$ cells, about $1 \times 10^6$ cells to about $5 \times 10^9$ cells, about $2 \times 10^6$ cells to about $5 \times 10^9$ cells, about $3 \times 10^6$ cells to about $4 \times 10^9$ cells, about $4 \times 10^6$ cells to about $3 \times 10^9$ cells, about $5 \times 10^6$ cells to about $2 \times 10^9$ cells, about $6 \times 10^6$ cells to about $1 \times 10^9$ cells, $0.5 \times 10^6$ cells to about $6 \times 10^8$ cells, about $1 \times 10^6$ cells to about $5 \times 10^8$ cells, about $2 \times 10^6$ cells to about $5 \times 10^8$ cells, about $3 \times 10^6$ cells to about $4 \times 10^8$ cells, about $4 \times 10^6$ cells to about $3 \times 10^8$ cells, about $5 \times 10^6$ cells to about $2 \times 10^8$ cells, about $6 \times 10^6$ cells to about $1 \times 10^8$ cells, about $7 \times 10^6$ cells to about $9 \times 10^8$ cells, about $8 \times 10^6$ cells to about $8 \times 10^8$ cells, about $9 \times 10^6$ cells to about $7 \times 10^8$ cells, about $1 \times 10^7$ cells to about $6 \times 10^8$ cells, about $2 \times 10^7$ cells to about $5 \times 10^8$ cells, about $7 \times 10^6$ cells to about $9 \times 10^7$ cells, about $8 \times 10^6$ cells to about $8 \times 10^7$ cells, about $9 \times 10^6$ cells to about $7 \times 10^7$ cells, about $1 \times 10^7$ cells to about $6 \times 10^7$ cells, or about $2 \times 10^7$ cells to about $5 \times 10^7$ cells.

In some embodiments, a therapeutically effective dose comprises about $0.5 \times 10^5$ cells to about $9 \times 10^{10}$ cells. In some embodiments, a therapeutically effective dose comprises about $0.5 \times 10^6$ cells to about $1 \times 10^{10}$ cells. In some embodiments, a therapeutically effective dose comprises about $0.5 \times 10^6$ cells to about $5 \times 10^9$ cells. In some embodiments, a therapeutically effective dose comprises about $0.5 \times 10^6$ cells to about $1 \times 10^9$ cells. In some embodiments, a therapeutically effective dose comprises about $0.5 \times 10^6$ cells to about $6 \times 10^8$ cells. In some embodiments, a therapeutically effective dose comprises about $0.5 \times 10^6$ cells to about $9 \times 10^{10}$ cells. In some embodiments, a therapeutically effective dose comprises about $0.5 \times 10^7$ cells to about $1 \times 10^{10}$ cells. In some embodiments, a therapeutically effective dose comprises about $0.5 \times 10^7$ cells to about $5 \times 10^9$ cells. In some embodiments, a therapeutically effective dose comprises about $0.5 \times 10^7$ cells to about $1 \times 10^9$ cells. In some embodiments, a therapeutically effective dose comprises about $0.5 \times 10^7$ cells to about $6 \times 10^8$ cells. In some embodiments, a therapeutically effective dose comprises about $0.5 \times 10^8$ cells to about $9 \times 10^{10}$ cells. In some embodiments, a therapeutically effective dose comprises about $0.5 \times 10^8$ cells to about $1 \times 10^{10}$ cells. In some embodiments, a therapeutically effective dose comprises about $0.5 \times 10^8$ cells to about $5 \times 10^9$ cells. In some embodiments, a therapeutically effective dose comprises about $0.5 \times 10^8$ cells to about $1 \times 10^9$ cells. The term "about" as referred to in a therapeutically dose, can be, for example, $\pm 0.5 \times 10^6$ cells, $\pm 0.5 \times 10^7$ cells, or $\pm 0.5 \times 10^8$ cells.

Kits and Articles of Manufacture

The disclosure provides kits and articles of manufacture comprising the polynucleotides and vectors encoding the engineered receptors described herein, and immune cells edited using gene editing systems described herein and comprising the engineered receptors described herein. In some embodiments, the kit comprises articles such as vials, syringes and instructions for use.

In some embodiments, the kit comprises a polynucleotide or vector comprising a sequence encoding one or more engineered receptors of the disclosure.

In some embodiments, the kit comprises a plurality of immune cells comprising an engineered receptor as described herein. In some embodiments, the plurality of immune cells comprises a plurality of T cells.

EXAMPLES

Example 1: Methods of Assaying HER2 CAR Activity in Jurkat and Primary T Cells

Cell Culture

Jurkat cells encoding an NFAT luciferase reporter were obtained from BPS Bioscience. In culture, Jurkat cells were maintained in RPMI media supplemented with 10% FBS, 1% Pen/Strep and 0.4 mg/mL G418/Geneticin. HCT.116 and HeLa cells were maintained as suggested by ATCC.

Jurkat Cell Transfection

Jurkat cells were transiently transfected via 100 uL or 20 ul format 4D Nucleofactor (Lonza) according to manufacturer's protocol. Cotransfection was performed with 1-3 ug of activator receptor construct and 1-3 ug of inhibitory receptor constructs or empty vector per 1e6 cells and recovered in RPMI media supplemented with 20% heat-inactivated FBS and 0.1% Pen/Strep. To confirm inhibitory receptor surface expression, Jurkat cells were stained 18-24 hours post-transfection with 10 ug/mL streptavidin-PE-HLA-A*02-pMHC tetramer for 60 minutes at 4° C. in PBS with 1% BSA and characterized by flow cytometry (BD FACSCanto II).

Jurkat-NFAT-Luciferase Activation Studies

Briefly, Jurkat NFAT-Firefly-Luciferase cells were transfected with activator and inhibitory (blocker) receptor constructs using Lonza 4D Nucleofector™ (AAF-1002B) or Neon™ transfection systems (ThermoFisher, MPK5000). mRNA transfected target cells (10,000 cells/well), activator only or activator/blocker expressing target cells at different densities, were added to transfected Jurkat-NFAT-Firefly-Luciferase cells (12,000 cells/well) to a final volume of 20 mL in 384-well plates (Corning 3570). After a 6-hour incubation at 37° C., the One-Step™ Luciferase firefly assay system (BPS Bioscience, 60690) was used to determine luminescence intensity on a Tecan Infinite® M1000.

Solid Substrate Antigen Titration

Biotinylated pMHCs were added to streptavidin-coated plates with and without biotinylated recombinant CD28 agonist, biotinylated recombinant PD-L1, or both at concentrations equimolar to the highest pMHC molarity. Mouse IgG1 was used as a control to ensure the binding capacity of the well was not exceeded. The unbound molecules were washed off and transduced T-cells were added. Half of the T-cells were recovered and stained with anti-CD69 at 24 hours and the rest were stained with anti-CD25 at 48 hours.

Activator mRNA Titration

HER2 or HLA-A2 mRNA were synthesized as described below and were diluted two fold 12 times. Each dilution of mRNA was mixed with two million Her2 knock-out HeLa cells (Her2−/HLA-A2−) and electroporated using 4D Nucleofactor. mRNA transfected target cells were then co-cultured with Jurkat cells transfected with HER2 CAR or blocker receptor for 6 hours before the degree of activation was measured as described above.

In Vitro Transcription of mRNA

HER2 sequence was synthesized by Genscript with T7 promoter in the 5' end together with 5' and 3' synthetic UTR sequences. In vitro transcription was done in 1×IVT buffer (40 mM Tris, 10 mM DTT, 2 mM Spermidine, 0.002% Triton X-100, and 27 mM $MgCl_2$) with T7 RNA polymerase (NEB, M0251S), Inorganic pyrophosphatase (NEB, M2403S) and murine RNase inhibitor (NEB, M0314S). In addition, 500 ng PCR purified template, 5 mM CleanCap Cap1 AG trimer, 5 mM each of ATP, CTP, GTP and pseudo-uridine triphosphate (pseudo-UTP) were added, and the transcription reaction was incubated at 37° C. for 2 hours, followed by addition of DNase I (NEB, M0303S) for additional 15 minutes incubation at 37° C.

In vitro transcription reaction was finalized by the addition of poly A tailing with poly A enzyme (NEB, M0276S) and incubation at 37° C. for 30 minutes. The mRNA was then cleaned using the NEB Monarch kit. The purified mRNA was treated with Antarctic phosphatase (NEB, M0289S) for 1 hour at 37° C. in 1× Antarctic phosphatase buffer (NEB). mRNA was then purified again using the NEB Monarch kit. mRNA concentrations were measured by Nanodrop. The quality of mRNA was accessed by gel electrophoresis. The final in vitro transcribed mRNA was aliquoted and stored at −80° C. until shortly before use.

Primary T Cell Transduction, Expansion, and Enrichment

Human PBMCs were purified from Leukopaks purchased from Allcells® according to methods described previously (Garcia et al., 2014). Collection protocols and donor informed consent were approved by an Institutional Review Board (IRB) at Allcells®. Allcells® also followed HIPAA compliance and approved protocols with strict oversight (https://www.allcells.com/cell-tissue-procurement/donor-facilities/). Unless otherwise specified, all LymphoONE media (Takara WK552) was supplemented with 1% human AB Serum (GeminiBio 100-512). Human PBMCs were grown in LymphoONE plus TransAct™ (Miltenyi 130-111-160) following the manufacturers guidelines (1:100 dilution) for 24 hours before transduction with lentivirus encoding the activator (CAR) and/or the blocker. 24 hours after transduction, additional LymphoONE plus IL-2 (300 IU/ml) was added to transduced cells, grown for 3 days before transfer to a 24-well G-Rex plate (Wilson Wolf 80192M). Fresh IL-2 (300 IU/ml) was added every 48 hours with media change every 7 days when the cells were expanded in G-Rex plates. Expression and antigen binding of transduced activator or activator and blocker in primary T cells were confirmed by flow cytometry using protein L for the activator and HLA-A2 pMHC or LIL-RB1 antibody for the blocker. If needed, CAR- or blocker-expressing cells were labeled with protein L-biotin/streptavidin-PE or pMHC/streptavidin-PE, followed by anti-PE microbeads (Miltenyi 130-048-801) according to the manufacturer's instructions, and subsequently enriched using AutoMACS® Pro Separator (Miltenyi). Enriched cells were grown in G-Rex plates until use.

Primary T Cell In Vitro Cytotoxicity Studies

For cytotoxicity studies, enriched primary T cells were incubated with HeLa and HCT.116 cells expressing renilla luciferase (Biosettia). Live luciferase-expressing target cells were quantified using a renilla Luciferase Reporter Assay System (Promega). Target cells stably expressing GFP and renilla luciferase (Biosettia) or stably expressing RFP and firefly luciferase (Biosettia) were imaged together with unlabeled primary T cells using an IncuCyte live cell imager. Fluorescence intensity of live target cells over time was quantified using IncuCyte imaging software after 40 hours. For reversibility studies, enriched primary T cells were similarly cocultured with "normal" or "tumor" target cells for 3 days and imaged. After 3 days, T cells were separated from remaining target cells by pipetting, FACS or magnetic beads. In separate wells, live luciferase-expressing target cells were quantified using a Dual-Luciferase Reporter Assay System (Promega) at 72 hours.

Mouse Xenograft Study

Activator and blocker expressing T cells were generated as described in above.

Five to six week old female NSG (NOD.Cg-Prkdc$^{scid}$Il2rg$^{tm1Wjl}$/SzJ), JAX stock No. 005557 mice were purchased from The Jackson Labs. Animals were acclimated to the housing environment for at least 3 days prior to the initiation of the study. Animals were injected with 5e6 HER2+ HCT.116 cells that were HLA-A*02 positive in one flank and HLA-A*02 negative cells, in the other flank. When total volume of tumors in both flanks reached an average of 100 mm3 (V=L×W×W/2), animals were randomized into groups, and 2e6, 5e6, or 10e6 total T cells were administered via the tail vein. Post T cell injection, tumor measurements on both flanks were performed 3 times per week for 4 weeks.

Statistical Analysis

Statistical analyses were performed using GraphPad Prism software. All peptide and cell titration studies are shown as mean±standard deviation (SD), while in vitro and in vivo studies using primary T cells are shown as mean±standard error of the mean (SEM), unless otherwise noted. Peptide and cell titration curves were fit using a four-parameter non-linear regression analysis. EC50 values were calculated directly from the curves. All other groups of data were analyzed using an ordinary two-way ANOVA followed by a Tukey's multiple-comparisons test, unless otherwise noted.

Example 2: Activity of HER2 Chimeric Antigen Receptors in Jurkat Cells

The sensitivity of different HER2 chimeric antigen receptors (CARs) was determined in Jurkat cells and rank ordered. The formats of the different HER2 CARs assayed, and the HER2 antigen binding domains for these CARs, are shown in FIG. 1. Sequences of the HER2 CARs assayed are shown in Table 25 below.

Figure 2B:
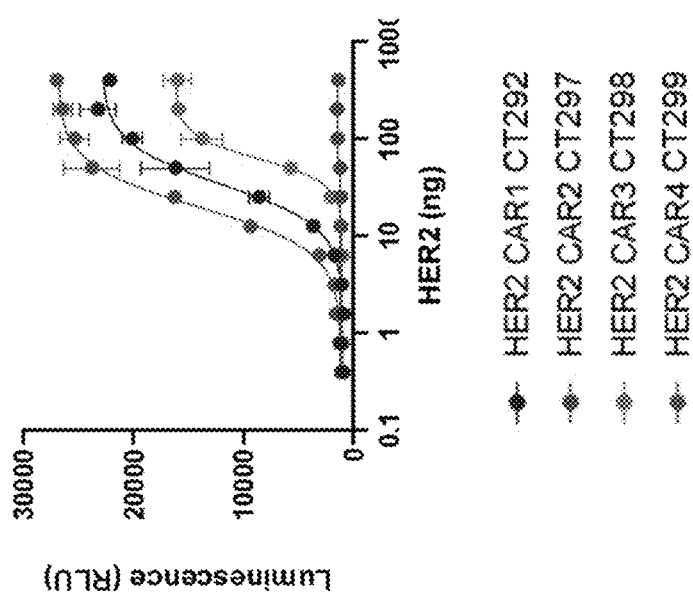
FIG. 2B is a plot showing HER2 activator EC50 in Jurkat cells, as measured by HCT.116 target cell number titration. HER2 CAR2 and HER2 CAR3 showed no activity.
Figure 2C:
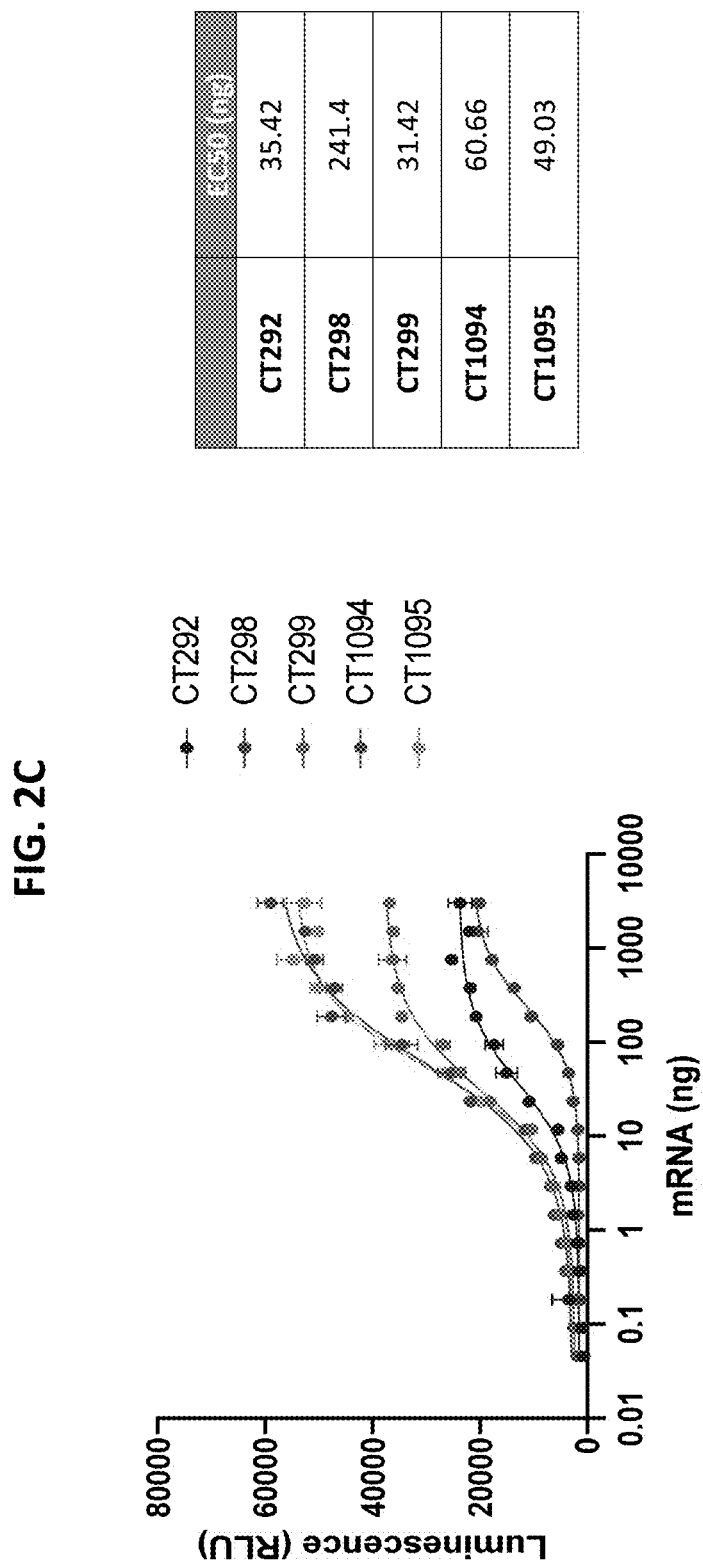
FIG. 2C as a plot and a table showing HER2 activator EC50 in Jurkat cells, as measured by titration of target HER2 mRNA. HER2 CAR2 (C297) showed no activity with antigen titration on a solid substrate (FIG. 2A) or target cell number titration (FIG. 2B) and was further engineered with different hinges (CT1094, CT1095).

The activity of Jurkat cells expressing HER2 CARS 1-4 (CT292, CT297, CT298 and CT299, respectively) was assayed using a titration of HER2 antigen on a solid substrate (FIG. 2A), and by titrating the number of HCT.116 HER2 positive target cells (FIG. 2B). In both cases, the HER2 CAR2, which had an FRP5 antigen binding domain, showed little to no activity. The FRP5 antigen binding domain, and a variant of FRP5, were assayed in a different CAR format that used an IgG1 hinge domain (CT1094 and CT1095). As shown in FIG. 2C, FRP5 antigen binding domain in combination with an IgG1 hinge shows detectable activity.

TABLE 25

| Construct | Amino Acid Sequence | DNA Sequence |
|---|---|---|
| CT292 | MDFQVQIFSFLLI | ATGGATTTTCAGGTGCAGATTTTCAGCTTCCTGCT |
|  | SASVIMSRGDIQM | AATCAGTGCCTCAGTCATAATGTCCAGAGGAGATA |
|  | TQSPSSLSASVGD | TCCAGATGACCCAGTCCCCGAGCTCCCTGTCCGCC |
|  | RVTITCRASQDVN | TCTGTGGGCGATAGGGTCACCATCACCTGCCGTGC |
|  | TAVAWYQQKPGKA | CAGTCAGGATGTGAATACTGCTGTAGCCTGGTATC |
|  | PKLLIYSASFLYS | AACAGAAACCAGGAAAAGCTCCGAAACTACTGATT |
|  | GVPSRFSGSRSGT | TACTCGGCATCCTTCCTTTATTCTGGAGTCCCTTC |
|  | DFTLTISSLQPED | TCGCTTCTCTGGATCTAGATCTGGGACGGATTTCA |
|  | FATYYCQQHYTTP | CTCTGACCATCAGCAGTCTGCAGCCGGAAGACTTC |
|  | PTFGQGTKVEIKR | GCAACTTATTACTGTCAGCAACATTATACTACTCC |
|  | TGSTSGSGKPGSG | TCCCACGTTCGGACAGGGTACCAAGGTGGAGATCA |

TABLE 25-continued

| Construct | Amino Acid Sequence | DNA Sequence |
| --- | --- | --- |
| | EGSEVQLVESGGG LVQPGGSLRLSCA ASGFNIKDTYIHW VRQAPGKGLEWVA RIYPTNGYTRYAD SVKGRFTISADTS KNTAYLQMNSLRA EDTAVYYCSRWGG DGFYAMDVWGQGT LVTVSSAAAFVPV FLPAKPTTTPAPR PPTPAPTIASQPL SLRPEACRPAAGG AVHTRGLDFACDI YIWAPLAGTCGVL LLSLVITLYCNHR NRSKRSRLLHSDY MNMTPRRPGPTRK HYQPYAPPRDFAA YRSRFSVVKRGRK KLLYIFKQPFMRP VQTTQEEDGCSCR FPEEEEGGCELRV KFSRSADAPAYQQ GQNQLYNELNLGR REEYDVLDKRRGR DPEMGGKPRRKNP QEGLYNELQKDKM AEAYSEIGMKGER RRGKGHDGLYQGL STATKDTYDALHM QALPPR (SEQ ID NO: 291) | AACGCACTGGGTCTACATCTGGATCTGGGAAGCCG GGTTCTGGTGAGGGTTCTGAGGTTCAGCTGGTGGA GTCTGGCGGTGGCCTGGTGCAGCCAGGGGGCTCAC TCCGTTTGTCCTGTGCAGCTTCTGGCTTCAACATT AAAGACACCTATATACACTGGGTGCGTCAGGCCCC GGGTAAGGGCCTGGAATGGGTTGCAAGGATTTATC CTACGAATGGTTATACTAGATATGCCGATAGCGTC AAGGGCCGTTTCACTATAAGCGCAGACACATCCAA AAACACAGCCTACCTGCAGATGAACAGCCTGCGTG CTGAGGACACTGCCGTCTATTATTGTTCTAGATGG GGAGGGGACGGCTTCTATGCTATGGACGTGTGGGG TCAAGGAACCCTGGTCACCGTTTCCTCGGCGGCCG CATTCGTGCCGGTCTTCCTGCCAGCGAAGCCCACC ACGACGCCAGCGCCGCGACCACCAACACCGGCGCC CACCATCGCGTCGCAGCCCCTGTCCCTGCGCCCAG AGGCGTGCCGGCCAGCGGCGGGGGGCGCAGTGCAC ACGAGGGGCTGGACTTCGCCTGTGATATCTACAT CTGGGCGCCCTTGGCCGGGACTTGTGGGGTCCTTC TCCTGTCACTGGTTATCACCCTTTACTGCAACCAC AGGAACAGGAGTAAGAGGAGCAGGCTCCTGCACAG TGACTACATGAACATGACTCCCCGCCGCCCCGGGC CCACCCGCAAGCATTACCAGCCCTATGCCCCACCA CGCGACTTCGCAGCCTATCGCTCCCGTTTCTCTGT TGTTAAACGGGGCAGAAAGAAGCTCCTGTATATAT TCAAACAACCATTTATGAGACCAGTACAAACTACT CAAGAGGAAGATGGCTGTAGCTGCCGATTTCCAGA AGAAGAAGGAGGATGTGAACTGAGAGTGAAGT TCAGCAGGAGCGCAGACGCCCCCGCGTACCAGCAG GGCCAGAACCAGCTCTATAACGAGCTCAATCTAGG ACGAAGAGGAGTACGATGTTTTGGACAAGAGGC GTGGCCGGGACCCTGAGATGGGGGGAAAGCCGAGA AGGAAGAACCCTCAGGAAGGCCTGTACAATGAACT GCAGAAAGATAAGATGGCGGAGGCCTACAGTGAGA TTGGGATGAAAGGCGAGCGCCGGAGGGGCAAGCAC CAAGGACACCTACGACGCCCTTCACATGCAGGCCC TGCCCCCTCGCTAG(SEQ ID NO: 292) |
| CT298 | MLLLVTSLLLCEL PHPAFLLIPDIQM TQSPSSLSASVGD RVTITCRASQDVN TAVAWYQQKPGKA PKLLIYSASFLYS GVPSRFSGSRSGT DFTLTISSLQPED FATYYCQQHYTTP PTFGQGTKVEIKG STSGGGSGGGSGG GGSSEVQLVESGG GLVQPGGSLRLSC AASGFNIKDTYIH WVRQAPGKGLEWV ARIYPTNGYTRYA DSVKGRFTISADT SKNTAYLQMNSLR AEDTAVYYCSRWG GDGFYAMDYVVGQ GTLVTVSSGGGSS GGGSGIYIWAPLA GTCGVLLLSLVIT KRGRKKLLYIFKQ PFMRPVQTTQEED GCSCRFPEEEEGG CELGGGRVKFSRS ADAPAYQQGQNQL YNELNLGRREEYD VLDKRRGRDPEMG GKPRRKNPQEGLY NELQKDKMAEAYS EIGMKGERRRGKG HDGLYQGLSTATK DTYDALHMQALPP R (SEQ ID NO: 293) | ATGCTGCTACTGGTCACCAGTCTACTGCTGTGCGA ACTGCCACATCCGGCCTTCCTGCTAATACCGGATA TCCAGATGACCCAGTCCCCGAGCTCCCTGTCCGCC TCTGTGGGCGATAGGGTCACCATCACCTGCCGTGC CAGTCAGGATGTGAATACTGCTGTAGCCTGGTATC AACAGAAACCAGGAAAAGCTCCGAAACTACTGATT TACTCGGCATCCTTCCTTTATTCTGGAGTCCCTTC TCGCTTCTCTGGATCTAGATCTGGGACGGATTTCA CTCTGACCATCAGCAGTCTGCAGCCGGAAGACTTC GCAACTTATTACTGTCAGCAACATTATACTACTCC TCCCACGTTCGGACAGGGTACCAAGGTGGAGATCA AAGGGTCTACATCTGGCGGTGGCTCTGGTGGCGGT TCCGGCGGTGGCGGTTCTTCCGAGGTTCAGCTGGT GGAGTCTGGCGGTGGCCTGGTGCAGCCAGGGGGCT CACTCCGTTTGTCCTGTGCAGCTTCTGGCTTCAAC ATTAAAGACACCTATATACACTGGGTGCGTCAGGC CCCGGGTAAGGGCCTGGAATGGGTTGCAAGGATTT ATCCTACGAATGGTTATACTAGATATGCCGATAGC GTCAAGGGCCGTTTCACTATAAGCGCAGACACATC CAAAAACACAGCCTACCTGCAGATGAACAGCCTGC GTGCTGAGGACACTGCCGTCTATTATTGTTCTAGA TGGGGAGGGGACGGCTTCTATGCTATGGACTATTG GGGTCAAGGAACCCTGGTCACCGTCTCCTCGGGTG GCGGTTCTTCCGGCGGTGGCTCTGGTATCTACATC TGGGCGCCCTTGGCCGGGACTTGTGGGGTCCTTCT CCTGTCACTGGTTATCACCAAACGGGGCAGAAAGA AGCTCCTGTATATATTCAAACAACCATTTATGAGA CCAGTACAAACTACTCAAGAGGAAGATGGCTGTAG CTGCCGATTTCCAGAAGAAGAAGAAGGAGGATGTG AACTGGGCGGTGGCAGAGTGAAGTTCAGCAGGAGC GCAGACGCCCCCGCGTACCAGCAGGGCCAGAACCA GCTCTATAACGAGCTCAATCTAGGACGAAGAGAGG AGTACGATGTTTTGGACAAGAGACGTGGCCGGGAC CCTGAGATGGGGGGAAAGCCGAGAAGGAAGAACCC TCAGGAAGGCCTGTACAATGAACTGCAGAAAGATA AGATGGCGGAGGCCTACAGTGAGATTGGGATGAAA GGCGAGCGCCGGAGGGGCAAGGGGCACGATGGCCT TTACCAGGGTCTCAGTACAGCCACCAAGGACACCT ACGACGCCCTTCACATGCAGGCCCTGCCCCCTCGC TAG (SEQ ID NO: 294) |

TABLE 25-continued

| Construct | Amino Acid Sequence | DNA Sequence |
|---|---|---|
| CT299 | MLLLVTSLLLCEL PHPAFLLIPDIQM TQSPSSLSASVGD RVTITCRASQDVN TAVAWYQQKPGKA PKLLIYSASFLYS GVPSRFSGSRSGT DFTLTISSLQPED FATYYCQQHYTTP PTFGQGTKVEIKG STSGGGSGGGSGG GGSSEVQLVESGG GLVQPGGSLRLSC AASGFNIKDTYIH WVRQAPGKGLEWV ARIYPTNGYTRYA DSVKGRFTISADT SKNTAYLQMNSLR AEDTAVYYCSRWG GDGFYAMDYVVGQ GTLVTVSSESKYG PPCPSCPAPEFEG GPSVFLFPPKPKD TLMISRTPEVTCV VVDVSQEDPEVQF NWYVDGVEVHNAK TKPREEQFQSTYR VVSVLTVLHQDWL NGKEYKCKVSNKG LPSSIEKTISKAK GQPREPQVYTLPP SQEEMTKNQVSLT CLVKGFYPSDIAV EWESNGQPENNYK TTPPVLDSDGSFF LYSRLTVDKSRWQ EGNVFSCSVMHEA LHNHYTQKSLSLS LGKIYIWAPLAGT CGVLLLSLVITKR GRKKLLYIFKQPF MRPVQTTQEEDGC SCRFPEEEEGGCE LGGGRVKFSRSAD APAYQQGQNQLYN ELNLGRREEYDVL DKRRGRDPEMGGK PRRKNPQEGLYNE LQKDKMAEAYSEI GMKGERRRGKHD GLYQGLSTATKDT YDALHMQALPPR (SEQ ID NO: 295) | ATGCTGCTACTGGTCACCAGTCTACTGCTGTGCGA ACTGCCACATCCGGCCTTCCTGCTAATACCGGATA TCCAGATGACCCAGTCCCCGAGCTCCCTGTCCGCC TCTGTGGGCGATAGGGTCACCATCACCTGCCGTGC CAGTCAGGATGTGAATACTGCTGTAGCCTGGTATC AACAGAAACCAGGAAAAGCTCCGAAACTACTGATT TACTCGGCATCCTTCCTTTATTCTGGAGTCCCTTC TCGCTTCTCTGGATCTAGATCTGGGACGGATTTCA CTCTGACCATCAGCAGTCTGCAGCCGGAAGACTTC GCAACTTATTACTGTCAGCAACATTATACTACTCC TCCCACGTTCGGACAGGGTACCAAGGTGGAGATCA AAGGGTCTACATCTGGCGGTGGCTCTGGTGGCGGT TCCGGCGGTGGCGGTTCTTCCGAGGTTCAGCTGGT GGAGTCTGGCGGTGGCCTGGTGCAGCCAGGGGGCT CACTCCGTTTGTCCTGTGCAGCTTCTGGCTTCAAC ATTAAAGACACCTATATACACTGGGTGCGTCAGGC CCCCGGGTAAGGGCCTGGAATGGGTTGCAAGGATTT ATCCTACGAATGGTTATACTAGATATGCCGATAGC GTCAAGGGCCGTTTCACTATAAGCGCAGACACATC CAAAAACACAGCCTACCTGCAGATGAACAGCCTGC GTGCTGAGGACACTGCCGTCTATTATTGTTCTAGA TGGGGAGGGGACGGCTTCTATGCTATGGACTATTG GGGTCAAGGAACCCTGGTCACCGTCTCCTCGGAGT CCAAATATGGTCCCCCATGCCCATCATGCCCAGCA CCTGAGTTCGAGGGGGGACCATCAGTCTTCCTGTT CCCCCCAAAACCCAAGGACACTCTCATGATCTCCC GGACCCCTGAGGTCACGTGCGTGGTGGTGGACGTG AGCCAGGAAGACCCCGAGGTCCAGTTCAACTGGTA CGTGGATGGCGTGGAGGTGCATAATGCCAAGACAA AGCCGCGGGAGGAGCAGTTCCAGAGCACGTACCGT GTGGTCAGCGTCCTCACCGTCCTGCACCAGGACTG GCTGAACGGCAAGGAGTACAAGTGCAAGGTCTCCA ACAAAGGCCTCCCGTCCTCCATCGAGAAAACCATC TCCAAAGCCAAAGGGCAGCCCCGAGAGCCACAGGT GTACACCCTGCCCCCATCCCAGGAGGAGATGACCA AGAACCAGGTCAGCCTGACCTGCCTGGTCAAAGGC TTCTACCCCAGCGACATCGCCGTGGAGTGGGAGAG CAATGGGCAGCCGGAGAACAACTACAAGACCACGC CTCCCGTGCTGGACTCCGACGGCTCCTTCTTCCTC TACAGCAGGCTCACCGTGGACAAGAGCAGGTGGCA GGAGGGGAATGTCTTCTCATGCTCCGTGATGCATG AGGCTCTGCACAACCACTACACACAGAAGAGCCTC TCCCTGTCTCTGGGTAAAATCTACATCTGGGCGCC CTTGGCCGGGACTTGTGGGGTCCTTCTCCTGTCAC TGGTTATCACCAAACGGGGCAGAAAGAAGCTCCTG TATATATTCAAACAACCATTTATGAGACAGACACA AACTACTCAAGAGGAAGATGGCTGTAGCTGCCGAT TTCCAGAAGAAGAAGAAGGAGGATGTGAACGGGC GGTGGCAGAGTGAAGTTCAGCAGGAGCGCAGACGC CCCCGCGTACCAGCAGGGCCAGAACCAGCTCTATA ACGAGCTCAATCTAGGACGAAGAGAGGAGTACGAT GTTTTGGACAAGAGACGTGGCCGGGACCCTGAGAT GGGGGGAAAGCCGAGAAGGAAGAACCCTCAGGAAG GCCTGTACAATGAACTGCAGAAAGATAAGATGGCG GAGGCCTACAGTGAGATTGGGATGAAAGGCGAGCG CCGGAGGGGCAAGGGGCACGATGGCCTTTACCAGG GTCTCAGTACAGCCACCAAGGACACCTACGACGCC CTTCACATGCAGGCCCTGCCCCCTCGCTAG (SEQ ID NO: 296) |
| CT297 | MDMRVPAQLLGLL LLWLRGARCQVQL QQSGPELKKPGET VKISCKASGYPFT NYGMNWVKQAPGQ GLKWMGWINTSTG ESTFADDFKGRFD FSLETSANTAYLQ INNLKSEDSATYF CARWEVYHGYVPY VVGQGTTVTVSSG GGGSGGGGSGGGG SDIQLTQSHKFLS TSVGDRVSITCKA SQDVYNAVAWYQQ KPGQSPKLLIYSA | ATGGACATGAGGGTCCCCGCTCAGCTCCTGGGGCT CCTGCTACTCTGGCTCCGAGGTGCCAGATGTCAGG TACAACTGCAGCAGTCAGGACCTGAACTGAAGAAG CCTGGAGAGACAGTCAAGATCTCCTGCAAGGCCTC TGGGTATCCTTTCACAAACTATGGAATGAACTGGG TGAAGCAGGCTCCAGGACAGGGTTTAAAGTGGATG GGCTGGATTAACACCTCCACTGGAGAGTCAACATT TGCTGATGACTTCAAGGGACGGTTTGACTTCTCTT TGGAAACCTCTGCCAACACTGCCTATTTGCAGATC AACAACCTCAAAAGTGAAGACTCGGCTACATATTT CTGTGCAAGATGGGAGGTTTACCACGGCTACATTG CTTACTGGGCCAAGGGACCACGGTCACCGTTTCC TCTGGCGGTGGCGGTTCTGGTGGCGGTGGCTCCGG CGGTGGCGGTTCTGACATCCAGCTGACCCAGTCTC ACAAATTCCTGTCCACTTCAGTAGGAGACAGGGTC AGCATCACCTGCAAGGCCAGTCAGGATGTGTATAA |

TABLE 25-continued

| Construct | Amino Acid Sequence | DNA Sequence |
|---|---|---|
| | SSRYTGVPSRFTG SGSGPDFTFTISS VQAEDLAVYFCQQ HFRTPFTFGSGTK LEIKIEVMYPPPY LDNEKSNGTIIHV KGKHLCPSPLFPG PSKPFWVLVVVGG VLACYSLLVTVAF IIFWVRSKRSRLL HSDYMNMTPRRPG PTRKHYQPYAPPR DFAAYRSVKFSR SADAPAYKQGQNQ LYNELNLGRREEY DVLDKRRGRDPEM GGKPRRKNPQEGL YNELQKDKMAEAY ESIGMKGERRRGK GHDGLYQGLSTAT KDTYDALHMQALP PR (SEQ ID NO: 297) | TGCTGTTGCCTGGTATCAACAGAAACCAGGACAAT CTCCTAAACTTCTGATTTACTCGGCATCCTCCCGG TACACTGGAGTCCCTTCTCGCTTCACTGGCAGTGG CTCTGGGCCGGATTTCACTTTCACCATCAGCAGTG TGCAGGCTGAAGACCTGGCAGTTTATTTCTGTCAG CAACATTTTCGTACTCCATTCACGTTCGGCTCGGG GACAAAATTGGAGATCAAAATTGAAGTTATGTATC CTCCTCCTTACCTAGACAATGAGAAGAGCAATGGA ACCATTATCCATGTGAAAGGGAAACACCTTTGTCC AAGTCCCTATTTCCCGGACCTTCTAAGCCCTTCT GGGTGCTGGTCGTTGTGGGCGGCGTGCTGGCCTGC TACAGCCTGCTGGTGACAGTGGCCTTCATCATCTT TTGGGTGAGGAGCAAGCGGAGCAGACTGCTGCACA GCGACTACATGAACATGACCCCCCGGAGGCCTGGC CCCACCCGGAAGCACTACCAGCCCTACGCCCCTCC CAGGGATTTCGCCGCCTACCGGAGCAGAGTGAAGT TCAGCAGGAGCGCAGACGCCCCCGCGTACAAGCAG GGCCAGAACCAGCTCTATAACGAGCTCAATCTAGG ACGAAGAGAGGAGTACGATGTTTTGGACAAGCGTA GAGGCCGGGACCCTGAGATGGGGGGAAAGCCGAGA AGGAAGAACCCTCAGGAAGGCCTGTACAATGAACT GCAGAAAGATAAGATGGCGGAGGCCTACAGTGAGA TTGGGATGAAAGGCGAGCGCCGGAGGGGCAAGGGG CACGATGGCCTTTACCAGGGACTCAGTACAGCCAC CAAGGACACCTACGACGCCCTTCACATGCAGGCCC TGCCCCCTCGCTAG (SEQ ID NO: 298) |
| CT1094 | MDMRVPAQLLGLL LLWLRGARCQVQL QQSGPELKKPGET VKISCKASGYPFT NYGMNWVKQAPGQ GLKWMGWINTSTG ESTFADDFKGRFD FSLETSANTAYLQ INNLKSEDSATYF CARWEVYHGYVPY VVGQGTTVTVSSG GGGSGGGGSGGGG SDIQLTQSHKFLS TSVGDRVSITCKA SQDVYNAVAWYQQ KPGQSPKLLIYSA SSRYTGVPSRFTG SGSGPDFTFTISS VQAEDLAVYFCQQ HFRTPFTFGSGTK LEIKAEPKSPDKT HTCPPCPKDPKFW VLVVVGGVLACYS LLVTVAFIIFWVR SKRSRLLHSDYMN MTPRRPGPTRKHY QPYAPPRDFAAYR SRVKFSRSADAPA YKQGQNQLYNELN LGRREEYDVLDKR RGRDPEMGGKPRR KNPQEGLYNELQK DKMAEAYSEIGMK GERRRGKGHDGLY QGLSTATKDTYDA LHMQALPPR (SEQ ID NO: 299) | ATGGACATGAGGGTCCCCGCTCAGCTCCTGGGGCT CCTGCTACTCTGGCTCCGAGGTGCCAGATGTCAGG TACAACTGCAGCAGTCAGGACCTGAACTGAAGAAG CCTGGAGAGACAGTCAAGATCTCCTGCAAGGCCTC TGGGTATCCTTTCACAAACTATGGAATGAACTGGG TGAAGCAGGCTCCAGGACAGGGTTTAAAGTGGATG GGCTGGATTAACACCTCCACTGGAGAGTCAACATT TGCTGATGACTTCAAGGGACGGTTTGACTTCTCTT TGGAAACCTCTGCCAACACTGCCTATTTGCAGATC AACAACCTCAAAAGTGAAGACTCGGCTACATATTT CTGTGCAAGATGGGAGGTTTACCACGGCTACGTTC CTTACTGGGGCCAAGGGACCACGGTCACCGTTTCC TCTGGCGGTGGCGGTTCTGGTGGCGGTGGCTCCGG CGGTGGCGGTTCTGACATCCAGCTGACCCAGTCTC ACAAATTCCTGTCCACTTCAGTAGGAGACAGGGTC AGCATCACCTGCAAGGCCAGTCAGGATGTGTATAA TGCTGTTGCCTGGTATCAACAGAAACCAGGACAAT CTCCTAAACTTCTGATTTACTCGGCATCCTCCCGG TACACTGGAGTCCCTTCTCGCTTCACTGGCAGTGG CTCTGGGCCGGATTTCACTTTCACCATCAGCAGTG TGCAGGCTGAAGACCTGGCAGTTTATTTCTGTCAG CAACATTTTCGTACTCCATTCACGTTCGGCTCGGG GACAAAATTGGAGATCAAAGCCGAGCCCAAGTCCC CTGATAAAACTCACACCTGCCCACCCTGTCCTAAG GACCCGAAGTTCTGGGTGCTGGTCGTTGTGGGCGG CGTGCTGGCCTGCTACAGCCTGCTGGTGACAGTGG CCTTCATCATCTTTTGGGTGAGGAGCAAGCGGAGC AGACTGCTGCACAGCGACTACATGAACATGACCCC CCGGAGGCCTGGCCCCACCCGGAAGCACTACCAGC CCTACGCCCCTCCCAGGGATTTCGCCGCCTACCGG AGCAGAGTGAAGTTCAGCAGGAGCGCAGACGCCCC CGCGTACAAGCAGGGCCAGAACCAGCTCTATAACG AGCTCAATCTAGGACGAAGAGAGGAGTACGATGTT TTGGACAAGCGTAGAGGCCGGGACCCTGAGATGGG GGGAAAGCCGAGAAGGAAGAACCCTCAGGAAGGCC TGTACAATGAACTGCAGAAAGATAAGATGGCGGAG GCCTACAGTGAGATTGGGATGAAAGGCGAGCGCCG GAGGGGCAAGGGGCACGATGGCCTTTACCAGGGAC TCAGTACAGCCACCAAGGACACCTACGACGCCCTT CACATGCAGGCCCTGCCCCCTCGCTAG (SEQ ID NO: 300) |

TABLE 25-continued

| Construct | Amino Acid Sequence | DNA Sequence |
|---|---|---|
| CT1095 | MDMRVPAQLLGLL LLWLRGARCQVQL QQSGPELKKPGET VKISCKASGYPFT NYGMNWVKQAPGQ GLKWMGWINTSTG ESTFADDFKGRFD FSLETSANTAYLQ INNLKSEDMATYF CARWEVYHGYVPY VVGQGTTVTVSSG GGGSGGGGSGGGG SDIQLTQSHKFLS TSVGDRVSITCKA SQDVYNAVAWYQQ KPGQSPKLLIYSA SSRYTGVPSRFTG SGSGPDFTFTISS VQAEDLAVYFCQQ HFRTPFTFGSGTK LEIKAEPKSPDKT HTCPPCPKDPKFW VLVVVGGVLACYS LLVTVAFIIFWVR SKRSRLLHSDYMN MTPRRPGPTRKHY QPYAPPRDFAAYR SRVKFSRSADAPA YKQGQNQLYNELN LGRREEYDVLDKR RGRDPEMGGKPRR KNPQEGLYNELQK DKMAEAYSEIGMK GERRRGKGHDGLY QGLSTATKDTYDA LHMQALPPR (SEQ ID NO: 301) | ATGGACATGAGGGTCCCCGCTCAGCTCCTGGGGCT CCTGCTACTCTGGCTCCGAGGTGCCAGATGTCAGG TACAACTGCAGCAGTCAGGACCTGAACTGAAGAAG CCTGGAGAGACAGTCAAGATCTCCTGCAAGGCCTC TGGGTATCCTTTCACAAACTATGGAATGAACTGGG TGAAGCAGGCTCCAGGACAGGGTTTAAAGTGGATG GGCTGGATTAACACCTCCACTGGAGAGTCAACATT TGCTGATGACTTCAAGGGACGGTTTGACTTCTCTT TGGAAACCTCTGCCAACACTGCCTATTTGCAGATC AACAACCTCAAAAGTGAAGACATGGCTACATATTT CTGTGCAAGATGGGAGGTTTACCACGGCTACGTTC CTTACTGGGGCCAAGGGACCACGGTCACCGTTTCC TCTGGCGGTGGCGGTTCTGGTGGCGGTGGCTCCGG CGGTGGCGGTTCTGACATCCAGCTGACCCAGTCTC ACAAATTCCTGTCCACTTCAGTAGGAGACAGGGTC AGCATCACCTGCAAGGCCAGTCAGGATGTGTATAA TGCTGTTGCCTGGTATCAACAGAAACCAGGACAAT CTCCTAAACTTCTGATTTACTCGGCATCCTCCCGG TACACTGGAGTCCCTTCTCGCTTCACTGGCAGTGG CTCTGGGCCGGATTTCACTTTCACCATCAGCAGTG TGCAGGCTGAAGACCTGGCAGTTTATTTCTGTCAG CAACATTTTCGTACTCCATTCACGTTCGGCTCGGG GACAAAATTGGAGATCAAAGCCGAGCCCAAGTCCC CTGATAAAACTCACACCTGCCCACCCTGTCCTAAG GACCCGAAGTTCTGGGTGCTGGTCGTTGTGGGCGG CGTGCTGGCCTGCTACAGCCTGCTGGTGACAGTGG CCTTCATCATCTTTTGGGTGAGGAGCAAGCGGAGC AGACTGCTGCACAGCGACTACATGAACATGACCCC CCGGAGGCCTGGCCCCACCCGGAAGCACTACCAGC CCTACGCCCCTCCCAGGGATTTCGCCGCCTACCGG AGCAGAGTGAAGTTCAGCAGGAGCGCAGACGCCCC CGCGTACAAGCAGGGCCAGAACCAGCTCTATAACG AGCTCAATCTAGGACGAAGAGAGGAGTACGATGTT TTGGACAAGCGTAGAGGCCGGGACCCTGAGATGGG GGGAAAGCCGAGAAGGAAGAACCCTCAGGAAGGCC TGTACAATGAACTGCAGAAAGATAAGATGGCGGAG GCCTACAGTGAGATTGGGATGAAAGGCGAGCGCCG GAGGGGCAAGGGGCACGATGGCCTTTACCAGGGAC TCAGTACAGCCACCAAGGACACCTACGACGCCCTT CACATGCAGGCCCTGCCCCCTCGCTAG (SEQ ID NO: 302) |

Example 3: An HLA-A*02 Inhibitory Receptor can Inhibit HER2 CAR Mediated Activation of Jurkat Cells The ability of an HLA-A*-02 LIR1 based inhibitory receptor to inhibit HER2 mediated activation of Jurkat cells expressing both a HER2 CAR and the based inhibitory receptor was assayed.

Figure 3:
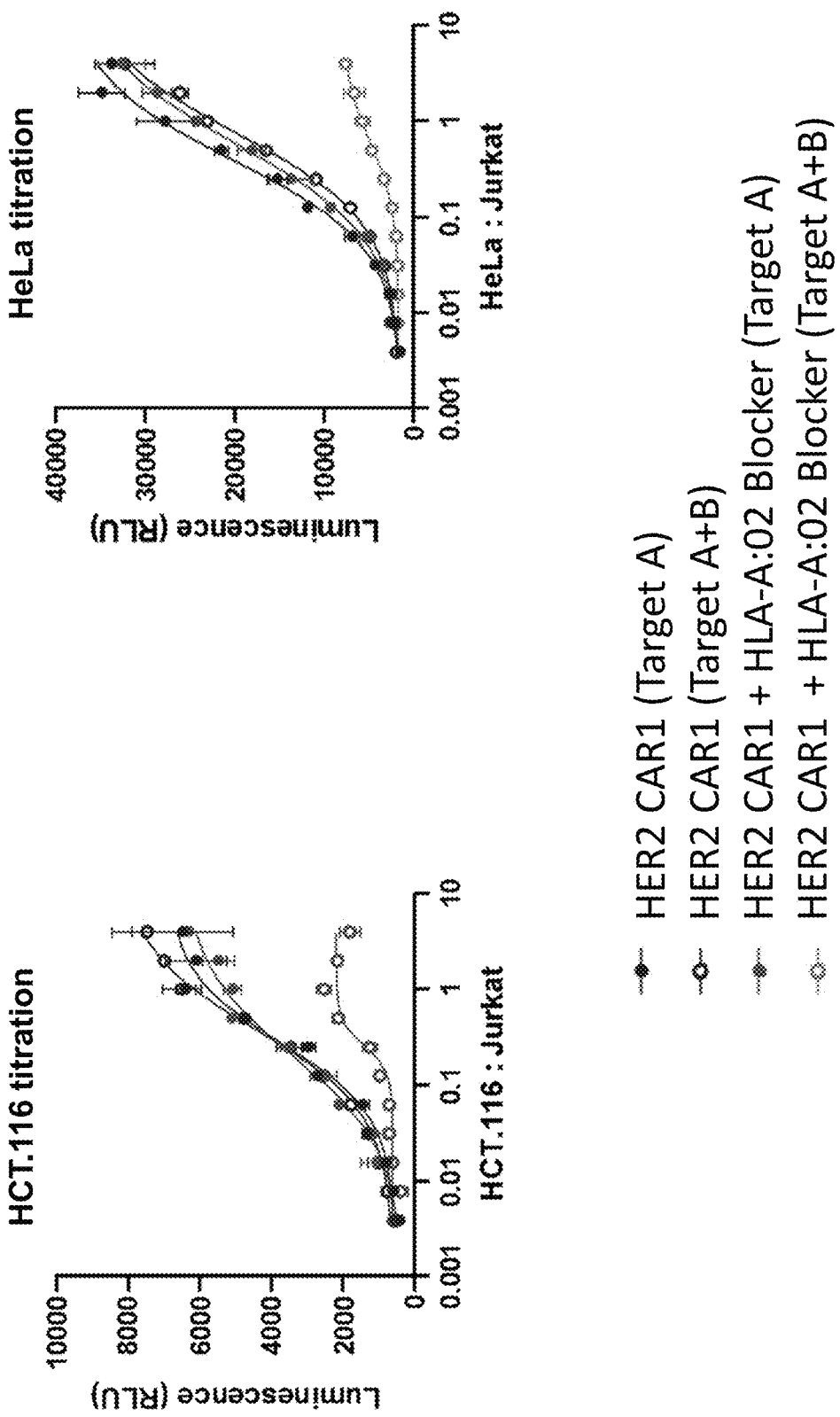
FIG. 3 is a pair of plots showing that activation of Jurkat cells that co-express an HLA-A*02 specific inhibitory receptor (HLA-A*02 Blocker) with the HER2 (CT292) CAR1 activator is blocked by target cells that express ligands for both the activator and blocker receptors. Target A: activator ligand (HER2); Target B: inhibitor ligand (HLA-A*02); left panel shows HCT.116 target cells; right panel: HeLa target cells.
Figure 4:
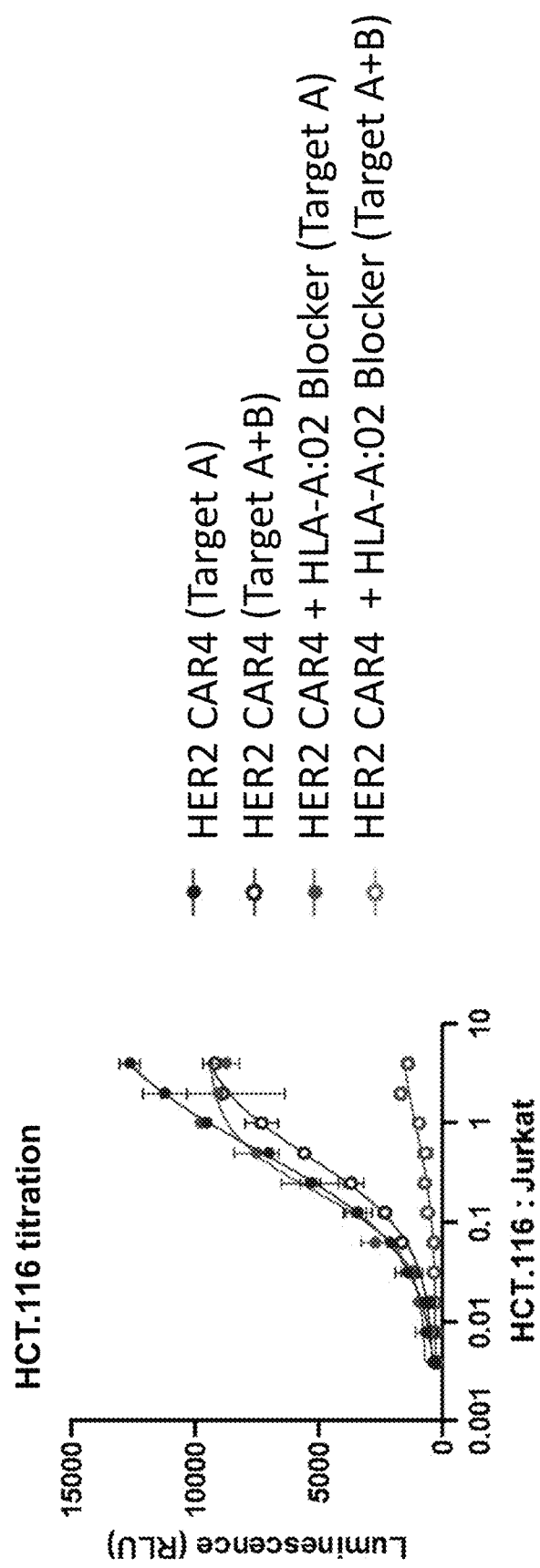
FIG. 4 is a plot showing that activation of Jurkat cells that co-express an HLA-A*02 specific inhibitory receptor (HLA-A*02 Blocker) with the HER2 (CT299) CAR1 activator is blocked by HCT.116 target cells that express ligands for both the activator and blocker receptors. Target A: activator ligand (HER2); Target B: inhibitor ligand (HLA-A*02).

Jurkat cells expressing either the HER2 CAR1 (FIG. 3) or HER2 CAR4 (FIG. 4), either alone or in combination with the CT1765 HLA-A*02 LIR1 inhibitory receptor, were co-cultured with HCT.116 or HeLa cells. HCT.116 Hela cells expressed HER2 (Target A), or HER2 and HLA-A*02 (Target AB). As can be seen from FIG. 3, activation Jurkat cells expressing the HLA-A*02 inhibitory receptor and HER2 CAR1 was inhibited by HCT.116 or HeLa target cells that expressed both HER2 and HLA-A*02. In contrast, activation Jurkat cells expressing only HER2 CAR1 was not inhibited in the presence of target cells expressing both HER2 and HLA-A*02. Similar results were observed for HER2 CAR4, as shown in FIG. 4.

Figure 5:
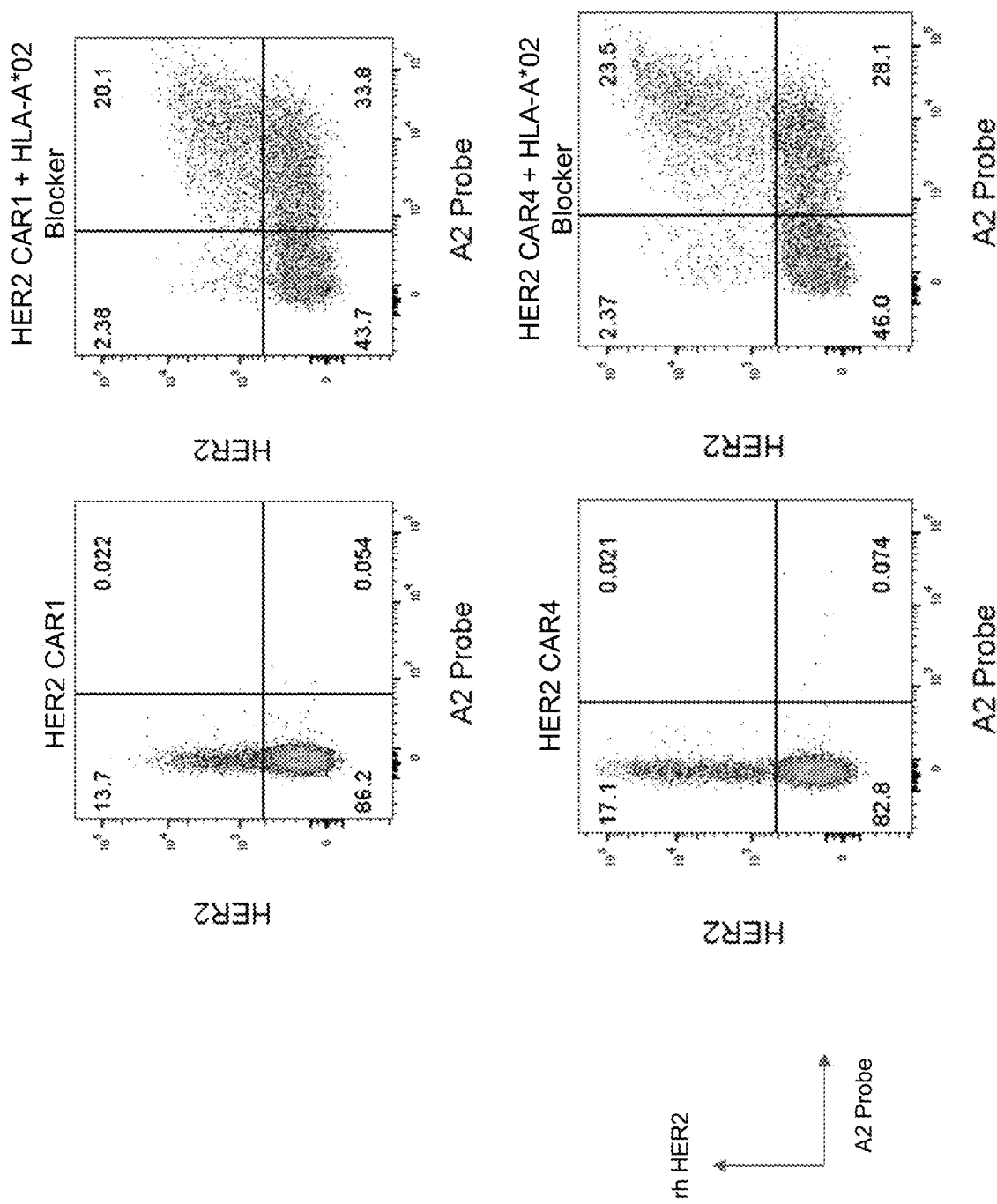
FIG. 5 is a series of fluorescence activated cell sorting (FACS) plots showing expression of the HER2 CAR1 or HER2 CAR4, alone or in combination with the HLA-A*02 Blocker, in Jurkat cells.

Surface expression of both the HER2 CAR, and the HLA-A*02 inhibitory receptor by Jurkat cells was validated by staining Jurkat cells using protein L for the activator receptor and pMHC or anti-LILRB1 antibody for the blocker receptor as shown in FIG. 5.

Example 4: An HLA-A*02 Inhibitory Receptor can Inhibit HER2 CAR Mediated Activation of Primary T Cells The efficacy, selectivity, and reversibility of HER2 CAR1 (CT292) in combination with an HLA-A*02 LIR1 inhibitory receptor was demonstrated in primary T cells. A murine version of the HLA-A*02 LIR1 inhibitory receptor (C1765), as well as two humanized versions (C2162 and C2163) were assayed in combination with HER2 CAR. The sequences of the HLA-A*02 inhibitory receptors are provided in Table 26 below.

Figure 6:
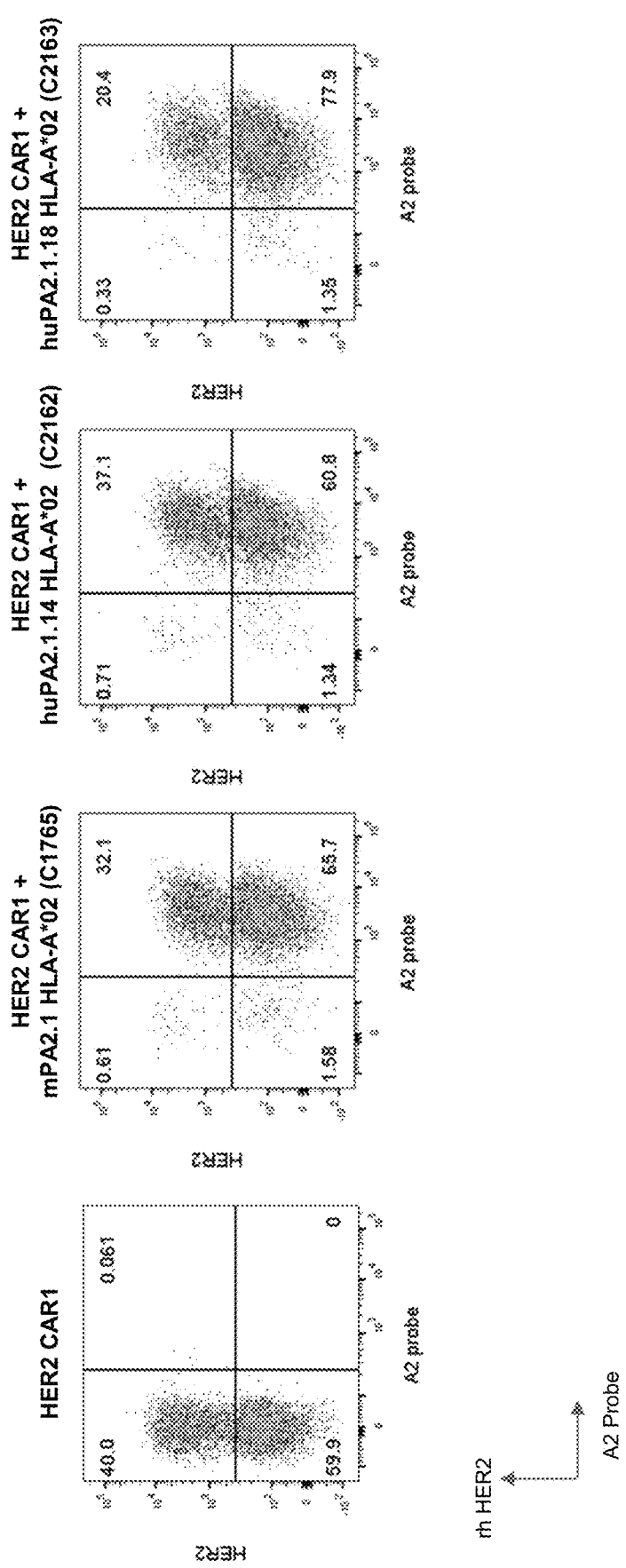
FIG. 6 is a series of FACS plots showing expression of HER2 CAR1 (CT292) in primary T cells, alone and in combination with HLA-A*02 blocker constructs mPA2.1 (C1765), humanized (hu) PA2.1.14 (C2162) and humanized PA2.1.18 (C2163). HER2 CAR1 and PA2.1 HLA-A*02 blockers can be expressed and enriched in primary T cells.
Figure 7:
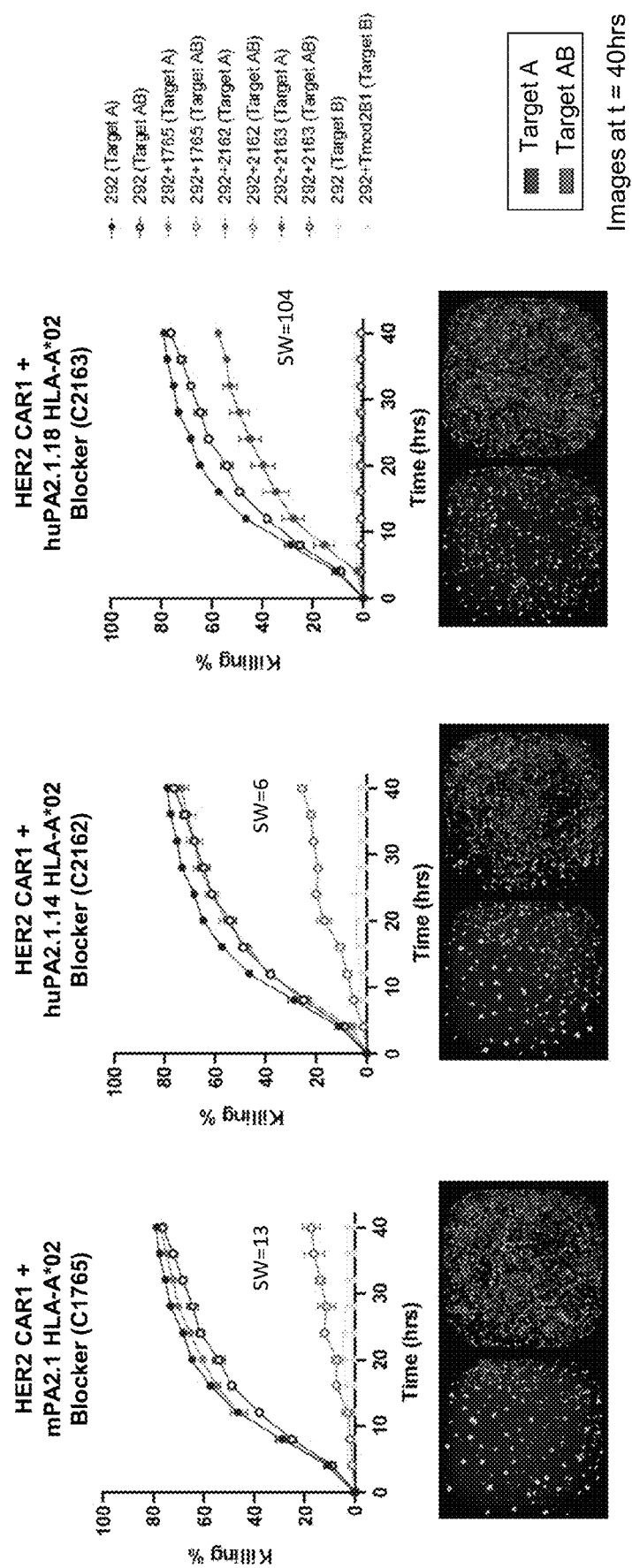
FIG. 7 is a series of plots and images showing that HER2 CAR1 (CT292) mediated primary T cell killing of HeLa target cells is inhibited when the T cells express an HLA-A*02 inhibitory receptors (as indicated), and the HeLa target cells co-express the HER2 activator ligand and HLA-A*02 blocker target ligand at a 1:40 ratio. Target A: activator ligand (HER2); Target B: inhibitor ligand (HLA-A*02); hu: humanized; SW: selectivity window. Images were taken at 40 hours, and show HeLa cells expression of activator (left image in each panel), or a combination of activator and inhibitor ligands (right panel in each image). Effector and target cells were at a ratio of 1:1.
Figure 8:
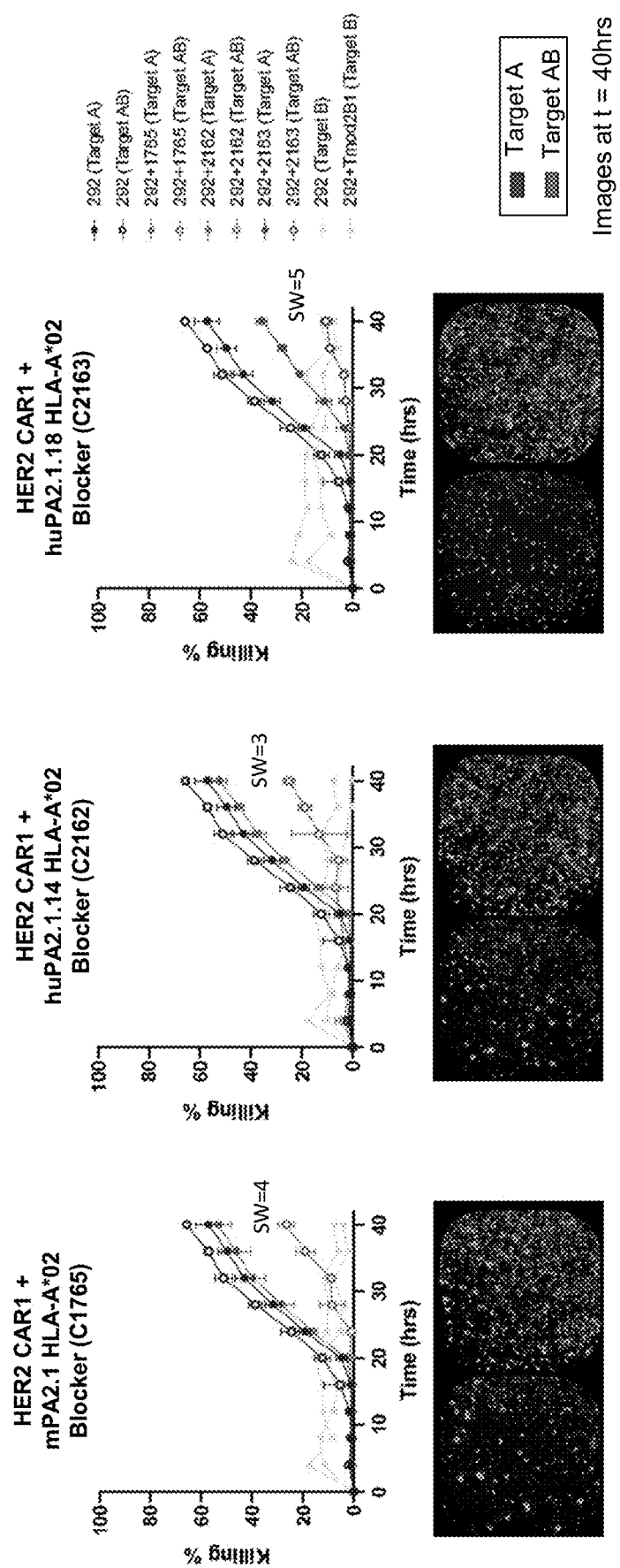
FIG. 8 is a series of plots and images showing that HER2 CAR1 (CT292) mediated primary T cell killing of HCT.116 target cells is inhibited when the T cells express an HLA-A*02 inhibitory receptors (as indicated), and the HCT.116 target cells co-express the HER2 activator ligand and HLA-A*02 blocker target ligand at a 1:4 ratio. Target A: activator ligand (HER2); Target B: inhibitor ligand (HLA-A*02); hu: humanized; SW: selectivity window. Images were taken at 40 hours, and show HCT.116 cells expression of activator (left image in each panel), or a combination of activator and inhibitor ligands (right panel in each image). Effector and target cells were at a ratio of 1:1.
Figure 12:
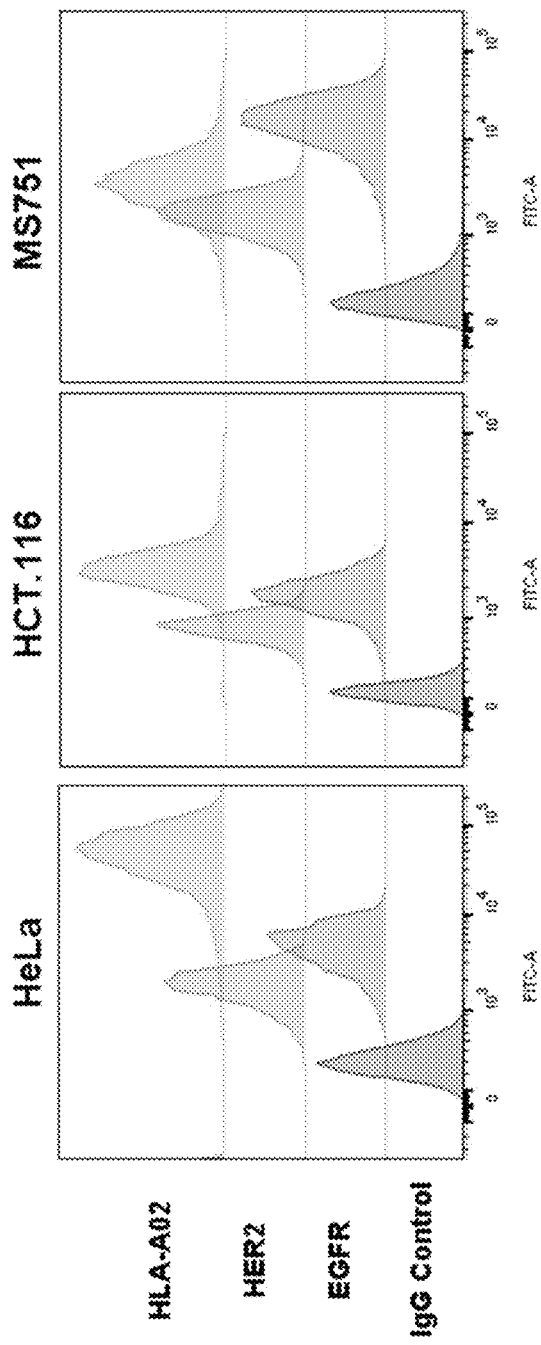
FIG. 12 is a series of FACS plots showing the expression of activator and inhibitor ligands by HeLa, HCT.116 and MS751 target cells. Cell surface antigens were quantified using the Agilent QIFI Kit.

As can be seen in FIG. 6, all of the HER2 CAR1, and the three inhibitory receptor constructs, were expressed by primary T cells following lentiviral transduction and enrichment. The activity of primary T cells expressing each of the three inhibitory receptors in combination with HER2 CAR1 was assayed using HeLa target cells expressing activator ligand to inhibitor ligand at a ratio of 1:40 (HER: HLA-A*-02). As shown in FIG. 7, all inhibitory receptors were able to inhibit HER2 mediated primary T cell activation. Similar results were obtained using HCT.116 target cells expressed activator to blocker antigen at a ratio of about 1:4 (FIG. 8). Antigen expression, and antigen densities, for HeLa and HCT.116 target cells are shown in FIGS. 12 and 13.

TABLE 26

HLA-A*02 Inhibitory receptors

| Construct | Amino Acid Sequence | DNA Sequence |
|---|---|---|
| C-1765 | MDMRVPAQLLGLLLLWLRGARCDVLMTQTPLSLPVSLGDQASISCRSSQSIVHSNGNTYLEWYLQKPGQSPKLLIYKVSNRFSGVPDRFSGSGSGTDFTLKISRVEAEDLGVYYCFQGSHVPRTSGGGTKLEIKGGGGSGGGGSGGGGSGGQVQLQQSGPELVKPGASVRISCKASGYTFTSYHIHWVKQRPGQGLEWIGWIYPGNVNTEYNEKFKGKATLTADKSSSTAYMHLSSLTSEDSAVYFCAREEITYAMDYWGQGTSVTVSSYGSQSSKPYLLTHPSDPLEVVSGPSGGPSSPTTGPTSTSGPEDQPLTPTGSDPQSGLGRHLGVVIGILVAVILLLLLLLLLFLILRHRRQGKHWTSTQRKADFQHPAGAVGPEPTDRGLQWRSSPAADAQEENLYAAVKHTQPEDGVEMDTRSPHDEDPQAVTYAEVKHSRPRREMASPPSPLSGEFLDTKDRQAEEDRQMDTEAAASEAPQDVTYAQLHSLTLRREATEPPPSQEGPSPAVPSIYATLAIH (SEQ ID NO: 303) | ATGGACATGAGGGTCCCCGCTCAGCTCCTGGGGCTCCTGCTACTCTGGCTCCGAGGTGCCAGATGTGATGTTTTGATGACCCAAACTCCACTCTCCCTGCCTGTCAGTCTTGGAGATCAAGCCTCCATCTCTTGCAGATCTAGTCAGAGCATTGTACATAGTAATGGAAACACCTATTTAGAATGGTACCTGCAGAAACCAGGCCAGTCTCCAAAGCTCCTGATCTACAAAGTTTCCAACCGATTTTCTGGGGTCCCAGACAGGTTCAGTGGCAGTGGATCAGGGACAGATTTCACACTCAAGATCAGTAGAGTGGAGGCTGAGGATCTGGGAGTTTATTACTGCTTTCAAGGTTCACATGTTCCTCGGACGTCCGGTGGAGGCACCAAGCTGGAAATCAAAGGCGGAGGTGGAAGCGGAGGGGGAGGATCTGGCGGCGGAGGAAGCGGAGGCCAGGTCCAGCTGCAGCAGTCTGGACCTGAGCTGGTGAAGCCTGGGGCTTCAGTGAGGATATCCTGCAAGGCTTCTGGCTACACCTTCACAAGTTACCATATACATTGGGTGAAGCAGAGGCCTGGACAGGGACTTGAGTGGATTGGATGGATTTATCCTGGAAATGTTAATACTGAGTACAATGAAGAAGTTCAAGGGCAAGGCCACACTGACTGCAGACAAATCGTCCAGCACAGCCTACATGCACCTCAGCAGCCTGACCTCTGAGGACTCTGCGGTCTATTTCTGTGCCAGAGAGGAGATTACCTATGCTATGGACTACTGGGGTCAAGGAACCTCAGTCACCGTGTCCTCATACGGCTCACAGAGCTCCAAACCCTACCTGCTGACTCACCCCAGTGACCCTGGAGCTCGTGGTCTCAGGACCGTCTGGGGCCCCAGCTCCCCGACAACAGGCCCCACCTCCACATCTGGCCCTGAGGACCAGCCCCTCACCCCCACCGGGTCGGATCCCCAGAGTGGTCTGGGAAGGCACCTGGGGGTTGTGATCGGCATCTTGGTGGCCGTCATCCTACTGCTCCTCCTCCTCCTCCTCCTCTTCCTCATCCTCCGACATCGACGTCAGGGCAAACACTGGACATCGACCCAGAGAAAGGCTGATTTCCAACATCCTGCAGGGGCTGTGGGGCCAGAGCCCACAGACAGAGGCCTGCAGTGGAGGTCCAGCCCAGCTGCCGATGCCCAGGAAGAAAACCTCTATGCTGCCGTGAAGCACACACAGCCTGAGGATGGGGTGGAGATGGACACTCGGAGCCCACACGATGAAGACCCCCAGGCAGTGACGTATGCCGAGGTGAAACACTCCAGACTTAGGAGAGAAATGGCCTCTCCTCCTTCCCCACTGTCTGGGGAATTCCTGGACACAAAGGACAGACAGGCGGAAGAGGACAGGCAGATGGACACTGAGGCTGCTGCATCTGAAGCCCCCCAGGATGTGACCTACGCCCAGCTGCACAGCTTGACCCTCAGAGGGAGGCAACTGAGCCTCCTCCATCCCAGGAAGGGCCCTCTCCAGCTGTGCCCAGCATCTACGCCACTCTGGCCATCCACTAG (SEQ ID NO: 304) |
| C-2162 | MDMRVPAQLLGLLLLWLRGARCQVQLVQSGAEVKKPGSSVKVSCKASGYTFTSYHIHWVRQAPGQGLEWIGWIYPGNVNTEYNEKFKGKATITADESTNTAYMELSSLRSEDTAVYYCAREEITYAMDYWGQGTLVTVSSGGGGSGGGGSGGGGSGDIQMTQSPSTLSASVGDRVTITCRSSQSIVHSNGNTYLEWYQQKPGKAPKLLIYKVSNRFSGVPARFSGSGSGTEFTLTISSLQPDDFATYYCFQGSHVPRTFGQGTKVEVKYGSQSSKPYLLTHPSDPLEVVSGPSGGPSSPTTGPTSTSGPEDQPLTPTGSDPQSGLGRHLGVVIGILVAVILLLLLLL | ATGGACATGAGGGTCCCCGCTCAGCTCCTGGGGCTCCTGCTACTCTGGCTCCGAGGTGCCAGATGTCAGGTGCAGCTGGTGCAGTCTGGGGCTGAGGTGAAGAAGCCTGGGTCCTCAGTGAAGGTTTCCTGCAAGGCTTCTGGATACACCTTCACTAGCTATCATATACATTGGGTGCGCCAGGCCCCCGGACAAGGGCTTGAGTGGATCGGATGGATCTACCCTGGCAATGTTAACACAGAATATAATGAGAAGTTCAAGGGCAAAGCCACCATTACCGCGGACGAATCCACGAACACAGCCTACATGGAGCTGAGCAGCCTGAGATCTGAAGACACGGCTGTGTATTACTGTGCGAGGGAGGAAATTACCTACGCTATGGACTACTGGGGCCAGGGAACCCTGGTCACCGTGTCCTCAGGCGGAGGTGGAAGCGGAGGGGGAGGATCTGGCGGCGGAGGAAGCGGAGGCGACATTCAAATGACCCAGAGCCCATCCACCCTGAGCGCATCTGTAGGTGACCGGGTCACCATCACTTGTAGATCCAGTCAGAGTATTGTACACAGTAATGGGAACACCTATTTGGAATGGTATCAGCAGAAACCAGGTAAAGCCCCAAAATTGCTCATCTACAAAGTCTCTAACAGATTTAGTGGTGTACCAGCCAGGTTCAGCGGTTCCGGAAGTGGTACTGAATTCACCCTCACGATTCCTCTCTCCAGCCAGATGATTTCGCCACTTATTACTGTTTTCAAGGTTCACATGTGCCGCGCACATTCGGTCAGGGTACTAAAGTAGAAGTCAAATACGGCTCACAGAGCTCCAAACCCTACCTGCTGACTCACCCCAGTGACCCTGGAGCTCGTGGTCTCAGGACCGTCTGGGGCCCCAGCTCCCCGACAACAGGCCCCACCTCCACATCTGGCCCTGAGGACCAGCCCCTCACCCCCACCGGGTCGGATCCCCAGAGTGGTCTGGGAAGGCACCTGGGGGTTGTGATCGGCATCTTGGTGGCCGTCATCCTACTGCTCCTCCTCCTC |

TABLE 26-continued

HLA-A*02 Inhibitory receptors

| Construct | Amino Acid Sequence | DNA Sequence |
|---|---|---|
| | LLLFLILRHRRQ GKHWTSTQRKAD FQHPAGAVGPEP TDRGLQWRSSPA ADAQEENLYAAV KHTQPEDGVEMD TRSPHDEDPQAV TYAEVKHSRPRR EMASPPSPLSGE FLDTKDRQAEED RQMDTEAAASEA PQDVTYAQLHSL TLRREATEPPPS QEGPSPAVPSIY ATLAIH (SEQ ID NO: 305) | CTCCTCCTCTTCCTCATCCTCCGACATCGACGTCAG GGCAAACACTGGACATCGACCCAGAGAAAGGCTGAT TTCCAACATCCTGCAGGGGCTGTGGGGCCAGAGCCC ACAGACAGAGGCCTGCAGTGGAGGTCCAGCCCAGCT GCCGATGCCCAGGAAGAAAACCTCTATGCTGCCGTG AAGCACACACAGCCTGAGGATGGGGTGGAGATGGAC ACTCGGAGCCCACACGATGAAGACCCCCAGGCAGTG ACGTATGCCGAGGTGAAACACTCCAGACCTAGGAGA GAAATGGCCTCTCCTCCTTCCCCACTGTCTGGGGAA TTCCTGGACACAAAGGACAGACAGGCGGAAGAGGAC AGGCAGATGGACACTGAGGCTGCTGCATCTGAAGCC CCCCAGGATGTGACCTACGCCCAGCTGCACAGCTTG ACCCTCAGACGGGAGGCAACTGAGCCTCCTCCATCC CAGGAAGGGCCCTCTCCAGCTGTGCCCAGCATCTAC GCCACTCTGGCCATCCACTAG (SEQ ID NO: 306) |
| C-2163 | MDMRVPAQLLGL LLLWLRGARCQV QLVQSGAEVKKP GSSVKVSCKASG YTFTSYHMHWVR QAPGQGLEWIGY IYPGNVNTEYNE KFKGKATLTADK STNTAYMELSSL RSEDTAVYFCAR EEITYAMDYWGQ GTLVTVSSGGGG SGGGGSGGGGSG GDVQMTQSPSTL SASVGDRVTITC SSSQSIVHSNGN TYMEWYQQKPGK APKLLIYKVSNR FSGVPDRFSGSG SGTEFTLTISSL QPDDFATYYCHQ GSHVPRTFGQGT KVEVKYGSQSSK PYLLTHPSDPLE LVVSGPSGGPSS PTTGPTSTSGPE DQPLTPTGSDPQ SGLGRHLGVVIG ILVAVILLLLLL LLLFLILRHRRQ GKHWTSTQRKAD FQHPAGAVGPEP TDRGLQWRSSPA ADAQEENLYAAV KHTQPEDGVEMD TRSPHDEDPQAV TYAEVKHSRPRR EMASPPSPLSGE FLDTKDRQAEED RQMDTEAAASEA PQDVTYAQLHSL TLRREATEPPPS QEGPSPAVPSIY ATLAIH (SEQ ID NO: 307) | ATGGACATGAGGGTCCCCGCTCAGCTCCTGGGGCTC CTGCTACTCTGGCTCCGAGGTGCCAGATGTCAGGTG CAGCTGGTGCAGTCTGGGGCTGAGGTGAAGAAGCCT GGGTCCTCAGTGAAGGTTTCCTGCAAGGCTTCTGGA TACACCTTCACTAGCTATCATATGCATTGGGTGCGC CAGGCCCCCGGACAAGGGCTTGAGTGGATCGGATAC ATCTACCCTGGCAATGTTAACACAGAATATAATGAG AAGTTCAAGGGCAAAGCCACCCTTACCGCGGACAAA TCCACGAACACAGCCTACATGGAGCTGAGCAGCCTG AGATCTGAAGACACGGCTGTGTATTTCTGTGCGAGG GAGGAAATTACCTACGCTATGGACTACTGGGGCCAG GGAACCCTGGTCACCGTGTCCTCAGGCGGAGGTGGA AGCGGAGGGGAGGATCTGGCGGCGGAGGAAGCGGA GGCGACGTTCAAATGACCCAGAGCCCATCCACCCTG AGCGCATCTGTAGGTGACCGGGTCACCATCACTTGT AGCTCCAGTCAGAGTATTGTACACAGTAATGGGAAC ACCTATATGGAATGGTATCAGCAGAAACCAGGTAAA GCCCCAAAATTGCTCATCTACAAAGTCTCTAACAGA TTTAGTGGTGTACCAGACAGGTTCAGCGGTTCCGGA AGTGGTACTGAATTCACCCTCACGATCTCCTCTCTC CAGCCAGATGATTTCGCCACTTATTACTGTCATCAA GGTTCACATGTGCCGCGCACATTCGGTCAGGGTACT AAAGTAGAAGTCAAATACGGCTCACAGAGCTCCAAA CCCTACCTGCTGACTCACCCCAGTGACCCCCTGGAG CTCGTGGTCTCAGGACCGTCTGGGGGCCCCAGCTCC CCGACAACAGGCCCCACCTCCACATCTGGCCCTGAG GACCAGCCCCTCACCCCCACCGGGTCGGATCCCCAG AGTGGTCTGGGAAGGCACCTGGGGGTTGGATCGGC ATCTTGGTGGCCGTCATCCTACTGCTCCTCCTCCTC CTCCTCCTCTTCCTCATCCTCCGACATCGACGTCAG GGCAAACACTGGACATCGACCCAGAGAAAGGCTGAT TTCCAACATCCTGCAGGGGCTGTGGGGCCAGAGCCC ACAGACAGAGGCCTGCAGTGGAGGTCCAGCCCAGCT GCCGATGCCCAGGAAGAAAACCTCTATGCTGCCGTG AAGCACACACAGCCTGAGGATGGGGTGGAGATGGAC ACTCGGAGCCCACACGATGAAGACCCCCAGGCAGTG ACGTATGCCGAGGTGAAACACTCCAGACCTAGGAGA GAAATGGCCTCTCCTCCTTCCCCACTGTCTGGGGAA TTCCTGGACACAAAGGACAGACAGGCGGAAGAGGAC AGGCAGATGGACACTGAGGCTGCTGCATCTGAAGCC CCCCAGGATGTGACCTACGCCCAGCTGCACAGCTTG ACCCTCAGACGGGAGGCAACTGAGCCTCCTCCATCC CAGGAAGGGCCCTCTCCAGCTGTGCCCAGCATCTAC GCCACTCTGGCCATCCACTAG (SEQ ID NO: 308) |

Figure 9:
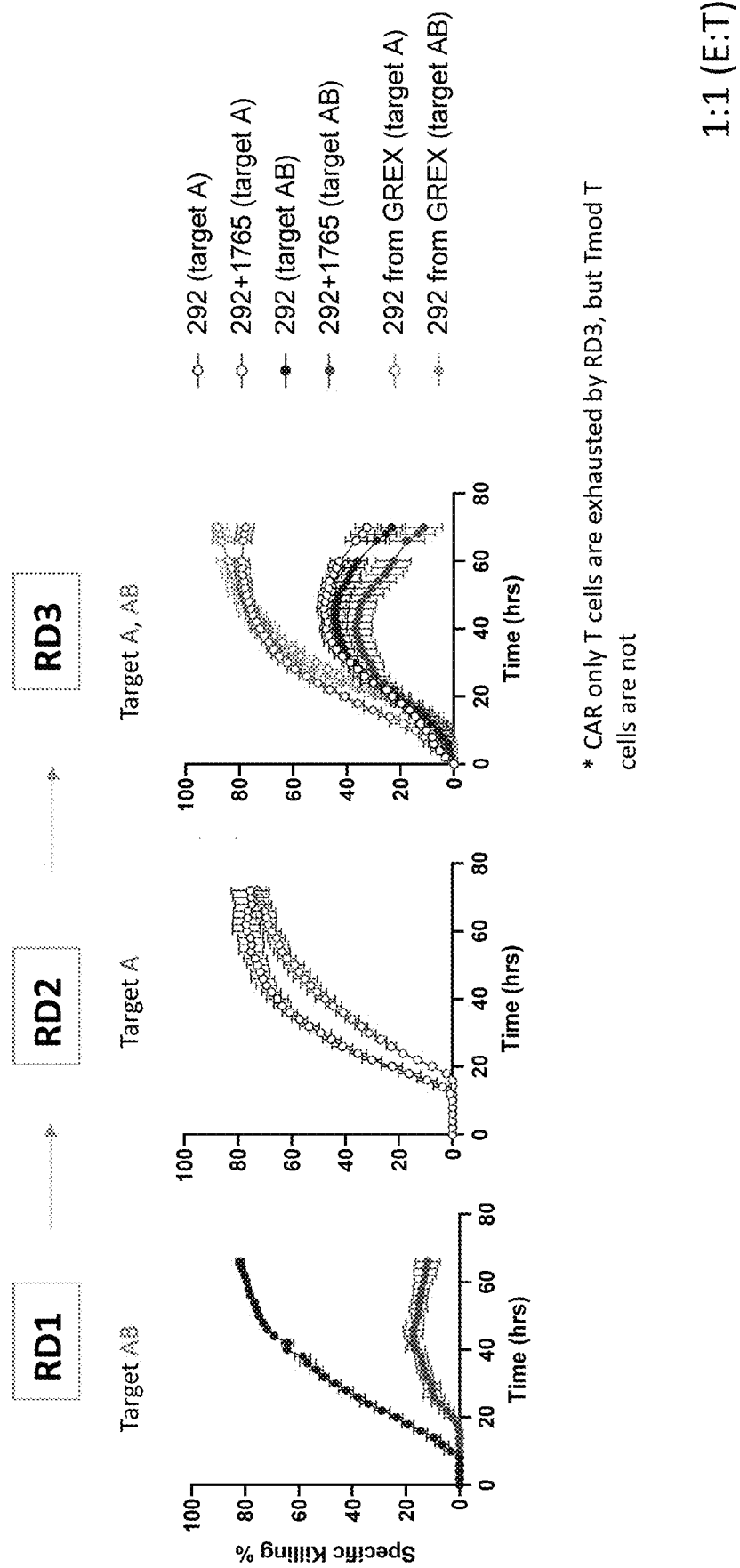
FIG. 9 is a series of plots showing that inhibition of primary T cell activation by the HER2 CAR1 (CT292) by HLA-A*02 inhibitory receptors is reversible. Activation of primary T cells was assayed using HCT.116 target cells. Target AB: HCT.116 cells expressing both activator (HER2) and inhibitor (HLA-A*02) ligands; Target A: HCT.116 cells expressing HER2; RD: round; E:T stands for Effector: Target. Primary T cells that expressed only the HER2 CAR, and not the HLA-A*02 inhibitory receptor were exhausted by Round 3, while Primary T cells that expressed both the HER2 CAR and the HLA-A*02 inhibitory receptor were not.
Figure 14:
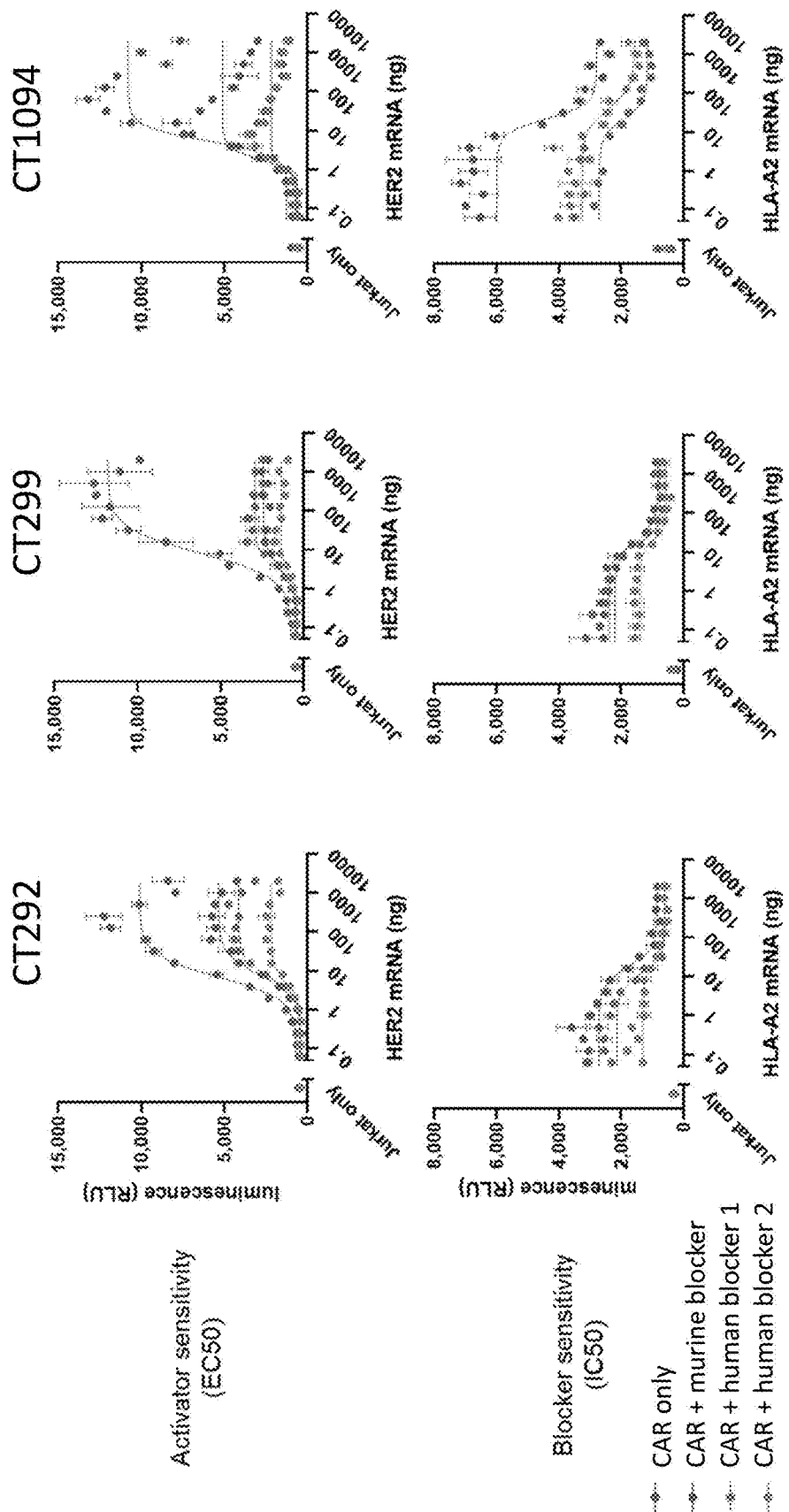
FIG. 14 is a series of plots showing sensitivity of nine receptor pairs comprising scFvs CT292 (left column), CT299 (middle column), or CT1094 (right column) paired with no modules (CAR only), murine blocker (C1765), humanized blocker 1 (C2162), or humanized blocker 2 (C2163). Activator (top row) and blocker (bottom row).

Example 5: Inhibition of HER CAR-Mediated Primary T Cell Activation by the HLA-A*02 Inhibitory Receptor is Reversible The ability of the HLA-A*02 LIR1 inhibitory receptor to inhibit HER2 mediated activation of primary T cells expressing a HER2 CAR was reversible. Primary T cells expressing HER2 CAR1 (CT292) alone or in combination with the CT1765 HLA-A*02 inhibitory receptor were co-cultured with HCT.116 cells expressing both HER2 and HLA-A*02 (FIG. 9, RD1, or round 1) at a ratio of 1:1. HCT.116 target cells were then removed, and the primary T cells were co-cultured with HCT.116 target cells expressing HER2 only (FIG. 9, RD2, or round 2) at a ratio of 1:1. Finally, primary T cells were again co-cultured with HCT.116 cells expressing both HER2 and HLA-A*02, or HER2 alone as a control (FIG. 9, RD3, or round 3) at a ratio of 1:1. As can be seen in FIG. 9, activation and inactivation of the T cells was reversible. In addition, T cells expressing only the HER2 CAR were exhausted by round 3 of co-culture, while T cells that expressed both the HER2 CAR and the HLA-A*02 LIR1 inhibitory receptor were not.

sity. Results are shown in FIG. 14 and summarized in Table 27. Blocker C2163 showed similar blocking activity to C2162 with lower level of activation and was not studied further.

TABLE 27

HER2 CARs and Inhibitory Receptors Screened

| Activator scFv | Blocker | Construct | EC50 (molecules/ cell) | IC50 (molecules/ cell) | T cell Expression | T cell Killing/ Blocking |
|---|---|---|---|---|---|---|
| CT292 | N/A | CT292 | 7,200 | N/A | +++ | ++ |
| | Murine | CT1110 | 7,600 | 28,000 | ++ | ++/++ |
| | Human-1 | CT1118 | 7,000 | 17,000 | + | ++/++ |
| | Human-2 | CT1184 | 6,400 | 44,800 | N/D | N/D |
| CT299 | N/A | CT299 | 7,800 | N/A | + | + |
| | Murine | CT1112 | 5,500 | 33,700 | + | +/+ |
| | Human-1 | CT1120 | 5,800 | 22,800 | + | +/++ |
| | Human-2 | CT1186 | 5,200 | 33,300 | N/D | N/D |
| CT1094 | N/A | CT1094 | 6,500 | N/A | +++ | ++ |
| | Murine | CT1113 | 4,900 | 38,800 | +++ | ++/++ |
| | Human-1 | CT1121 | 4,600 | 37,900 | ++ | ++/++ |
| | Human-2 | CT1187 | 4,500 | 87,400 | N/D | N/D |

Figure 10:
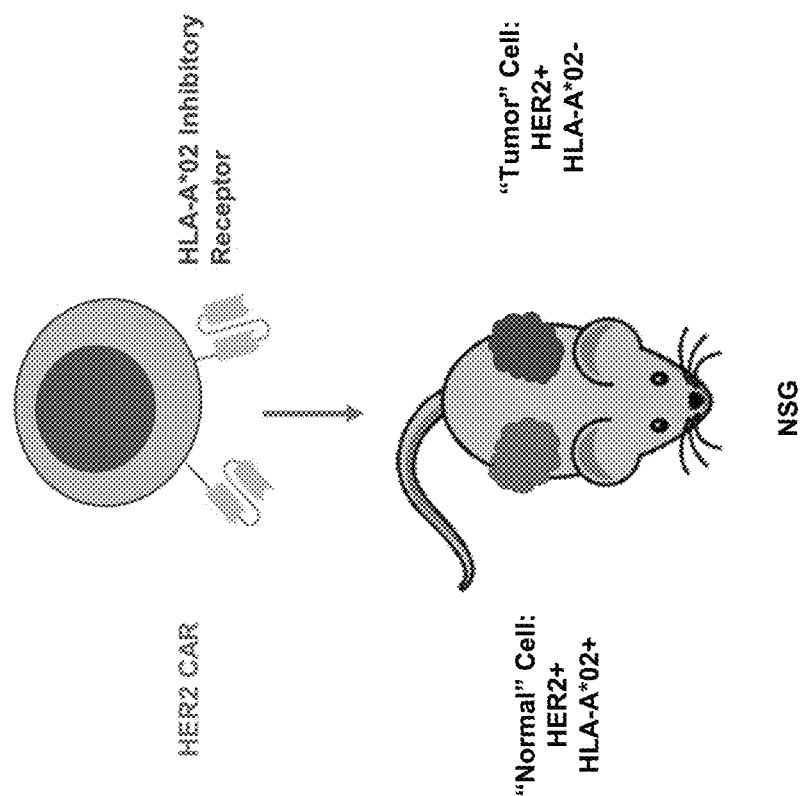
FIG. 10 is a diagram showing an experiment assaying the ability of primary T cells expressing the HER2 CAR and HLA-A*02 inhibitory receptor to kill target cells in a mouse xenograft model of a HER2 positive cancer that has lost expression of HLA-A*02.
Figure 11:
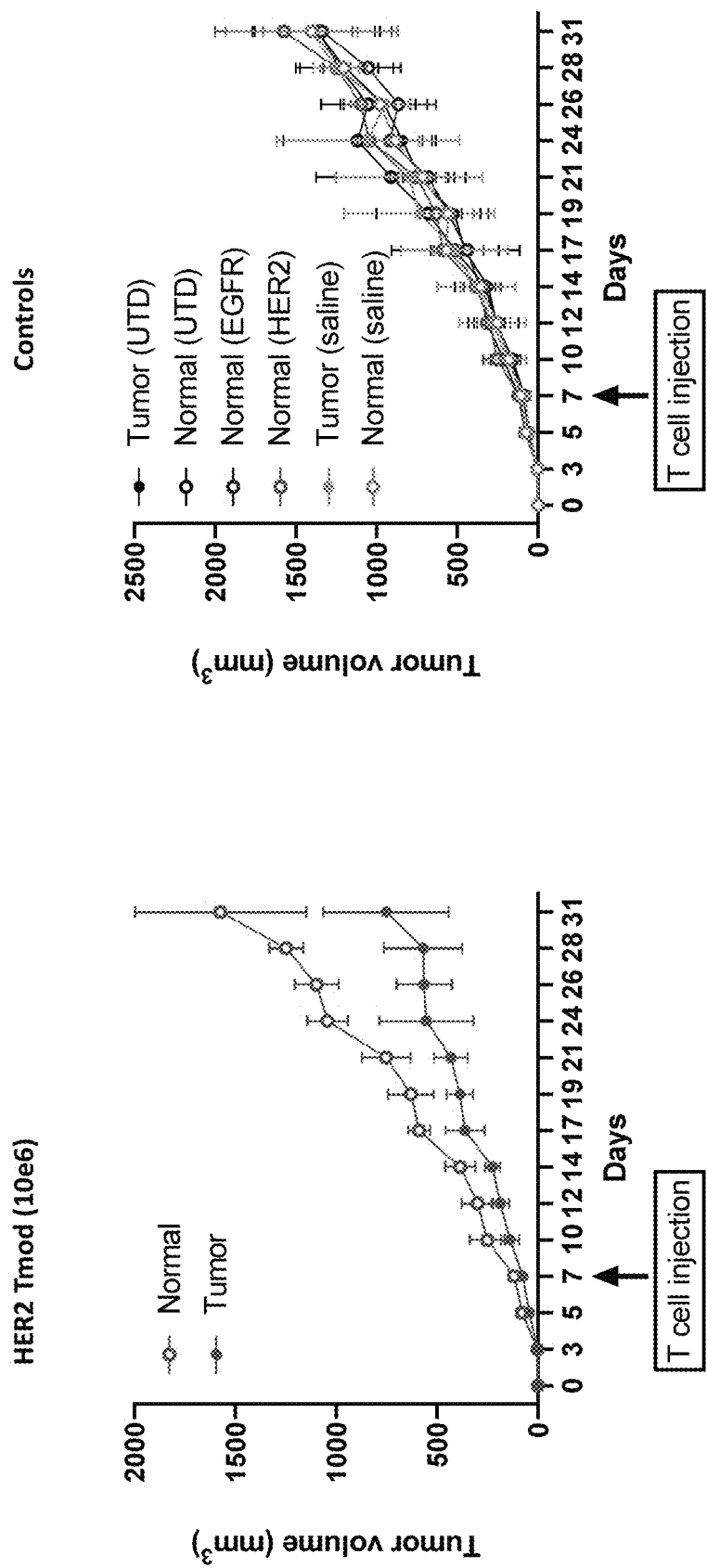
FIG. 11 is a pair of plots showing that primary T cells expressing the HER2 CAR and HLA-A*02 inhibitory receptor selectively kill tumor cells, and not normal cells, in a mouse xenograft model of a HER2 positive cancer that has lost expression of HLA-A*02.

Example 6: Activity of Primary T Cells Expressing HER2 CAR and HLA-A*02 Inhibitory Receptor in a Mouse Xenograft Model The optimal dose of T cells to be used for in vivo treatments and studies was assayed using a mouse xenograft model. Mice were implanted with 5e6 target cells in each flank. Target cells were HCT.116 wild type cells ("normal" cells) which are HER2+ and HLA-A*02 positive, or HCT.116 in which HLA-A*02 had been knocked out ("tumor" cells). The normal target cells were grafted in one flank and the tumor cells were grafted in the other flank. Mice were treated with T cells from HLA-A*02 negative donors which were either untransduced, or transduced with the HER2 CAR1 activator receptor (CT292) in combination with the C2162 HLA-A*02 LIR1 inhibitory receptor. Xenograft model mice were injected with 2e6, 5e6, or 10e6 total T cells, and tumor volume was monitored in the days following T cell injection. A diagram of the experiment is shown in FIG. 10. As seen in FIG. 11, T cells expressing the combination of the HER2 CAR and the HLA-A*02 LIR inhibitory receptor showed cytotoxicity and blocking effect in the xenograft in vivo model and a dose of 1e7 total T cells per mouse.

Example 7: Activity of HER2 CAR and HLA-A*02 Inhibitory Receptor Expressed in Jurkat Cells Nine candidates of receptor pairs were tested. scFvs CT292, CT299, or CT1094 were paired with no modules (CAR only), murine blocker (C1765), humanized blocker 1 (C2162), or humanized blocker 2 (C2163). The various combinations of blockers and inhibitors are shown in Table 27.

Figure 15:
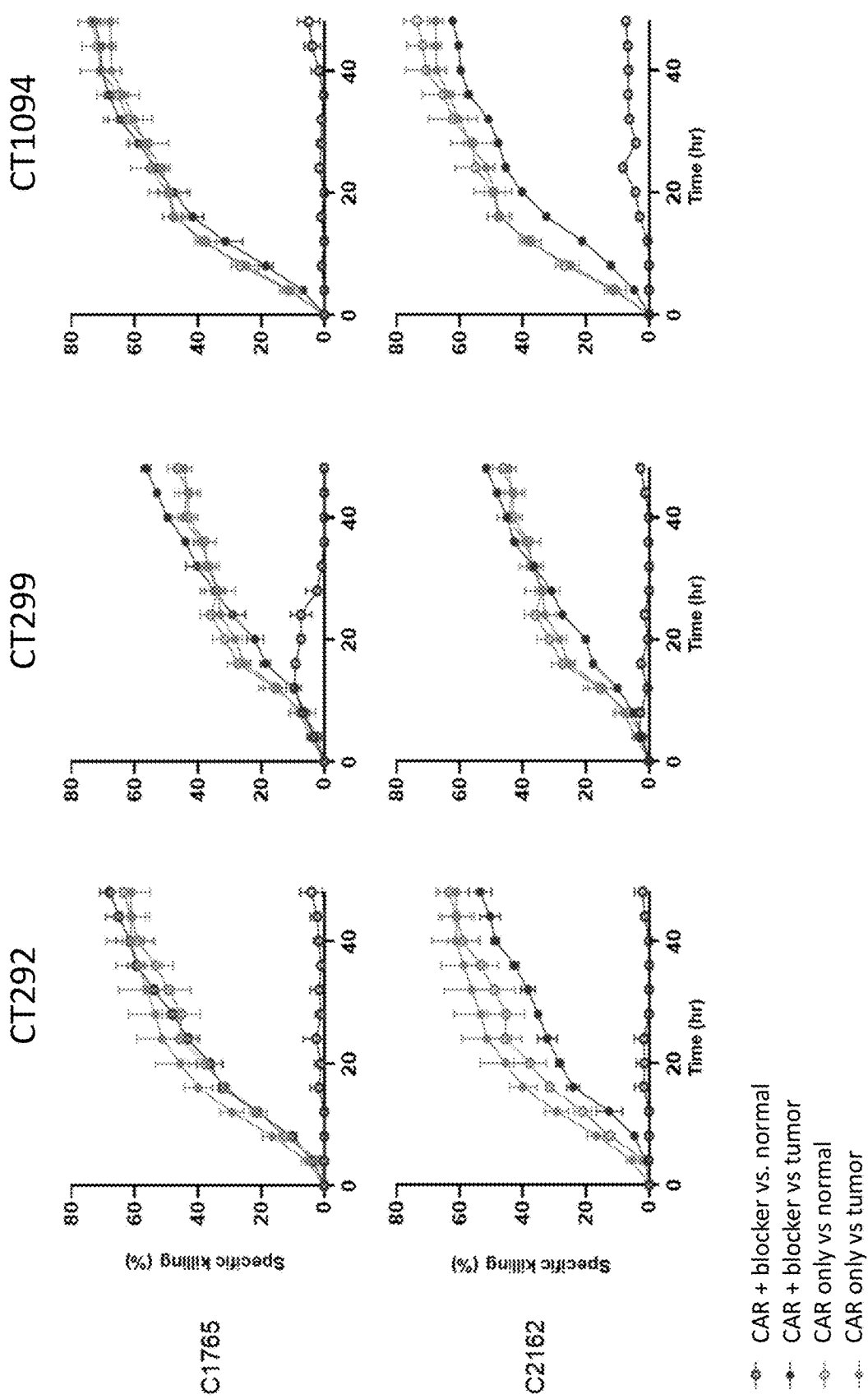
FIG. 15 is a series of plots showing killing of HeLa target cells by primary T cells transduced with 6 candidates of activator-blocker pairs at 1:1 E:T ratio. The activator-blocker pairs comprise scFvs of CT292 (left column), CT299 (middle column), or CT1094; right column) with blockers in murine form (C1765; top row) or humanized form (C2162; bottom row).

Activator and blocker sensitivity was measured using the mRNA titration assay. mRNA was titrated and used to transfect HER2− HeLa target cells, which was then cocultured with Jurkat cells expressing the appropriate HER2 constructs and NFAT luciferase. After 6 hours of coculture, Jurkat cell activation was measured by luminescence inten- Example 8: Selective Cell Killing by Primary T Cell Expressing HER2 CAR and HLA-A*02 Inhibitory Receptor Primary T cells were transduced with six activator-blocker receptor pairs and measured for acute cytotoxicity function on HeLa target cells at 1:1 E:T ratio. Cells were transfected with a HER2 CAR (CT292, CT299, or CT1094) only or with HER2 CAR and blockers in murine form (C1765) or humanized form (C2162). Results are shown in FIG. 15. Cell transfected with any one of the receptor pairs tested selectively killed tumor cells but spared normal cells, while cells transfected with CARs only killed both cell types.

Figure 16:
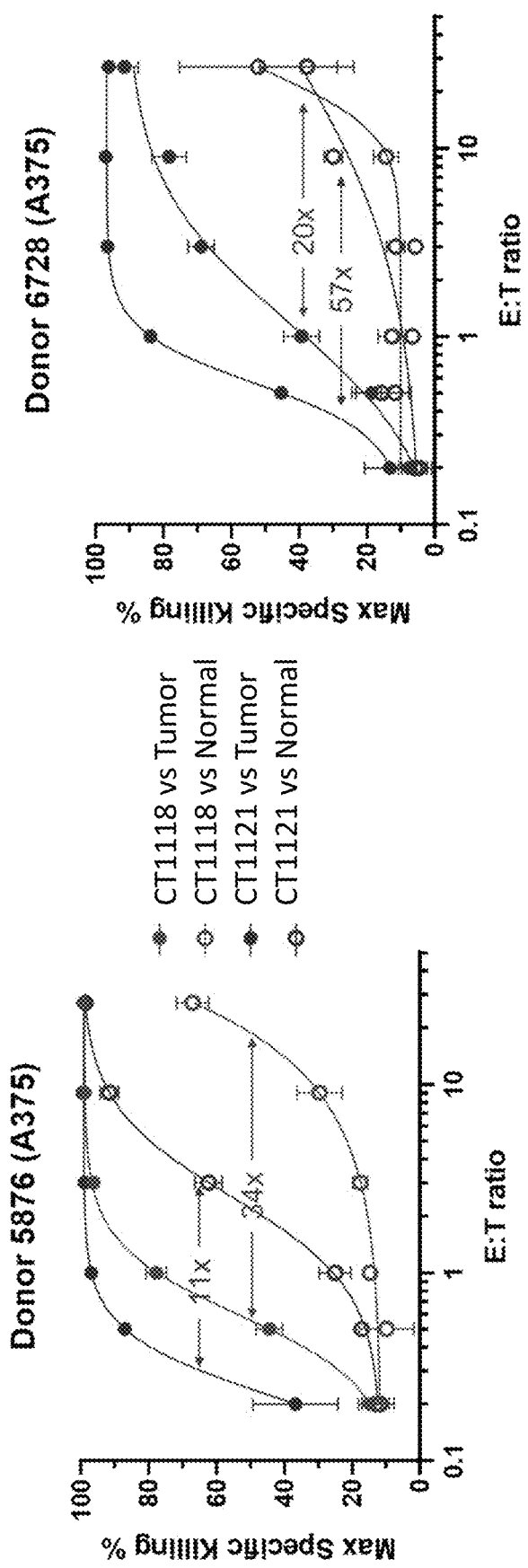
FIG. 16 is a pair of plots showing cell killing of tumor (solid circles) or normal (hollow circles) A375 target cells by CT1118 or CT1121 constructs. This analysis was conducted in two HLA-A*02− T cell donors (left vs right).

Primary T cells were transduced with HER2 CAR CT292 and human blocker 1 (CT1118 cells) or with HER2 CAR CT1094 and human blocker 1 (CT1121 cells) and co-cultured with A375 normal (HLA-A*02-proficient) or tumor (HLA-A*02-deficient) target cells over a wide range of E:T ratios for 48 hours, and the maximum specific killing at each E:T ratio was recorded. The data was fitted using nonlinear regression to derive the E:T ratio giving rise to 50% maximum cytotoxicity (EC50). Results are shown in FIG. 16, where the fold-change of EC50 from tumor to normal target cells is indicated as the selectivity ratio. This analysis was conducted in two individual HLA-A*02− T cell donors (left vs right). Overall, the CT1211 receptor combination is more potent than CT1118. Both constructs are selective, but the CT1118 receptor combination appears to protect normal A375 target cells better over the range of E:T ratios tested.

Example 9: Further Characterization of the CT1118 Receptor Combination

Figure 17:
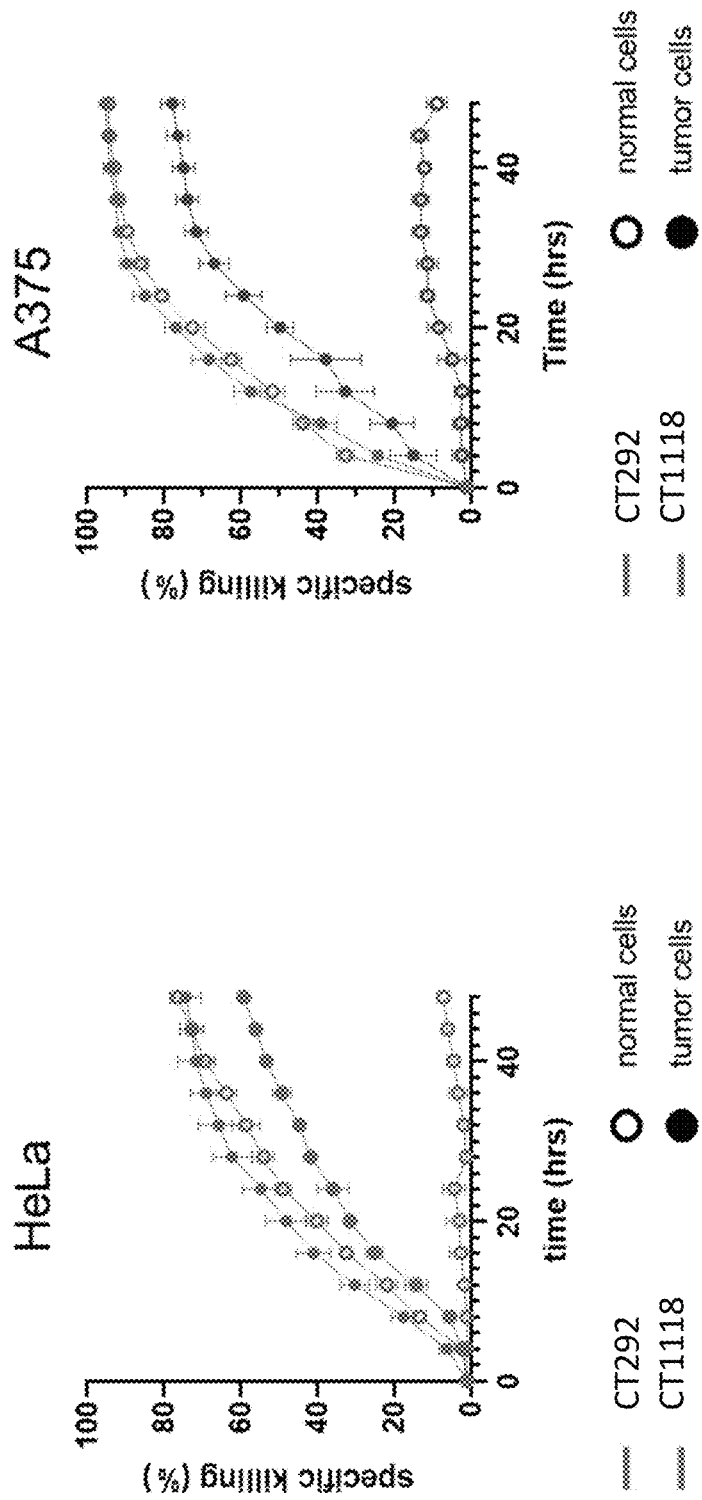
FIG. 17 is a pair of plots showing cell killing of HeLa target cells (left panel) or A375 target cells (right panel) by primary T cell transfected with HER2 CAR1 (CT292) and CAR/human blocker (CT2162) at 1:1 E:T ratio.

The CT1118 receptor combination (CT292 CAR and human blocker CT2162) was benchmarked against the CT292 CAR alone. Primary T cells were transduced with CT292 alone or in combination with CT2162 and acute cytotoxicity at 1:1 E:T ratio on HeLa target cells or A375 target cells was evaluated. Results are shown in FIG. 17. CT292 cells killed both tumor and normal cells than CT1118 cells. CT1118 cells killed tumor cells with similar efficiency as the CT292 cells while sparing normal cells, thus demonstrating improved selectivity of the receptor combination over the CAR alone.

Figure 18:
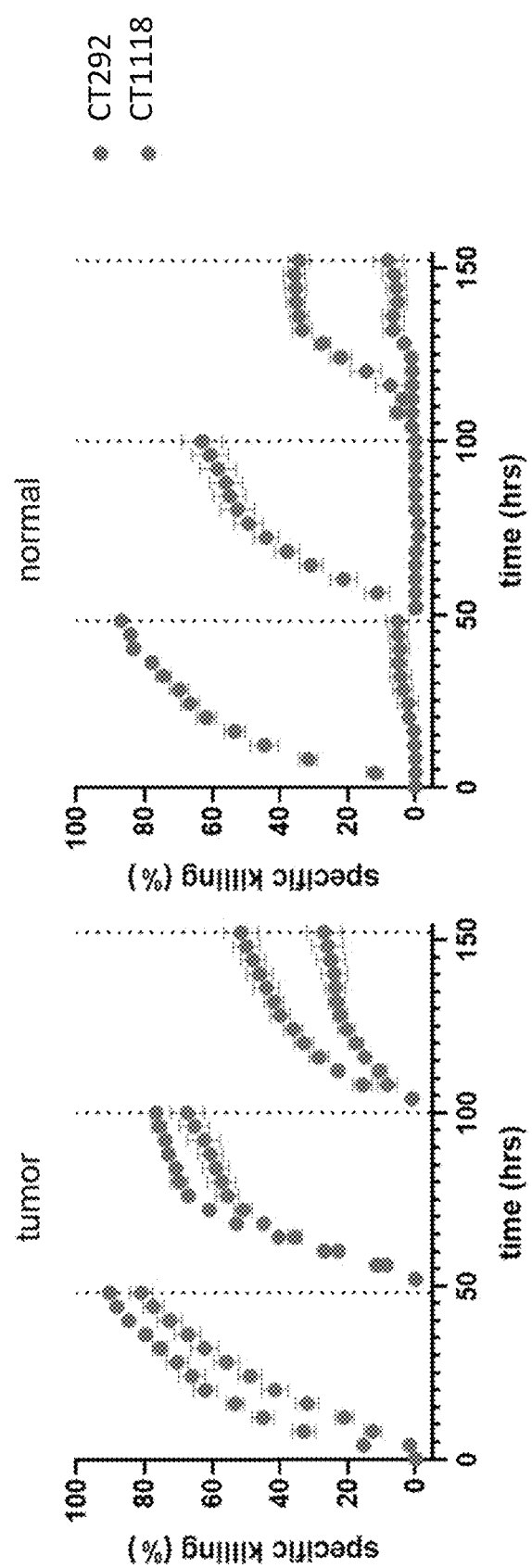
FIG. 18 is a pair of plots showing cell killing of HER2+/HLA-A*02− HeLa target cells (left panel) or normal HeLa target cells (right panel) by primary T cells transfected with HER2 CAR1 or CT2162 in three 48-hour rounds of tumor rechallenge on at 1:1 E:T ratio.

Next, the activity and selectivity of the CT1118 cells was evaluated after rechallenge. Results are shown in FIG. 18. Primary CT292 T cells and CT1118 T cells maintained similar potency for up to three 48-hour rounds of tumor rechallenge on HER2+/HLA-A*02− HeLa target cells at 1:1 E:T ratio. However, the CT1118 cells continuously spared HER2+/HLA-A*02+ HeLa target cells, while CT292 cells did not.

Example 10: Reversibility of CT1118 Function

Figure 19:
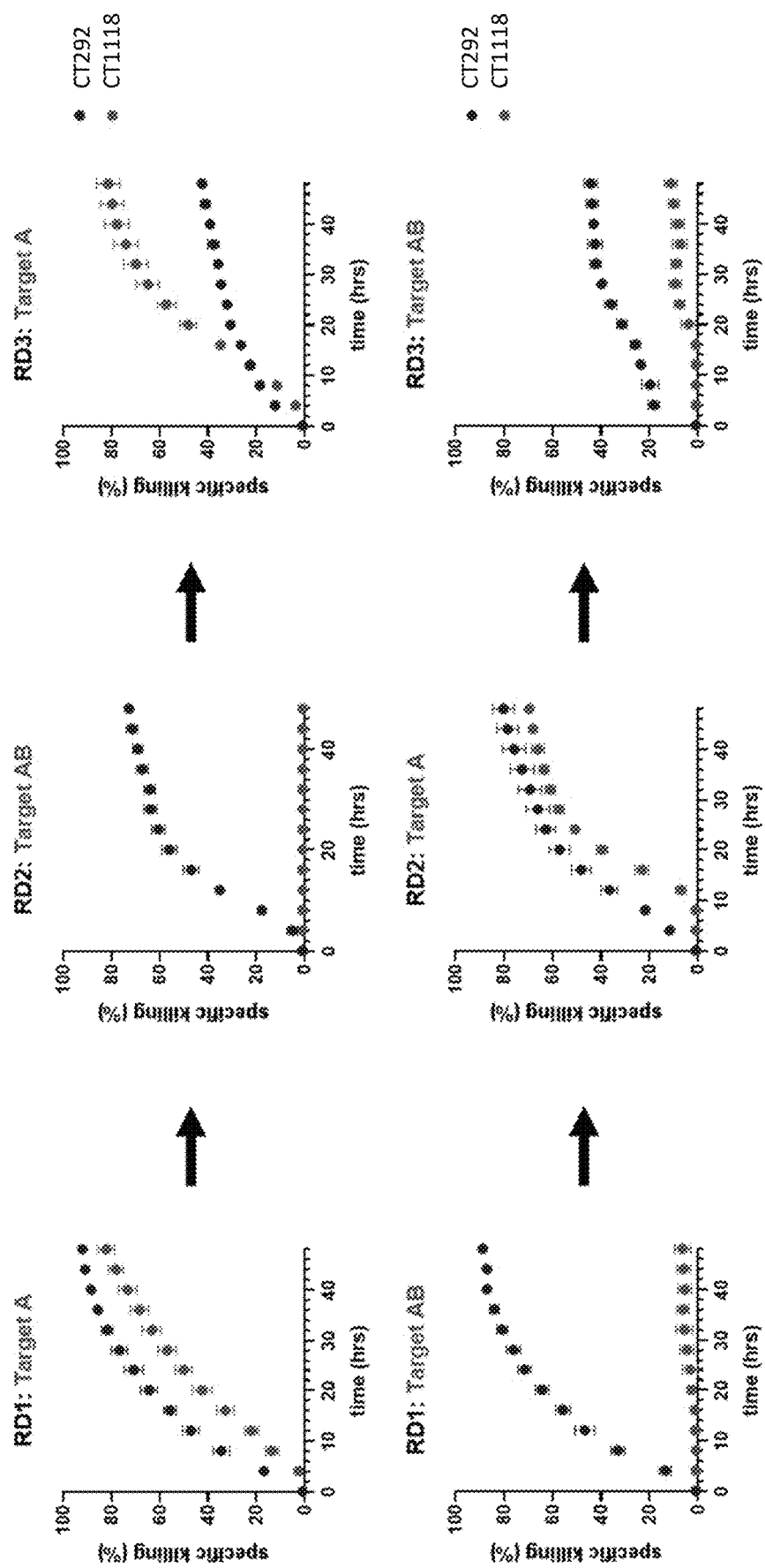
FIG. 19 is a series of plots showing reversibility of the ability of HER2 CAR1 and CT2162 to kill tumor (target A; HER2+/HLA-A*02−) or normal (target AB; HER2+/HLA-A*02+) HeLa cells in 48-hour rounds at 1:1 E:T ratio. Arrows indicate the sequence of exposure: tumor→normal-→tumor (top panel) vs normal→top→normal (bottom panel).
Figure 20:
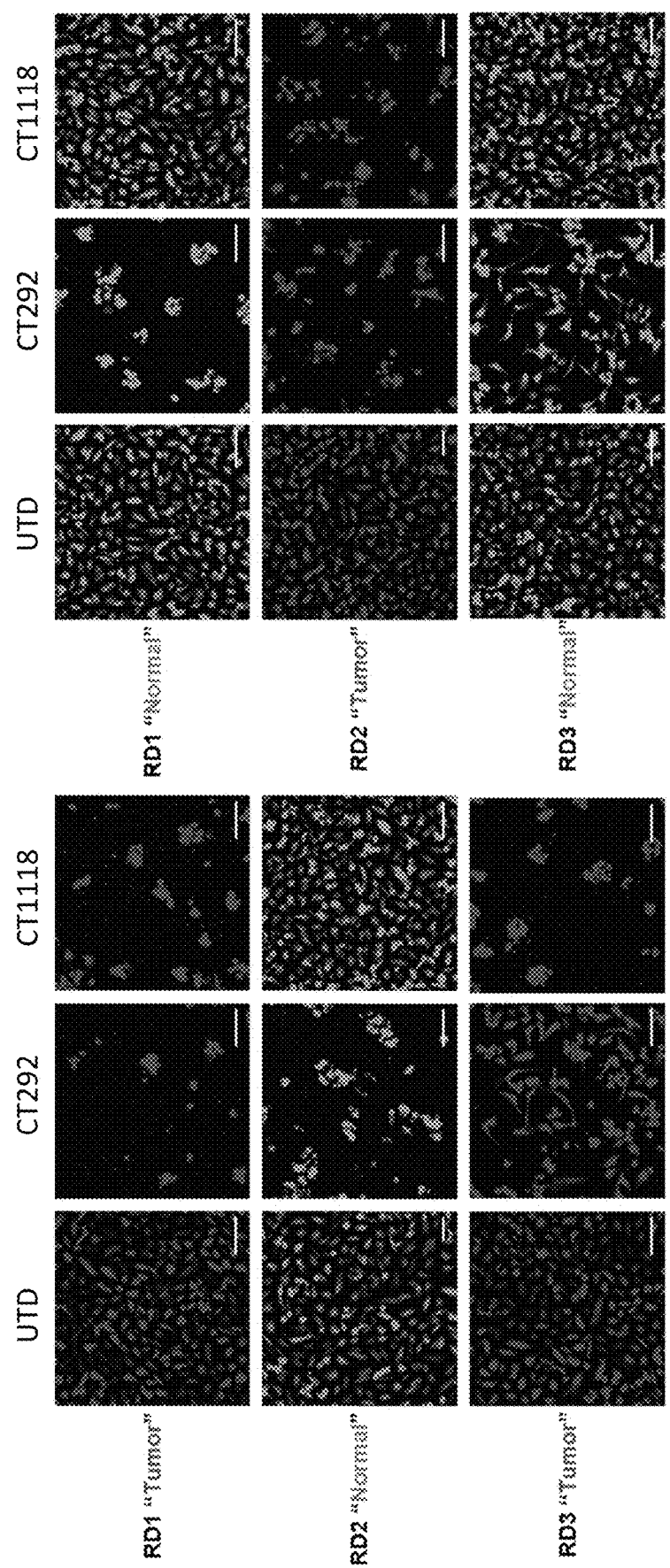
FIG. 20 is a series of images showing reversibility of the ability of untransduced T cells (UTD), HER2 CAR1 T cells, or CT2162 cells to kill HER2+/HLA-A*02− HeLa cells ("Tumor") or HER2+/HLA-A*02+ HeLa cells ("Normal") at 1:1 E:T ratio. Images of the target cells at t=48 hrs are shown for each sequence i.e. left panel: tumor→normal-→tumor vs right panel: normal→tumor→normal. Scale bar=50 μm.
Figure 21:
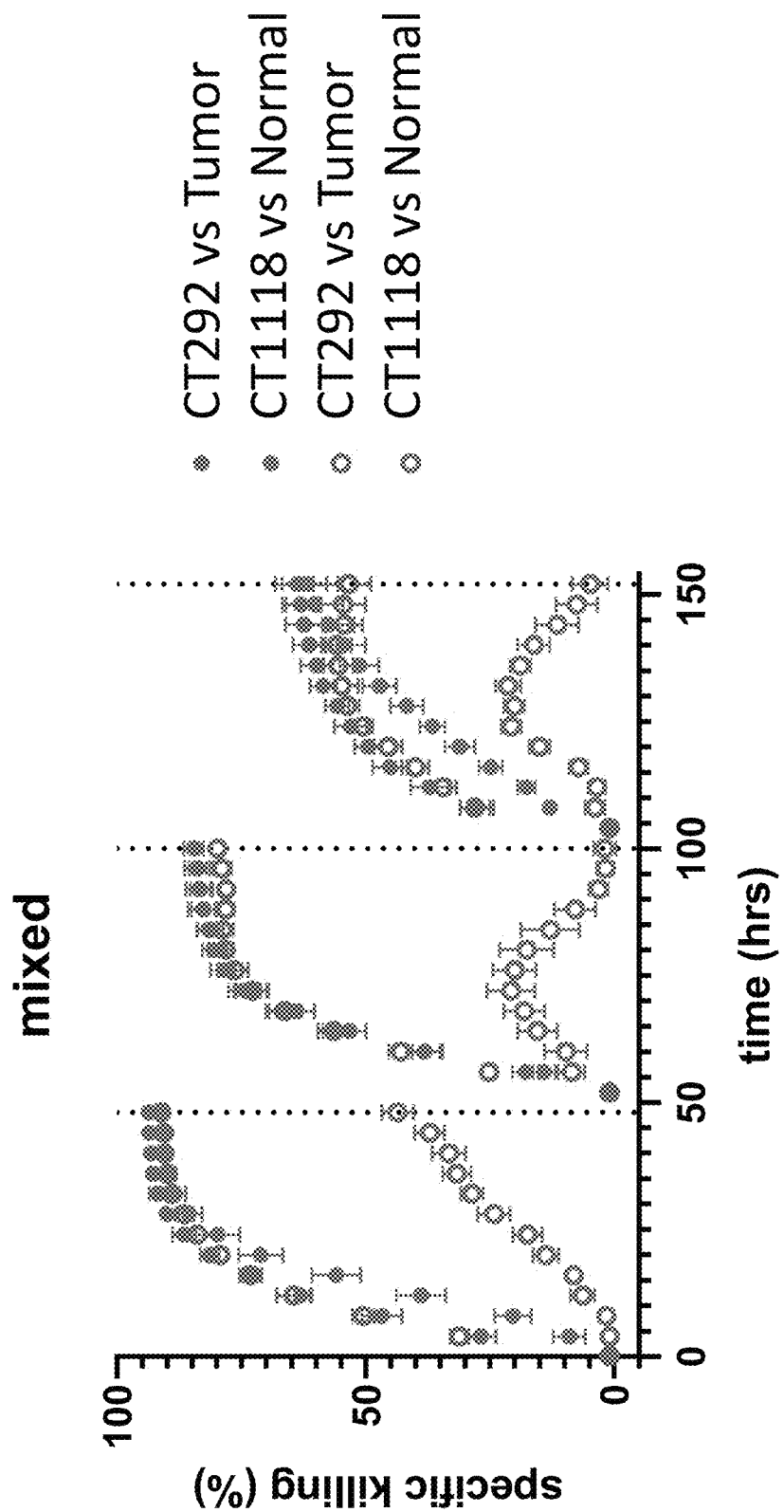
FIG. 21 is a plot showing selective killing of tumor (target A; solid circles) and normal (target AB; hollow circles) HeLa target cells by HER2 CAR1 and CT2162 cells at a 1:1 ratio over three rounds of 48-hours.
Figure 22:
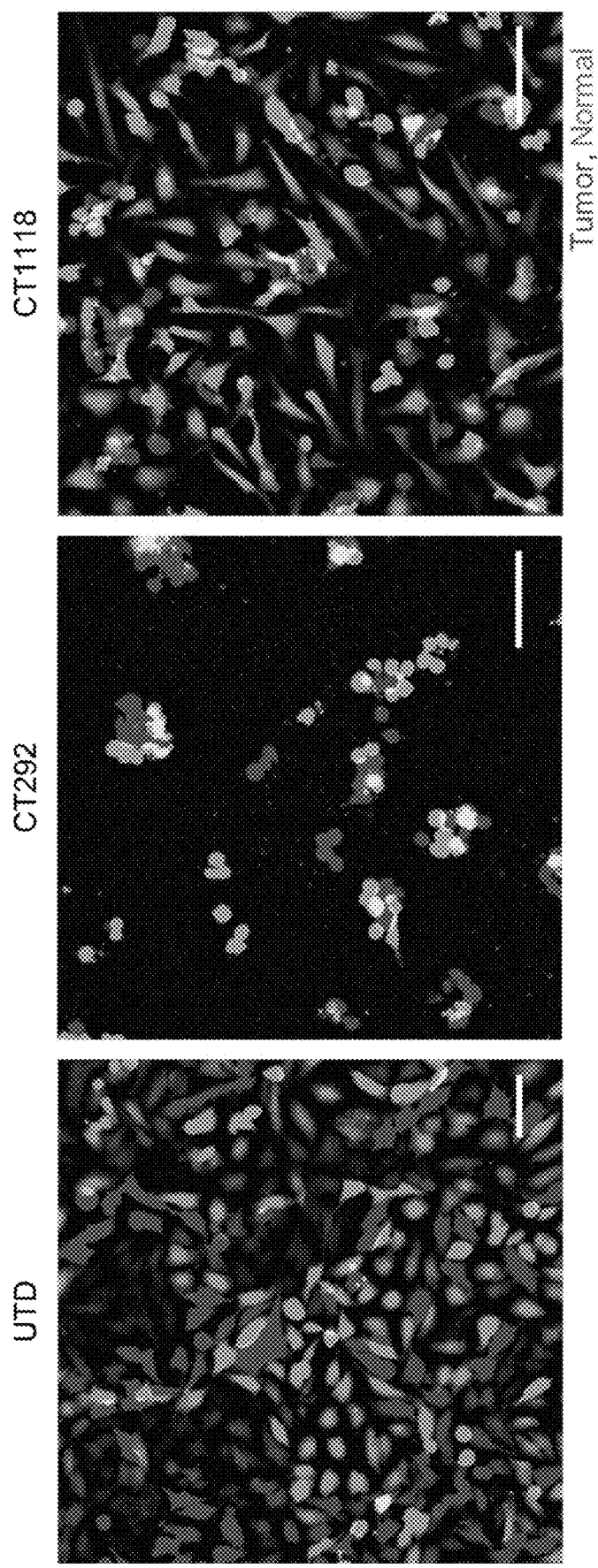
FIG. 22 is a series of images showing selective killing of tumor but not normal HeLa target cells in a mixed culture after 20 hours of coculture with untransduced (UTD; left), CT292 (middle), or CT118 (right) cells.
Figure 23:
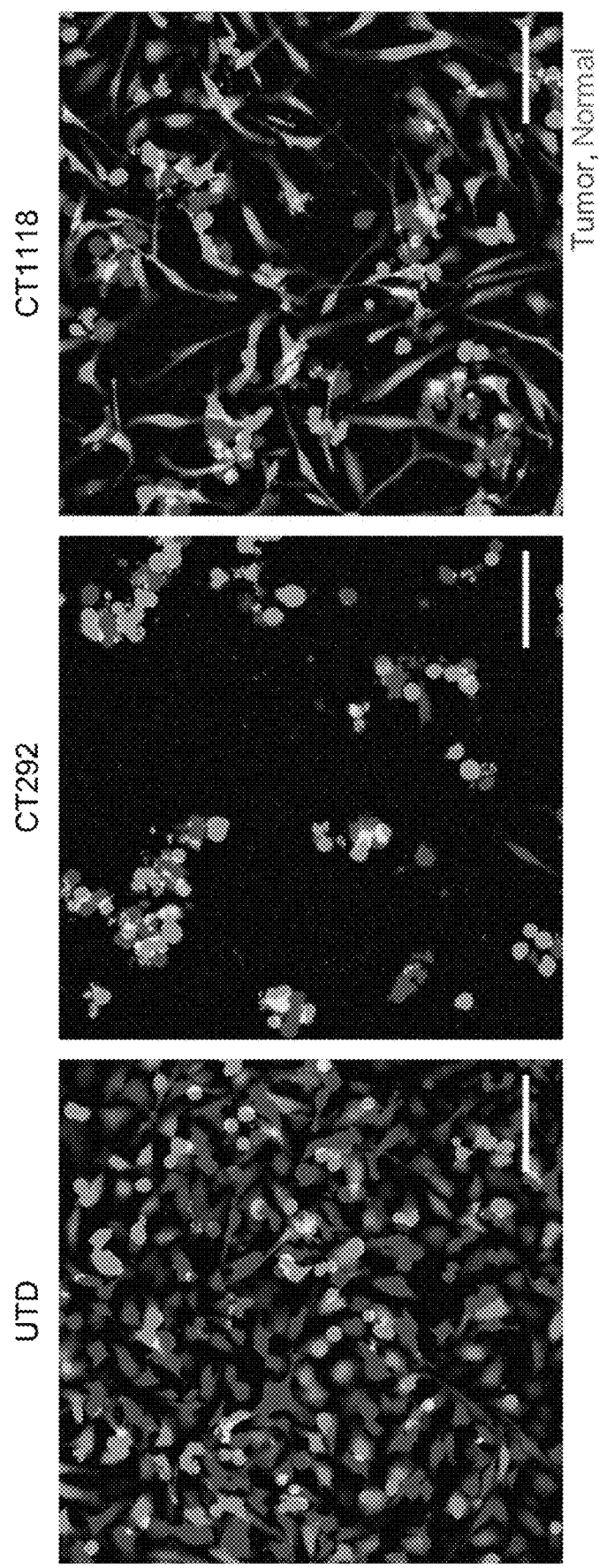
FIG. 23 is a series of images showing selective killing of tumor but not normal HeLa target cells in a rechallenge (i.e. round 2) of mixed culture after 24 hours of coculture with untransduced (UTD; left), CT292 (middle), or CT118 (right) cells.

The reversibility of the function of CT292 and CT1118 cells was evaluated by coculturing CT292 cells and CT1118 cells with HeLa isotypes of tumor (target A; HER2+/HLA-A*02−) or normal (target AB; HER2+/HLA-A*02+) for 48 hours per round at 1:1 E:T ratio. Results are shown in FIG. 19. CT292 T cells killed both cell types while CT1118 cells showed reversible activation. Moreover, CT1118 cells showed inactivation of cytotoxicity, which was dependent on the HLA-A*02 status. This reversibility of function was observed regardless of the sequence of exposure, tumor-→normal→tumor or normal→top→normal. FIG. 20 shows images of the target cells at t=48 hrs for each sequence (left panel: tumor→normal→tumor; right panel: normal→tumor-→normal). Regardless of the sequence, CT1118 cells exhibited reversible function. UTD treatment resulted in healthy, adherent target cells regardless of HLA-A*02 expression while CT292 cells killed both tumor and normal target cells. CT1118 cells selectively killed tumor cells but spared normal cells Example 11: Selectivity Toxicity of CT1118 in Mixed Culture Selective cytotoxicity was assessed by coculturing CT292 cells or CT1118 cells with tumor and normal HeLa target cells mixed at a 1:1 ratio for three 48-hour rounds. Results are shown in FIG. 21. CT1118 cells showed continuous selective killing of tumor cells, whereas CT292 cells killed both cell types. FIG. 22 shows images of tumor and normal HeLa target cells in a mixed culture after 20 hours of coculture with untransduced T cells, CT292 cells, or CT1118 cells. CT292 cells killed both normal and tumor cells, while CT1118 cells selectively killed tumor cells. FIG. 23 shows that the selectivity of CT1118 is maintained after a rechallenge for 24 hours.

Example 12: Effects of CT292 In Vivo

Figure 24:
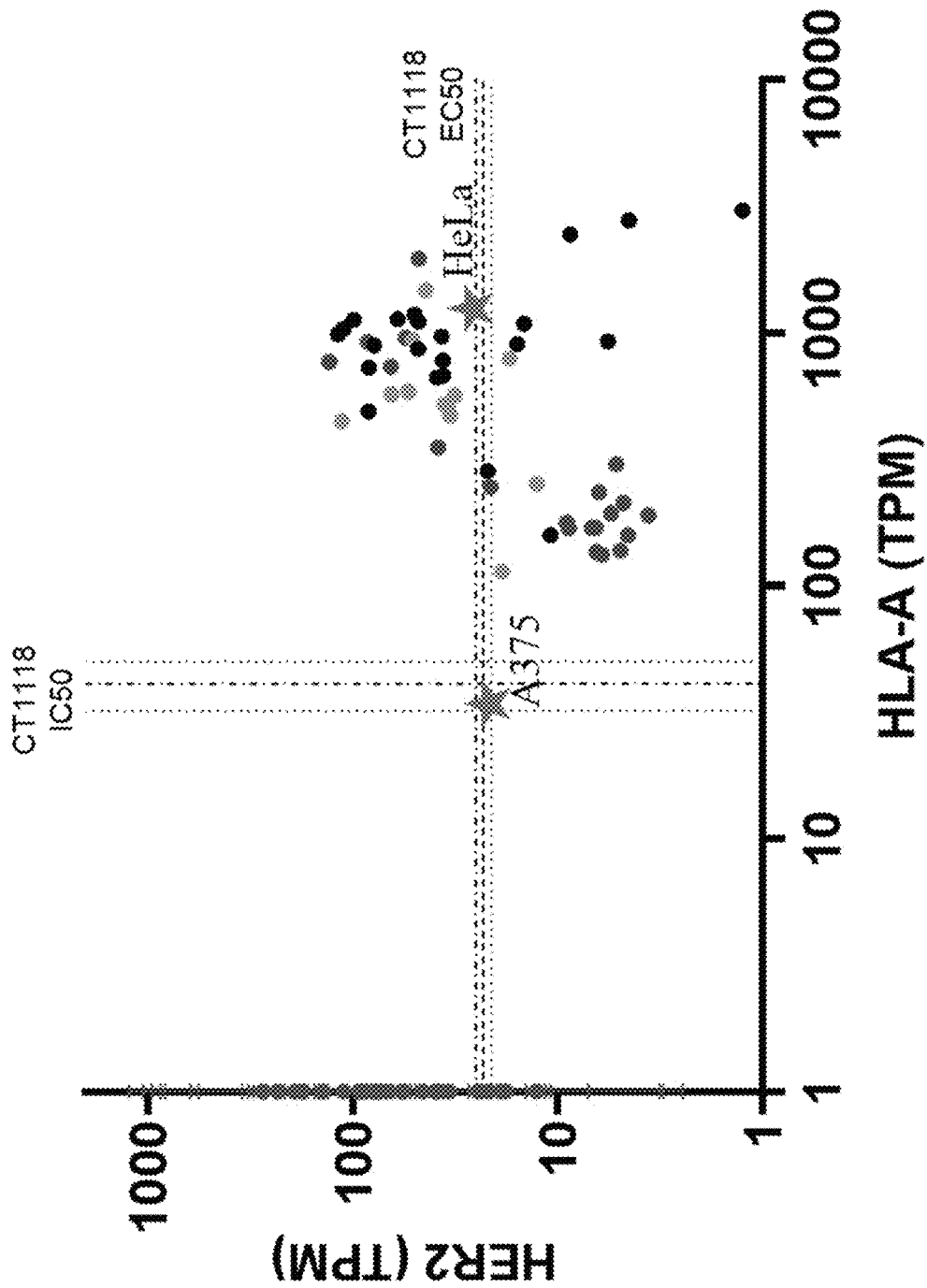
FIG. 24 shows a Quant Plot of HER2 and HLA-A2 expression in normal, tumors (assuming LOH of HLA-A2), and cell lines (stars). The EC50 and IC50 of CT1118 are marked by dashed lines. Lighter dashed lines show the range of measured EC50 and IC50s. A375, the cell line used in the in vivo study described in Example 12, has HER2 and HLA-A2 expression similar to the EC50 and IC50 of HER2 CT1118, respectively.

1E6 A375 A2+ (normal) and A2− (tumor) were grafted on each flank of the NSG mice on day 0. A375 cells have HER2 and HLA-A2 expression similar to the EC50 and IC50 of CT1118, respectively (FIG. 24). On day 8, untransduced ("UTD"), CT292 cells, and CT1118 cells were injected at 20 million cells per mouse. Tumor volumes were measured by caliper every 2-3 days after injection.

Figure 25:
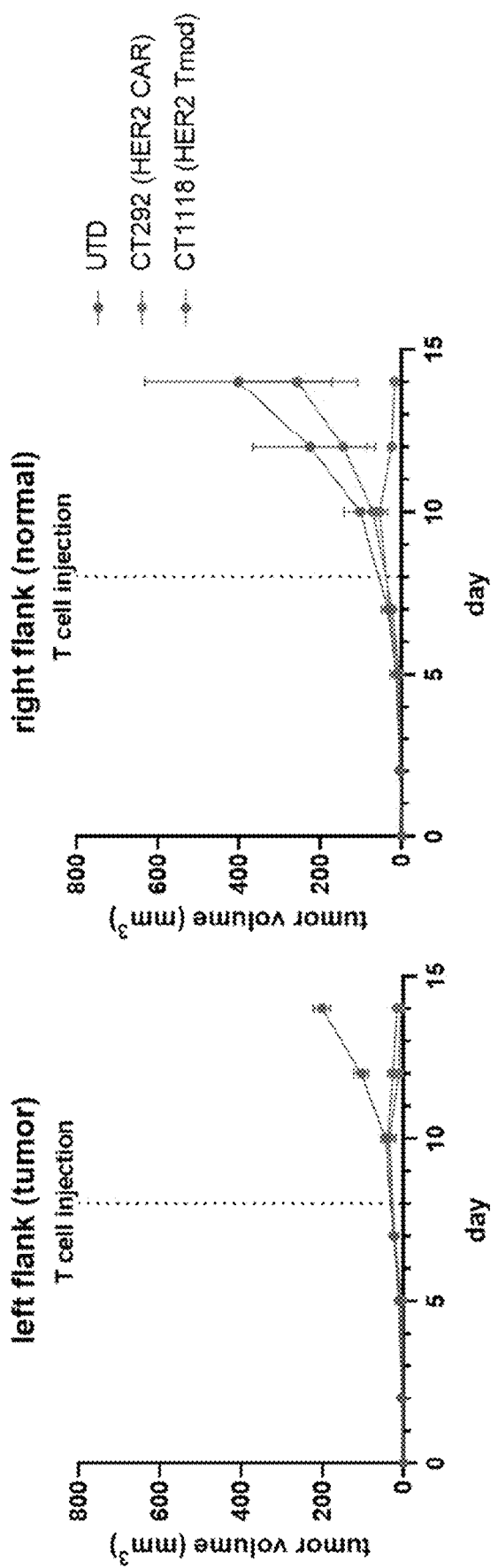
FIG. 25 shows tumor volume in mice bearing tumor (left panel) and normal (right panel) A375 xenografts after treatment with Untransduced ("UTD") cells, CT292 cells, and CT1118 cells.

Results are shown in FIG. 25. CT292 cells reduced both tumor and normal xenografts, while CT1118 cells selectively reduced the tumor xenograft but not the normal xenograft.

Example 13: In Vitro Efficacy of CT292 Paired With HLA-A03, HLA-A*11 or HLA-B807 Blockers Jurkat NFAT luciferase (JNL) cell inhibition with the CT292 paired with either HLA-A*03:01 blocker 26 (comprising an scFv of SEQ ID NO: 405), HLA-A*11:01 blocker 4 (comprising an scFv of SEQ ID NO: 345), or HLA-B*07:02 blocker BB7.1 (comprising an scFv of SEQ ID NO: 21806) was measured in an mRNA titration assay.

Figure 26A:
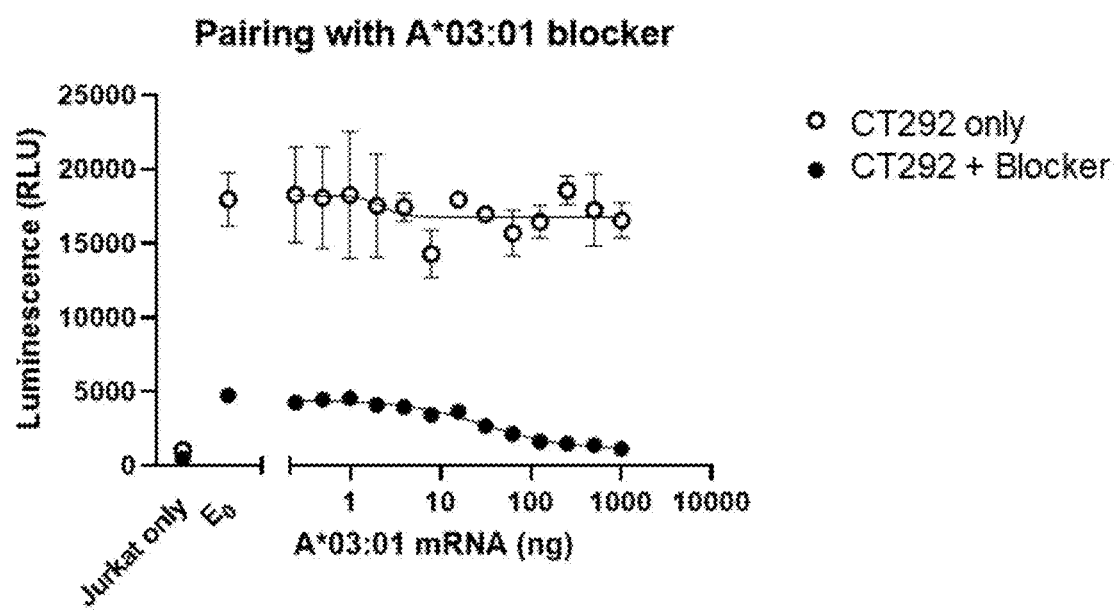
FIGS. 26A-26C show Jurkat NFAT luciferase (JNL) cell inhibition with CT292 paired with either a HLA-A*03 blocker, a HLA-A*11 blocker, or a HLA-B*07 blocker measured in an mRNA titration assay.
Figure 26B:
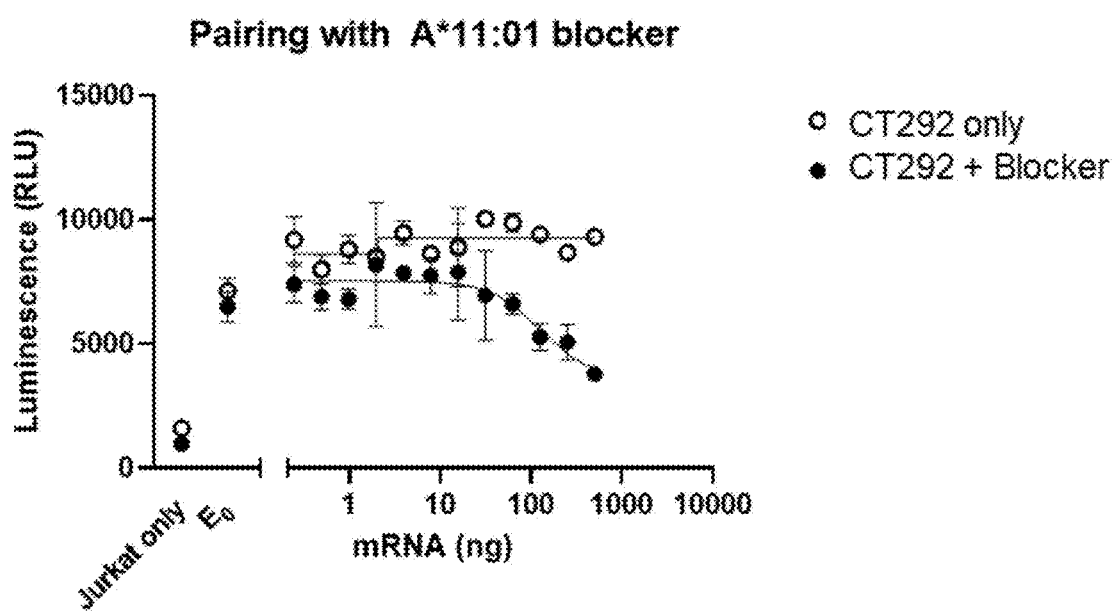
Figure 26C:
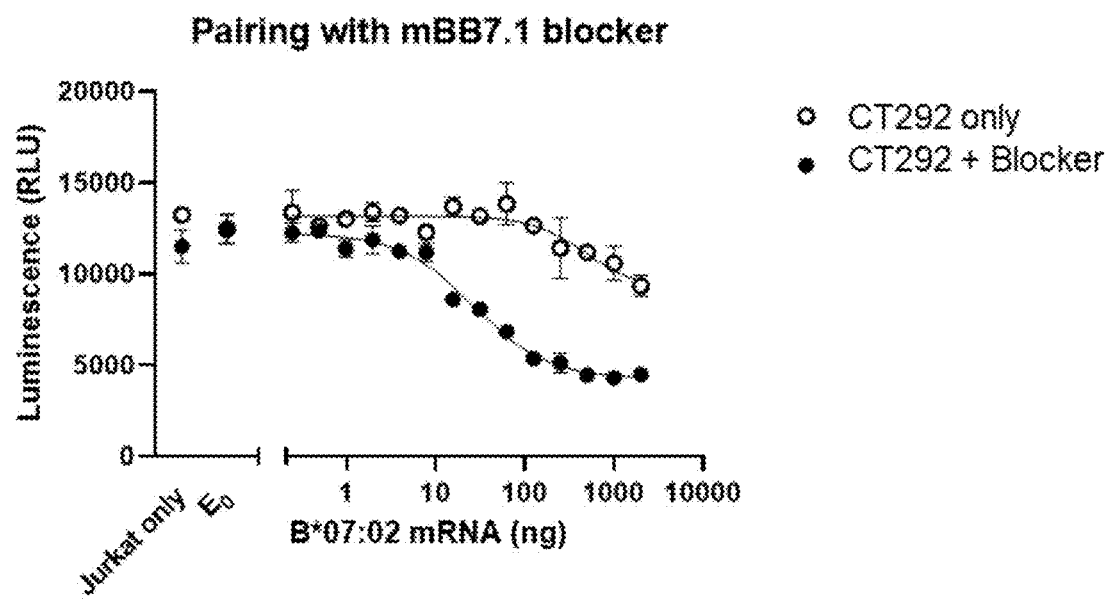

JNL cell activation was measured in an mRNA titration assay using HeLa cells transfected with mRNA. HeLa cells were transfected with serially-diluted mRNA encoding either the A*03:01, A*11:01, or B*07:02 blocker. JNL cells were transiently transfected with CT292 and negative control vector (open circle), or CT292 and either the HLA-A*03:01, HLA-A*11:01, or HLA-B*07:02 blocker (closed circle). The functional response was assessed after a 6-hour co-culture of 5,000 JNL cells and 5,000 HeLa cells. Data are shown in FIGS. 26A-26C. The results show that all blockers block activation of the HER2 CAR in the presence of titrated corresponding HLA mRNAs.

Figure 27:
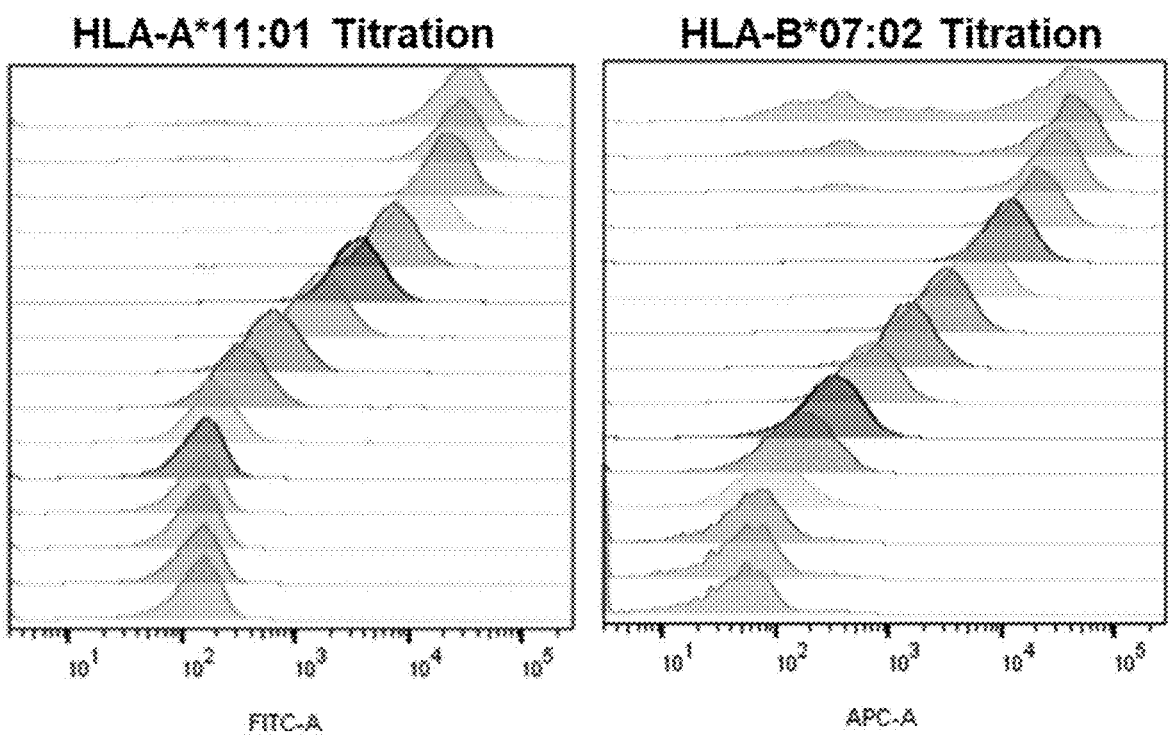
FIG. 27 shows titrated HLA-A*11:01 or HLA-B*07:02 protein on the surface of HeLa cells upon mRNA transfection. HeLa cells were transfected with 2× serially-diluted mRNA encoding either FLAG-tagged HLA-A*11:01 or FLAG-tagged HLA-B*07:02 with top dose of 2000 ng per 200,000 HeLa cells. The bottom panel contains 0 ng mRNA.

HLA-A*11:01 or HLA-B*07:02 protein on the surface of HeLa cells upon mRNA transfection was assessed by flow cytometer. HeLa cells were transfected with 2× serially-diluted mRNA encoding either FLAG-tagged HLA-A*11:01 or FLAG-tagged HLA-B*07:02 with top dose of 2000 ng per 200,000 HeLa cells. Cells were transfected using the 4D nucleofector X-Unit (Lonza) in the 20 uL format, according to manufacturer's instructions. Transfected cells were transferred to MEM media containing 10% FBS and 0.1% penicillin and streptomycin and incubated at 37° C., 5% CO2 for 16-24 hours. On the next day, cells were mechanically detached and washed twice with 100 uL FACS buffer (PBS+1% BSA), then stained with either anti-HLA*A11:01 (One Lambda 0284HA) or anti-B*07:02 mRNA (BB7.1) antibody for 30 minutes on ice. After 2× wash with 100 uL FACS buffer, cells were stained with either anti-mouse IgG FITC or APC secondary antibody for 30 minutes on ice. Cells were then washed twice with FACS buffer and fluorescence was measured. Results are shown in FIG. 27, where the bottom panel contains 0 ng mRNA.

SEQUENCE LISTING (21806 sequences)

SEQ ID NO: 1 - protein, 10 aa, Artificial Sequence
  Linker
GGGSSGGGSG

SEQ ID NO: 2 - protein, 1255 aa, Artificial Sequence [sequence omitted]

SEQ ID NO: 3 - protein, 1225 aa, Artificial Sequence
  her2 isoform b
MKLRLPASPETHLDMLRHLYQGCQVVQGNLELTYLPTNASLSFLQDIQEVQGYVLIAHNQVRQVPLQRLRIVRGTQLFEDNYALAVLDNGDPLNNTTPVTGASPGGLRELQLRSLTEILKGGVLIQRNPQLCYQDTILWKDIFHKNNQLALTLIDTNRSRACHPCSPMCKGSRCWGESSEDCQSLTRTVCAGGCARCKGPLPTDCCHEQCAAGCTGPKHSDCLACLHFNHSGICELHCPALVTYNTDTFESMPNPEGRYTFGASCVTACPYNYLSTDVGSCTLVCPLHNQEVTAEDGTQRCEKCSKPCARVCYGLGMEHLREVRAVTSANIQEFAGCKKIFGSLAFLPESFDGDPASNTAPLQPEQLQVFETLEEITGYLYISAWPDSLPDLSVFQNLQVIRGRILHNGAYSLTLQGLGISWLGLRSLRELGSGLALIHHNTHLCFVHTVPWDQLFRNPHQALLHTANRPEDECVGEGLACHQLCARGHCWGPGPTQCVNCSQFLRGQECVEECRVLQGLPREYVNARHCLPCHPECQPQNGSVTCFGPEADQCVACAHYKDPPFCVARCPSGVKPDLSYMPIWKFPDEEGACQPCPINCTHSCVDLDDKGCPAEQRASPLTSIISAVVGILLVVVLGVVFGILIKRRQQKIRKYTMRRLLQETELVEPLTPSGAMPNQAQMRILKETELRKVKVLGSGAFGTVYKGIWIPDGENVKIPVAIKVLRENTSPKANKEILDEAYVMAGVGSPYVSRLLGICLTSTVQLVTQLMPYGCLLDHVRENRGRLGSQDLLNWCMQIAKGMSYLEDVRLVHRDLAARNVLVKSPNHVKITDFGLARLLDIDETEYHADGGKVPIKWMALESILRRRFTHQSDVWSYGVTVWELMTFGAKPYDGIPAREIPDLLEKGERLPQPPICTIDVYMIMVKCWMIDSECRPRFRELVSEFSRMARDPQRFVVIQNEDLGPASPLDSTFYRSLLEDDDMGDLVDAEEYLVPQQGFFCPDPAPGAGGMVHHRHRSSSTRSGGGDLTLGLEPSEEEAPRSPLAPSEGAGSDVFDGDLGMGAAKGLQSLPTHDPSPLQRYSEDPTVPLPSETDGYVAPLTCSPQPEYVNQPDVRPQPPSPREGPLPAARPAGATLERPKTLSPGKNGVVKDVFAFGGAVENPEYLTPQGGAAPQPHPPPAFSPAFDNLYYWDQDPPERGAPPSTFKGTPTAENPEYLGLDVPV

SEQ ID NO: 4 - protein, 1240 aa, Artificial Sequence
  her2 isoform c
MPRGSWKPQVCTGTDMKLRLPASPETHLDMLRHLYQGCQVVQGNLELTYLPTNASLSFLQDIQEVQGYVLIAHNQVRQVPLQRLRIVRGTQLFEDNYALAVLDNGDPLNNTTPVTGASPGGLRELQLRSLTEILKGGVLIQRNPQLCYQDTILWKDIFHKNNQLALTLIDTNRSRACHPCSPMCKGSRCWGESSEDCQSLTRTVCAGGCARCKGPLPTDCCHEQCAAGCTGPKHSDCLACLHFNHSGICELHCPALVTYNTDTFESMPNPEGRYTFGASCVTACPYNYLSTDVGSCTLVCPLHNQEVTAEDGTQRCEKCSKPCARVCYGLGMEHLREVRAVTSANIQEFAGCKKIFGSLAFLPESFDGDPASNTAPLQPEQLQVFETLEEITGYLYISAWPDSLPDLSVFQNLQVIRGRILHNGAYSLTLQGLGISWLGLRSLRELGSGLALIHHNTHLCFVHTVPWDQLFRNPHQALLHTANRPEDECVGEGLACHQLCARGHCWGPGPTQCVNCSQFLRGQECVEECRVLQGLPREYVNARHCLPCHPECQPQNGSVTCFGPEADQCVACAHYKDPPFCVARCPSGVKPDLSYMPIWKFPDEEGACQPCPINCTHSCVDLDDKGCPAEQRASPLTSIISAVVGILLVVVLGVVFGILIKRRQQKIRKYTMRRLLQETELVEPLTPSGAMPNQAQMRILKETELRKVKVLGSGAFGTVYKGIWIPDGENVKIPVAIKVLRENTSPKANKEILDEAYVMAGVGSPYVSRLLGICLTSTVQLVTQLMPYGCLLDHVRENRGRLGSQDLLNWCMQIAKGMSYLEDVRLVHRDLAARNVLVKSPNHVKITDFGLARLLDIDETEYHADGGKVPIKWMALESILRRRFTHQSDVWSYGVTVWELMTFGAKPYDGIPAREIPDLLEKGERLPQPPICTIDVYMIMVKCWMIDSECRPRFRELVSEFSRMARDPQRFVVIQNEDLGPASPLDSTFYRSLLEDDDMGDLVDAEEYLVPQQGFFCPDPAPGAGGMVHHRHRSSSTRSGGGDLTLGLEPSEEEAPRSPLAPSEGAGSDVFDGDLGMGAAKGLQSLPTHDPSPLQRYSEDPTVPLPSETDGYVAPLTCSPQPEYVNQPDVRPQPPSPREGPLPAARPAGATLERPKTLSPGKNGVVKDVFAFGGAVENPEYLTPQGGAAPQPHPPPAFSPAFDNLYYWDQDPPERGAPPSTFKGTPTAENPEYLGLDVPV

SEQ ID NO: 5 - protein, 1055 aa, Artificial Sequence
  her2 isoform d
MELAALCRWGLLLALLPPGAASTQVCTGTDMKLRLPASPETHLDMLRHLYQGCQVVQGNLELTYLPTNASLSFLQDIQEVQGYVLIAHNQVRQVPLQRLRIVRGTQLFEDNYALAVLDNGDPLNNTTPVTGASPGGLRELQLRSLTEILKGGVLIQRNPQLCYQDTILWKDIFHKNNQLALTLIDTNRSRACHPCSPMCKGSRCWGESSEDCQSLTRTVCAGGCARCKGPLPTDCCHEQCAAGCTGPKHSDCLACLHFNHSGICELHCPALVTYNTDTFESMPNPEGRYTFGASCVTACPYNYLSTDVGSCTLVCPLHNQEVTAEDGTQRCEKCSKPCARVCYGLGMEHLREVRAVTSANIQEFAGCKKIFGSLAFLPESFDGDPASNTAPLQPEQLQVFETLEEITGYLYISAWPDSLPDLSVFQNLQVIRGRILHNGAYSLTLQGLGISWLGLRSLRELGSGLALIHHNTHLCFVHTVPWDQLFRNPHQALLHTANRPEDECVGEGLACHQLCARGHCWGPGPTQCVNCSQFLRGQECVEECRVLQGLPREYVNARHCLPCHPECQPQNGSVTCFGPEADQCVACAHYKDPPFCVARCPSGVKPDLSYMPIWKFPDEEGACQPCPINCTHSCVDLDDKGCPAEQRASPLTSIISAVVGILLVVVLGVVFGILIKRRQQKIRKYTMRRLLQETELVEPLTPSGAMPNQAQMRILKETELRKVKVLGSGAFGTVYKGIWIPDGENVKIPVAIKVLRENTSPKANKEILDEAYVMAGVGSPYVSRLLGICLTSTVQLVTQLMPYGCLLDHVRENRGRLGSQDLLNWCMQIAKGMSYLEDVRLVHRDLAARNVLVKSPNHVKITDFGLARLLDIDETEYHADGGKVPIKWMALESILRRRFTHQSDVWSYGVTVWELMTFGAKPYDGIPAREIPDLLEKGERLPQPPICTIDVYMIMVKCWMIDSECRPRFRELVSEFSRMARDPQRFVVIQNEDLGPASPLDSTFYRSLLEDDDMGDLVDAEEYLVPQQGFFCPDPAPGAGGMVHHRHRSSSTRNM

SEQ ID NO: 6 - protein, 603 aa, Artificial Sequence
  her2 isoform e
MKLRLPASPETHLDMLRHLYQGCQVVQGNLELTYLPTNASLSFLQDIQEVQGYVLIAHNQVRQVPLQRLRIVRGTQLFEDNYALAVLDNGDPLNNTTPVTGASPGGLRELQLRSLTEILKGGVLIQRNPQLCYQDTILWKDIFHKNNQLALTLIDTNRSRACHPCSPMCKGSRCWGESSEDCQSLTRTVCAGGCARCKGPLPTDCCHEQCAAGCTGPKHSDCLACLHFNHSGICELHCPALVTYNTDTFESMPNPEGRYTFGASCVTACPYNYLSTDVGSCTLVCPLHNQEVTAEDGTQRCEKCSKPCARVCYGLGMEHLREVRAVTSANIQEFAGCKKIFGSLAFLPESFDGDPASNTAPLQPEQLQVFETLEEITGYLYISAWPDSLPDLSVFQNLQVIRGRILHNGAYSLTLQGLGISWLGLRSLRELGSGLALIHHNTHLCFVHTVPWDQLFRNPHQALLHTANRPEDECVGEGLACHQLCARGHCWGPGPTQCVNCSQFLRGQECVEECRVLQGLPREYVNARHCLPCHPECQPQNGSVTCFGPEADQCVACAHYKDPPFCVARCPSGVKPDLSYMPIWKFPDEEGACQPCPINCTHS

SEQ ID NO: 7 - protein, 1294 aa, Artificial Sequence
  her2 isoform f
MELAALCRWGLLLALLPPGAASTQVCTGTDMKLRLPASPETHLDMLRHLYQGCQVVQGNLELTYLPTNASLSFLQDIQEVQGYVLIAHNQVRQVPLQRLRIVRGTQLFEDNYALAVLDNGDPLNNTTPVTGASPGGLRELQLRSLTEILKGGVLIQRNPQLCYQDTILWKDIFHKNNQLALTLIDTNRSRACHPCSPMCKGSRCWGESSEDCQSLTRTVCAGGCARCKGPLPTDCCHEQCAAGCTGPKHSDCLACLHFNHSGICELHCPALVTYNTDTFESMPNPEGRYTFGASCVTACPYNYLSTDVGSCTLVCPLHNQEVTAEDGTQRCEKCSKPCARVCYGLGMEHLREVRAVTSANIQEFAGCKKIFGSLAFLPESFDGVSLCQQAGVQWYDLGSLQPLPPGFKQFSCLSLLSSWDYRDPASNTAPLQPEQLQVFETLEEITGYLYISAWPDSLPDLSVFQNLQVIRGRILHNGAYSLTLQGLGISWLGLRSLRELGSGLALIHHNTHLCFVHTVPWDQLFRNPHQALLHTANRPEDECVGEGLACHQLCARGHCWGPGPTQCVNCSQFLRGQECVEECRVLQGLPREYVNARHCLPCHPECQPQNGSVTCFGPEADQCVACAHYKDPPFCVARCPSGVKPDLSYMPIWKFPDEEGACQPCPINCTHSCVDLDDKGCPAEQRASPLTSIISAVVGILLVVVLGVVFGILIKRRQQKIRKYTMRRLLQETELVEPLTPSGAMPNQAQMRILKETELRKVKVLGSGAFGTVYKGIWIPDGENVKIPVAIKVLRENTSPKANKEILDEAYVMAGVGSPYVSRLLGICLTSTVQLVTQLMPYGCLLDHVRENRGRLGSQDLLNWCMQIAKGMSYLEDVRLVHRDLAARNVLVKSPNHVKITDFGLARLLDIDETEYHADGGKVPIKWMALESILRRRFTHQSDVWSYGVTVWELMTFGAKPYDGIPAREIPDLLEKGERLPQPPICTIDVYMIMVKCWMIDSECRPRFRELVSEFSRMARDPQRFVVIQNEDLGPASPLDSTFYRSLLEDDDMGDLVDAEEYLVPQQGFFCPDPAPGAGGMVHHRHRSSSTRSGGGDLTLGLEPSEEEAPRSPLAPSEGAGSDVFDGDLGMGAAKGLQSLPTHDPSPLQRYSEDPTVPLPSETDGYVAPLTCSPQPEYVNQPDVRPQPPSPREGPLPAARPAGATLERPKTLSPGKNGVVKDVFAFGGAVENPEYLTPQGGAAPQPHPPPAFSPAFDNLYYWDQDPPERGAPPSTFKGTPTAENPEYLGLDVPV

SEQ ID NO: 8 - protein, 1289 aa, Artificial Sequence
  her2 isoform g
MELAALCRWGLLLALLPPGAASTQVCTGTDMKLRLPASPETHLDMLRHLYQGCQVVQGNLELTYLPTNASLSFLQDIQEVQGYVLIAHNQVRQVPLQRLRIVRGTQLFEDNYALAVLDNGDPLNNTTPVTGASPGGLRELQLRSLTEILKGGVLIQRNPQLCYQDTILWKDIFHKNNQLALTLIDTNRSRACHPCSPMCKGSRCWGESSEDCQSLTRTVCAGGCARCKGPLPTDCCHEQCAAGCTGPKHSDCLACLHFNHSGICELHCPALVTYNTDTFESMPNPEGRYTFGASCVTACPYNYLSTDVGSCTLVCPLHNQEVTAEDGTQRCEKCSKPCARVCYGLGMEHLREVRAVTSANIQEFAGCKKIFGSLAFLPESFDGDPASNTAPLQPEQLQVFETLEEITGYLYISAWPDSLPDLSVFQNLQVIRGRILHNGAYSLTLQGLGISWLGLRSLRELGSGLALIHHNTHLCFVHTVPWDQLFRNPHQALLHTANRPEDECVGEGLACHQLCARGHCWGPGPTQCVNCSQFLRGQECVEECRVLQGLPREYVNARHCLPCHPECQPQNGSVTCFGPVMRFPLWVPPIFWLKSLPRIKLGGGPRGRGHRDWEADQCVACAHYKDPPFCVARCPSGVKPDLSYMPIWKFPDEEGACQPCPINCTHSCVDLDDKGCPAEQRASPLTSIISAVVGILLVVVLGVVFGILIKRRQQKIRKYTMRRLLQETELVEPLTPSGAMPNQAQMRILKETELRKVKVLGSGAFGTVYKGIWIPDGENVKIPVAIKVLRENTSPKANKEILDEAYVMAGVGSPYVSRLLGICLTSTVQLVTQLMPYGCLLDHVRENRGRLGSQDLLNWCMQIAKGMSYLEDVRLVHRDLAARNVLVKSPNHVKITDFGLARLLDIDETEYHADGGKVPIKWMALESILRRRFTHQSDVWSYGVTVWELMTFGAKPYDGIPAREIPDLLEKGERLPQPPICTIDVYMIMVKCWMIDSECRPRFRELVSEFSRMARDPQRFVVIQNEDLGPASPLDSTFYRSLLEDDDMGDLVDAEEYLVPQQGFFCPDPAPGAGGMVHHRHRSSSTRSGGGDLTLGLEPSEEEAPRSPLAPSEGAGSDVFDGDLGMGAAKGLQSLPTHDPSPLQRYSEDPTVPLPSETDGYVAPLTCSPQPEYVNQPDVRPQPPSPREGPLPAARPAGATLERPKTLSPGKNGVVKDVFAFGGAVENPEYLTPQGGAAPQPHPPPAFSPAFDNLYYWDQDPPERGAPPSTFKGTPTAENPEYLGLDVPV

SEQ ID NO: 9 - protein, 1282 aa, Artificial Sequence
  her2 isoform h
MELAALCRWGLLLALLPPGAASTQVCTGTDMKLRLPASPETHLDMLRHLYQGCQVVQGNLELTYLPTNASLSFLQDIQEVQGYVLIAHNQVRQVPLQRLRIVRGTQLFEDNYALAVLDNGDPLNNTTPVTGASPGGLRELQLRSLTEILKGGVLIQRNPQLCYQDTILWKDIFHKNNQLALTLIDTNRSRACHPCSPMCKGSRCWGESSEDCQSLTRTVCAGGCARCKGPLPTDCCHEQCAAGCTGPKHSDCLACLHFNHSGICELHCPALVTYNTDTFESMPNPEGRYTFGASCVTACPYNYLSTDVGSCTLVCPLHNQEVTAEDGTQRCEKCSKPCARVCYGLGMEHLREVRAVTSANIQEFAGCKKIFGSLAFLPESFDGVSLCQQAGVQWYDLGSLQPLPPGFKQFSCLSLLSSWDYRDPASNTAPLQPEQLQVFETLEEITGYLYISAWPDSLPDLSVFQNLQVIRGRILHNGAYSLTLQGLGISWLGLRSLRELGSGLALIHHNTHLCFVHTVPWDQLFRNPHQALLHTANRPEDECVGEGLACHQLCARGHCWGPGPTQCVNCSQFLRGQECVEECRVLQGLPREYVNARHCLPCHPECQPQNGSVTCFGPEADQCVACAHYKDPPFCVARCPSGVKPDLSYMPIWKFPDEEGACQPCPINCTHSCVDLDDKGCPAEQRASPLTSIISAVVGILLVVVLGVVFGILIKRRQQKIRKYTMRRLLQETELVEPLTPSGAMPNQAQMRILKETELRKVKGIWIPDGENVKIPVAIKVLRENTSPKANKEILDEAYVMAGVGSPYVSRLLGICLTSTVQLVTQLMPYGCLLDHVRENRGRLGSQDLLNWCMQIAKGMSYLEDVRLVHRDLAARNVLVKSPNHVKITDFGLARLLDIDETEYHADGGKVPIKWMALESILRRRFTHQSDVWSYGVTVWELMTFGAKPYDGIPAREIPDLLEKGERLPQPPICTIDVYMIMVKCWMIDSECRPRFRELVSEFSRMARDPQRFVVIQNEDLGPASPLDSTFYRSLLEDDDMGDLVDAEEYLVPQQGFFCPDPAPGAGGMVHHRHRSSSTRSGGGDLTLGLEPSEEEAPRSPLAPSEGAGSDVFDGDLGMGAAKGLQSLPTHDPSPLQRYSEDPTVPLPSETDGYVAPLTCSPQPEYVNQPDVRPQPPSPREGPLPAARPAGATLERPKTLSPGKNGVVKDVFAFGGAVENPEYLTPQGGAAPQPHPPPAFSPAFDNLYYWDQDPPERGAPPSTFKGTPTAENPEYLGLDVPV

SEQ ID NO: 10 - protein, 1280 aa, Artificial Sequence
  her2 isoform i
MELAALCRWGLLLALLPPGAASTQVCTGTDMKLRLPASPETHLDMLRHLYQGCQVVQGNLELTYLPTNASLSFLQDIQEVQGYVLIAHNQVRQVPLQRLRIVRGTQLFEDNYALAVLDNGDPLNNTTPVTGASPGGLRELQLRSLTEGRRAPREAEGDRRGKGPLIIAHPTEILKGGVLIQRNPQLCYQDTILWKDIFHKNNQLALTLIDTNRSRACHPCSPMCKGSRCWGESSEDCQSLTRTVCAGGCARCKGPLPTDCCHEQCAAGCTGPKHSDCLACLHFNHSGICELHCPALVTYNTDTFESMPNPEGRYTFGASCVTACPYNYLSTDVGSCTLVCPLHNQEVTAEDGTQRCEKCSKPCARVCYGLGMEHLREVRAVTSANIQEFAGCKKIFGSLAFLPESFDGDPASNTAPLQPEQLQVFETLEEITGYLYISAWPDSLPDLSVFQNLQVIRGRILHNGAYSLTLQGLGISWLGLRSLRELGSGLALIHHNTHLCFVHTVPWDQLFRNPHQALLHTANRPEDECVGEGLACHQLCARGHCWGPGPTQCVNCSQFLRGQECVEECRVLQGLPREYVNARHCLPCHPECQPQNGSVTCFGPEADQCVACAHYKDPPFCVARCPSGVKPDLSYMPIWKFPDEEGACQPCPINCTHSCVDLDDKGCPAEQRASPLTSIISAVVGILLVVVLGVVFGILIKRRQQKIRKYTMRRLLQETELVEPLTPSGAMPNQAQMRILKETELRKVKVLGSGAFGTVYKGIWIPDGENVKIPVAIKVLRENTSPKANKEILDEAYVMAGVGSPYVSRLLGICLTSTVQLVTQLMPYGCLLDHVRENRGRLGSQDLLNWCMQIAKGMSYLEDVRLVHRDLAARNVLVKSPNHVKITDFGLARLLDIDETEYHADGGKVPIKWMALESILRRRFTHQSDVWSYGVTVWELMTFGAKPYDGIPAREIPDLLEKGERLPQPPICTIDVYMIMVKCWMIDSECRPRFRELVSEFSRMARDPQRFVVIQNEDLGPASPLDSTFYRSLLEDDDMGDLVDAEEYLVPQQGFFCPDPAPGAGGMVHHRHRSSSTRSGGGDLTLGLEPSEEEAPRSPLAPSEGAGSDVFDGDLGMGAAKGLQSLPTHDPSPLQRYSEDPTVPLPSETDGYVAPLTCSPQPEYVNQPDVRPQPPSPREGPLPAARPAGATLERPKTLSPGKNGVVKDVFAFGGAVENPEYLTPQGGAAPQPHPPPAFSPAFDNLYYWDQDPPERGAPPSTFKGTPTAENPEYLGLDVPV

SEQ ID NO: 11 - protein, 1265 aa, Artificial Sequence
  her2 isoform j
MELAALCRWGLLLALLPPGAASTQVCTGTDMKLRLPASPETHLDMLRHLYQGCQVVQGNLELTYLPTNASLSFLQDIQEVQGYVLIAHNQVRQVPLQRLRIVRGTQLFEDNYALAVLDNGDPLNNTTPVTGASPGGLRELQLRSLTEILKGGVLIQRNPQLCYQDTILWKDIFHKNNQLALTLIDTNRSRACHPCSPMCKGSRCWGESSEDCQSLTRTVCAGGCARCKGPLPTDCCHEQCAAGCTGPKHSDCLACLHFNHSGICELHCPALVTYNTDTFESMPNPEGRYTFGASCVTACPYNYLSTDVGSCTLVCPLHNQEVTAEDGTQRCEKCSKPCARVCYGLGMEHLREVRAVTSANIQEFAGCKKIFGSLAFLPESFDGDPASNTAPLQPEQLQVFETLEEITGYLYISAWPDSLPDLSVFQNLQVIRGRILHNGAYSLTLQGLGISWLGLRSLRELGSGLALIHHNTHLCFVHTVPWDQLFRNPHQALLHTANRPEDECVPCGPFLLTAVGEGLACHQLCARGHCWGPGPTQCVNCSQFLRGQECVEECRVLQGLPREYVNARHCLPCHPECQPQNGSVTCFGPEADQCVACAHYKDPPFCVARCPSGVKPDLSYMPIWKFPDEEGACQPCPINCTHSCVDLDDKGCPAEQRASPLTSIISAVVGILLVVVLGVVFGILIKRRQQKIRKYTMRRLLQETELVEPLTPSGAMPNQAQMRILKETELRKVKVLGSGAFGTVYKGIWIPDGENVKIPVAIKVLRENTSPKANKEILDEAYVMAGVGSPYVSRLLGICLTSTVQLVTQLMPYGCLLDHVRENRGRLGSQDLLNWCMQIAKGMSYLEDVRLVHRDLAARNVLVKSPNHVKITDFGLARLLDIDETEYHADGGKVPIKWMALESILRRRFTHQSDVWSYGVTVWELMTFGAKPYDGIPAREIPDLLEKGERLPQPPICTIDVYMIMVKCWMIDSECRPRFRELVSEFSRMARDPQRFVVIQNEDLGPASPLDSTFYRSLLEDDDMGDLVDAEEYLVPQQGFFCPDPAPGAGGMVHHRHRSSSTRSGGGDLTLGLEPSEEEAPRSPLAPSEGAGSDVFDGDLGMGAAKGLQSLPTHDPSPLQRYSEDPTVPLPSETDGYVAPLTCSPQPEYVNQPDVRPQPPSPREGPLPAARPAGATLERPKTLSPGKNGVVKDVFAFGGAVENPEYLTPQGGAAPQPHPPPAFSPAFDNLYYWDQDPPERGAPPSTFKGTPTAENPEYLGLDVPV

SEQ ID NO: 12 - protein, 1262 aa, Artificial Sequence
  her2 isoform k
MELAALCRWGLLLALLPPGAASTQVCTGTDMKLRLPASPETHLDMLRHLYQGCQVVQGNLELTYLPTNASLSFLQDIQEVQGYVLIAHNQVRQVPLQRLRIVRGTQLFEDNYALAVLDNGDPLNNTTPVTGASPGGLRELQLRSLTEILKGGVLIQRNPQLCYQDTILWKDIFHKNNQLALTLIDTNRSRACHPCSPMCKGSRCWGESSEDCQSLTRTVCAGGCARCKGPLPTDCCHEQCAAGCTGPKHSDCLACLHFNHSGICELHCPALVTYNTDTFESMPNPEGRYTFGASCVTACPYNYLSTDVGSCTLVCPLHNQEVTAEDGTQRCEKCSKPCARVCYGLGMEHLREVRAVTSANIQEFAGCKKIFGSLAFLPESFDGDPASNTAPLQPEQLQVFETLEEITGYLYISAWPDSLPDLSVFQNLQVIRGRILHKCPPFSHSGAYSLTLQGLGISWLGLRSLRELGSGLALIHHNTHLCFVHTVPWDQLFRNPHQALLHTANRPEDECVGEGLACHQLCARGHCWGPGPTQCVNCSQFLRGQECVEECRVLQGLPREYVNARHCLPCHPECQPQNGSVTCFGPEADQCVACAHYKDPPFCVARCPSGVKPDLSYMPIWKFPDEEGACQPCPINCTHSCVDLDDKGCPAEQRASPLTSIISAVVGILLVVVLGVVFGILIKRRQQKIRKYTMRRLLQETELVEPLTPSGAMPNQAQMRILKETELRKVKVLGSGAFGTVYKGIWIPDGENVKIPVAIKVLRENTSPKANKEILDEAYVMAGVGSPYVSRLLGICLTSTVQLVTQLMPYGCLLDHVRENRGRLGSQDLLNWCMQIAKGMSYLEDVRLVHRDLAARNVLVKSPNHVKITDFGLARLLDIDETEYHADGGKVPIKWMALESILRRRFTHQSDVWSYGVTVWELMTFGAKPYDGIPAREIPDLLEKGERLPQPPICTIDVYMIMVKCWMIDSECRPRFRELVSEFSRMARDPQRFVVIQNEDLGPASPLDSTFYRSLLEDDDMGDLVDAEEYLVPQQGFFCPDPAPGAGGMVHHRHRSSSTRSGGGDLTLGLEPSEEEAPRSPLAPSEGAGSDVFDGDLGMGAAKGLQSLPTHDPSPLQRYSEDPTVPLPSETDGYVAPLTCSPQPEYVNQPDVRPQPPSPREGPLPAARPAGATLERPKTLSPGKNGVVKDVFAFGGAVENPEYLTPQGGAAPQPHPPPAFSPAFDNLYYWDQDPPERGAPPSTFKGTPTAENPEYLGLDVPV

SEQ ID NO: 13 - protein, 1254 aa, Artificial Sequence
  her2 isoform l
MELAALCRWGLLLALLPPGAASTQVCTGTDMKLRLPASPETHLDMLRHLYQGCQVVQGNLELTYLPTNASLSFLQDIQEVQGYVLIAHNQVRQVPLQRLRIVRGTQLFEDNYALAVLDNGDPLNNTTPVTGASPGGLRELQLRSLTEILKGGVLIQRNPQLCYQDTILWKDIFHKNNQLALTLIDTNRSRACHPCSPMCKGSRCWGESSEDCQSLTRTVCAGGCARCKGPLPTDCCHEQCAAGCTGPKHSDCLACLHFNHSGICELHCPALVTYNTDTFESMPNPEGRYTFGASCVTACPYNYLSTDVGSCTLVCPLHNQEVTAEDGTQRCEKCSKPCARVCYGLGMEHLREVRAVTSANIQEFAGCKKIFGSLAFLPESFDGDPASNTAPLQPEQLQVFETLEEITGYLYISAWPDSLPDLSVFQNLQVIRGRILHNGAYSLTLQGLGISWLGLRSLRELGSGLALIHHNTHLCFVHTVPWDQLFRNPHQALLHTANRPEDECVGEGLACHQLCARGHCWGPGPTQCVNCSQFLRGQECVEECRVLQGLPREYVNARHCLPCHPECQPQNGSVTCFGPADQCVACAHYKDPPFCVARCPSGVKPDLSYMPIWKFPDEEGACQPCPINCTHSCVDLDDKGCPAEQRASPLTSIISAVVGILLVVVLGVVFGILIKRRQQKIRKYTMRRLLQETELVEPLTPSGAMPNQAQMRILKETELRKVKVLGSGAFGTVYKGIWIPDGENVKIPVAIKVLRENTSPKANKEILDEAYVMAGVGSPYVSRLLGICLTSTVQLVTQLMPYGCLLDHVRENRGRLGSQDLLNWCMQIAKGMSYLEDVRLVHRDLAARNVLVKSPNHVKITDFGLARLLDIDETEYHADGGKVPIKWMALESILRRRFTHQSDVWSYGVTVWELMTFGAKPYDGIPAREIPDLLEKGERLPQPPICTIDVYMIMVKCWMIDSECRPRFRELVSEFSRMARDPQRFVVIQNEDLGPASPLDSTFYRSLLEDDDMGDLVDAEEYLVPQQGFFCPDPAPGAGGMVHHRHRSSSTRSGGGDLTLGLEPSEEEAPRSPLAPSEGAGSDVFDGDLGMGAAKGLQSLPTHDPSPLQRYSEDPTVPLPSETDGYVAPLTCSPQPEYVNQPDVRPQPPSPREGPLPAARPAGATLERPKTLSPGKNGVVKDVFAFGGAVENPEYLTPQGGAAPQPHPPPAFSPAFDNLYYWDQDPPERGAPPSTFKGTPTAENPEYLGLDVPV

SEQ ID NO: 14 - protein, 1252 aa, Artificial Sequence
  her2 isoform m
MELAALCRWGLLLALLPPGAASTQVCTGTDMKLRLPASPETHLDMLRHLYQGCQVVQGNLELTYLPTNASLSFLQEVQGYVLIAHNQVRQVPLQRLRIVRGTQLFEDNYALAVLDNGDPLNNTTPVTGASPGGLRELQLRSLTEILKGGVLIQRNPQLCYQDTILWKDIFHKNNQLALTLIDTNRSRACHPCSPMCKGSRCWGESSEDCQSLTRTVCAGGCARCKGPLPTDCCHEQCAAGCTGPKHSDCLACLHFNHSGICELHCPALVTYNTDTFESMPNPEGRYTFGASCVTACPYNYLSTDVGSCTLVCPLHNQEVTAEDGTQRCEKCSKPCARVCYGLGMEHLREVRAVTSANIQEFAGCKKIFGSLAFLPESFDGDPASNTAPLQPEQLQVFETLEEITGYLYISAWPDSLPDLSVFQNLQVIRGRILHNGAYSLTLQGLGISWLGLRSLRELGSGLALIHHNTHLCFVHTVPWDQLFRNPHQALLHTANRPEDECVGEGLACHQLCARGHCWGPGPTQCVNCSQFLRGQECVEECRVLQGLPREYVNARHCLPCHPECQPQNGSVTCFGPEADQCVACAHYKDPPFCVARCPSGVKPDLSYMPIWKFPDEEGACQPCPINCTHSCVDLDDKGCPAEQRASPLTSIISAVVGILLVVVLGVVFGILIKRRQQKIRKYTMRRLLQETELVEPLTPSGAMPNQAQMRILKETELRKVKVLGSGAFGTVYKGIWIPDGENVKIPVAIKVLRENTSPKANKEILDEAYVMAGVGSPYVSRLLGICLTSTVQLVTQLMPYGCLLDHVRENRGRLGSQDLLNWCMQIAKGMSYLEDVRLVHRDLAARNVLVKSPNHVKITDFGLARLLDIDETEYHADGGKVPIKWMALESILRRRFTHQSDVWSYGVTVWELMTFGAKPYDGIPAREIPDLLEKGERLPQPPICTIDVYMIMVKCWMIDSECRPRFRELVSEFSRMARDPQRFVVIQNEDLGPASPLDSTFYRSLLEDDDMGDLVDAEEYLVPQQGFFCPDPAPGAGGMVHHRHRSSSTRSGGGDLTLGLEPSEEEAPRSPLAPSEGAGSDVFDGDLGMGAAKGLQSLPTHDPSPLQRYSEDPTVPLPSETDGYVAPLTCSPQPEYVNQPDVRPQPPSPREGPLPAARPAGATLERPKTLSPGKNGVVKDVFAFGGAVENPEYLTPQGGAAPQPHPPPAFSPAFDNLYYWDQDPPERGAPPSTFKGTPTAENPEYLGLDVPV

SEQ ID NO: 15 - protein, 1243 aa, Artificial Sequence
  her2 isoform n
MELAALCRWGLLLALLPPGAASTQVCTGTDMKLRLPASPETHLDMLRHLYQGCQVVQGNLELTYLPTNASLSFLQDIQEVQGYVLIAHNQVRQVPLQRLRIVRGTQLFEDNYALAVLDNGDPLNNTTPVTGASPGGLRELQLRSLTEILKGGVLIQRNPQLCYQDTILWKDIFHKNNQLALTLIDTNRSRACHPCSPMCKGSRCWGESSEDCQSLTRTVCAGGCARCKGPLPTDCCHEQCAAGCTGPKHSDCLACLHFNHSGICELHCPALVTYNTDTFESMPNPEGRYTFGASCVTACPYNYLSTDVGSCTLVCPLHNQEVTAEDGTQRCEKCSKPCARVCYGLGMEHLREVRAVTSANIQEFAGCKKIFGSLAFLPESFDGDPASNTAPLQPEQLQVFETLEEITGYLYISAWPDSLPDLSVFQNLQVIRGRILHNGAYSLTLQGLGISWLGLRSLRELGSGLALIHHNTHLCFVHTVPWDQLFRNPHQALLHTANRPEDECVGEGLACHQLCARGHCWGPGPTQCVNCSQFLRGQECVEECRVLQGLPREYVNARHCLPCHPECQPQNGSVTCFGPEADQCVACAHYKDPPFCVARCPSGVKPDLSYMPIWKFPDEEGACQPCPINCTHSCVDLDDKGCPAEQRASPLTSIISAVVGILLVVVLGVVFGILIKRRQQKIRKYTMRRLLQETELVEPLTPSGAMPNQAQMRILKETELRKVKGIWIPDGENVKIPVAIKVLRENTSPKANKEILDEAYVMAGVGSPYVSRLLGICLTSTVQLVTQLMPYGCLLDHVRENRGRLGSQDLLNWCMQIAKGMSYLEDVRLVHRDLAARNVLVKSPNHVKITDFGLARLLDIDETEYHADGGKVPIKWMALESILRRRFTHQSDVWSYGVTVWELMTFGAKPYDGIPAREIPDLLEKGERLPQPPICTIDVYMIMVKCWMIDSECRPRFRELVSEFSRMARDPQRFVVIQNEDLGPASPLDSTFYRSLLEDDDMGDLVDAEEYLVPQQGFFCPDPAPGAGGMVHHRHRSSSTRSGGGDLTLGLEPSEEEAPRSPLAPSEGAGSDVFDGDLGMGAAKGLQSLPTHDPSPLQRYSEDPTVPLPSETDGYVAPLTCSPQPEYVNQPDVRPQPPSPREGPLPAARPAGATLERPKTLSPGKNGVVKDVFAFGGAVENPEYLTPQGGAAPQPHPPPAFSPAFDNLYYWDQDPPERGAPPSTFKGTPTAENPEYLGLDVPV

SEQ ID NO: 16 - protein, 1241 aa, Artificial Sequence
  her2 isoform o
MELAALCRWGLLLALLPPGAASTQVCTGTDMKLRLPASPETHLDMLRHLYQGCQVVQGNLELTYLPTNASLSFLQDIQEVQGYVLIAHNQVRQVPLQRLRIVRGTQLFEDNYALAVLDNGDPLNNTTPVTGASPGGLRELQLRSLTEILKGGVLIQRNPQLCYQDTILWKDIFHKNNQLALTLIDTNRSRACHPCSPMCKGSRCWGESSEDCQSLTRTVCAGGCARCKGPLPTDCCHEQCAAGCTGPKHSDCLACLHFNHSGICELHCPALVTYNTDTFESMPNPEGRYTFGASCVTACPYNYLSTDVGSCTLVCPLHNQEVTAEDGTQRCEKCSKPCARVCYGLGMEHLREVRAVTSANIQEFAGCKKIFGSLAFLPESFDGDPASNTAPLQPEQLQVFETLEEITGYLYISAWPDSLPDLSVFQNLQVIRGRILHNGAYSLTLQGLGISWLGLRSLRELGSGLALIHHNTHLCFVHTVPWDQLFRNPHQALLHTANRPEDECVGEGLACHQLCARGHCWGPGPTQCVNCSQFLRGQECVEECRVLQGLPREYVNARHCLPCHPECQPQNGSVTCFGPEADQCVACAHYKDPPFCVARCPSGVKPDLSYMPIWKFPDEEGACQPCPINCTHSCVDLDDKGCPAEQRASPLTSIISAVVGILLVVVLGVVFGILIKRRQQKIRKYTMRRLLQETELVEPLTPSGAMPNQAQMRILKETELRKGIWIPDGENVKIPVAIKVLRENTSPKANKEILDEAYVMAGVGSPYVSRLLGICLTSTVQLVTQLMPYGCLLDHVRENRGRLGSQDLLNWCMQIAKGMSYLEDVRLVHRDLAARNVLVKSPNHVKITDFGLARLLDIDETEYHADGGKVPIKWMALESILRRRFTHQSDVWSYGVTVWELMTFGAKPYDGIPAREIPDLLEKGERLPQPPICTIDVYMIMVKCWMIDSECRPRFRELVSEFSRMARDPQRFVVIQNEDLGPASPLDSTFYRSLLEDDDMGDLVDAEEYLVPQQGFFCPDPAPGAGGMVHHRHRSSSTRSGGGDLTLGLEPSEEEAPRSPLAPSEGAGSDVFDGDLGMGAAKGLQSLPTHDPSPLQRYSEDPTVPLPSETDGYVAPLTCSPQPEYVNQPDVRPQPPSPREGPLPAARPAGATLERPKTLSPGKNGVVKDVFAFGGAVENPEYLTPQGGAAPQPHPPPAFSPAFDNLYYWDQDPPERGAPPSTFKGTPTAENPEYLGLDVPV

SEQ ID NO: 17 - protein, 1241 aa, Artificial Sequence
  her2 isoform p
MELAALCRWGLLLALLPPGAASTQVCTGTDMKLRLPASPETHLDMLRHLYQGCQVVQGNLELTYLPTNASLSFLQDIQEVQGYVLIAHNQVRQVPLQRLRIVRGTQLFEDNYALAVLDNGDPLNNTTPVTGASPGGLRELQLRSLTEILKGGVLIQRNPQLCYQDTILWKDIFHKNNQLALTLIDTNRSRACHPCSPMCKGSRCWGESSEDCQSLTRTVCAGGCARCKGPLPTDCCHEQCAAGCTGPKHSDCLACLHFNHSGICELHCPALVTYNTDTFESMPNPEGRYTFGASCVTACPYNYLSTDVGSCTLVCPLHNQEVTAEDGTQRCEKCSKPCARVCYGLGMEHLREVRAVTSANIQEFAGCKKIFGSLAFLPESFDGDPASNTAPLQPEQLQVFETLEEITGYLYISAWPDSLPDLSVFQNLQVIRGRILHNGAYSLTLQGLGISWLGLRSLRELGSGLALIHHNTHLCFVHTVPWDQLFRNPHQALLHTANRPEDECVGEGLACHQLCARGHCWGPGPTQCVNCSQFLRGQECVEECRVLQGLPREYVNARHCLPCHPECQPQNGSVTCFGPEADQCVACAHYKDPPFCVARCPSGVKPDLSYMPIWKFPDEEGACQPCPINCTHSCVDLDDKGCPAEQRASPLTSIISAVVGILLVVVLGVVFGILIKRRQQKIRKYTMRRLLQETEAQMRILKETELRKVKVLGSGAFGTVYKGIWIPDGENVKIPVAIKVLRENTSPKANKEILDEAYVMAGVGSPYVSRLLGICLTSTVQLVTQLMPYGCLLDHVRENRGRLGSQDLLNWCMQIAKGMSYLEDVRLVHRDLAARNVLVKSPNHVKITDFGLARLLDIDETEYHADGGKVPIKWMALESILRRRFTHQSDVWSYGVTVWELMTFGAKPYDGIPAREIPDLLEKGERLPQPPICTIDVYMIMVKCWMIDSECRPRFRELVSEFSRMARDPQRFVVIQNEDLGPASPLDSTFYRSLLEDDDMGDLVDAEEYLVPQQGFFCPDPAPGAGGMVHHRHRSSSTRSGGGDLTLGLEPSEEEAPRSPLAPSEGAGSDVFDGDLGMGAAKGLQSLPTHDPSPLQRYSEDPTVPLPSETDGYVAPLTCSPQPEYVNQPDVRPQPPSPREGPLPAARPAGATLERPKTLSPGKNGVVKDVFAFGGAVENPEYLTPQGGAAPQPHPPPAFSPAFDNLYYWDQDPPERGAPPSTFKGTPTAENPEYLGLDVPV

SEQ ID NO: 18 - protein, 1239 aa, Artificial Sequence
  her2 isoform q
MELAALCRWGLLLALLPPGAASTQVCTGTDMKLRLPASPETHLDMLRHLYQGCQVVQGNLELTYLPTNASLSFLQDIQEVQGYVLIAHNQVRQVPLQRLRIVRGTQLFEDNYALAVLDNGDPLNNTTPVTGASPGGLRELQLRSLTEILKGGVLIQRNPQLCYQDTILWKDIFHKNNQLALTLIDTNRSRACHPCSPMCKGSRCWGESSEDCQSLTRTVCAGGCARCKGPLPTDCCHEQCAAGCTGPKHSDCLACLHFNHSGICELHCPALVTYNTDTFESMPNPEGRYTFGASCVTACPYNYLSTDVGSCTLVCPLHNQEVTAEDGTQRCEKCSKPCARVCYGLGMEHLREVRAVTSANIQEFAGCKKIFGSLAFLPESFDGDPASNTAPLQPEQLQVFETLEEITGYLYISAWPDSLPDLSVFQNLQVIRGRILHNGAYSLTLQGLGISWLGLRSLRELGSGLALIHHNTHLCFVHTVPWDQLFRNPHQALLHTANRPEDECVGEGLACHQLCARGHCWGPGPTQCVNCSQFLRGQECVEECRVLQGLPREYVNARHCLPCHPECQPQNGSVTCFGPEADQCVACAHYKDPPFCVARCPSGVKPDLSYMPIWKFPDEEGACQPCPINCTHSPLTSIISAVVGILLVVVLGVVFGILIKRRQQKIRKYTMRRLLQETELVEPLTPSGAMPNQAQMRILKETELRKVKVLGSGAFGTVYKGIWIPDGENVKIPVAIKVLRENTSPKANKEILDEAYVMAGVGSPYVSRLLGICLTSTVQLVTQLMPYGCLLDHVRENRGRLGSQDLLNWCMQIAKGMSYLEDVRLVHRDLAARNVLVKSPNHVKITDFGLARLLDIDETEYHADGGKVPIKWMALESILRRRFTHQSDVWSYGVTVWELMTFGAKPYDGIPAREIPDLLEKGERLPQPPICTIDVYMIMVKCWMIDSECRPRFRELVSEFSRMARDPQRFVVIQNEDLGPASPLDSTFYRSLLEDDDMGDLVDAEEYLVPQQGFFCPDPAPGAGGMVHHRHRSSSTRSGGGDLTLGLEPSEEEAPRSPLAPSEGAGSDVFDGDLGMGAAKGLQSLPTHDPSPLQRYSEDPTVPLPSETDGYVAPLTCSPQPEYVNQPDVRPQPPSPREGPLPAARPAGATLERPKTLSPGKNGVVKDVFAFGGAVENPEYLTPQGGAAPQPHPPPAFSPAFDNLYYWDQDPPERGAPPSTFKGTPTAENPEYLGLDVPV

SEQ ID NO: 19 - protein, 1226 aa, Artificial Sequence
  her2 isoform r
MELAALCRWGLLLALLPPGAASTQVCTGTDMKLRLPASPETHLDMLRHLYQGCQVVQGNLELTYLPTNASLSFLQDIQEVQGYVLIAHNQVRQVPLQRLRIVRGTQLFEDNYALAVLDNGDPLNNTTPVTGASPGGLRELQLRSLTEILKGGVLIQRNPQLCYQDTILWKDIFHKNNQLALTLIDTNRSRACHPCSPMCKGSRCWGESSEDCQSLTRTVCAGGCARCKGPLPTDCCHEQCAAGCTGPKHSDCLACLHFNHSGICELHCPALVTYNTDTFESMPNPEGRYTFGASCVTACPYNYLSTDVGSCTLVCPLHNQEVTAEDGTQRCEKCSKPCARVCYGLGMEHLREVRAVTSANIQEFAGCKKIFGSLAFLPESFDGDPASNTAPLQPEQLQVFETLEEITGYLYISAWPDSLPDLSVFQNLQVIRGRILHNGAYSLTLQGLGISWLGLRSLRELGSGLALIHHNTHLCFVHTVPWDQLFRNPHQALLHTANRPEDECVGEGLACHQLCARGHCWGPGPTQCVNCSQFLRGQECVEECRVLQGLPREYVNARHCLPCHPECQPQNGSVTCFGPEADQCVACAHYKDPPFCVARCPSGVKPDLSYMPIWKFPDEEGACQPCPINCTHSCVDLDDKGCPAEQRASPLTSIISAVVGILLVVVLGVVFGILIKRRQQKIRKYTMRRLLQETELVEPLTPSGAMPNQAQMRILKETELRKVKVLGSGAFGTVYKGIWIPDGENVKIPVAIKVLRENTSPKANKEILDEAYVMAGVGSPYVSRLLGICLTSTVQLVTQLMPYGCLLDHVRENRGRLGSQDLLNWCMQIAKGMSYLEDVRLVHRDLAARNVLVKSPNHVKITDFGLARLLDIDETEYHADGGKVPIKWMALESILRRRFTHQSDVWSYGVTVWELMTFGAKPYDGIPAREIPDLLEKGERLPQPPICTIDVYMIMVKCWMIDSECRPRFRELVSEFSRMARDPQRFVVIQNEDLGPASPLDSTFYRSLLEDDDMGDLVDAEEYLSGGGDLTLGLEPSEEEAPRSPLAPSEGAGSDVFDGDLGMGAAKGLQSLPTHDPSPLQRYSEDPTVPLPSETDGYVAPLTCSPQPEYVNQPDVRPQPPSPREGPLPAARPAGATLERPKTLSPGKNGVVKDVFAFGGAVENPEYLTPQGGAAPQPHPPPAFSPAFDNLYYWDQDPPERGAPPSTFKGTPTAENPEYLGLDVPV

SEQ ID NO: 20 - protein, 1222 aa, Artificial Sequence
  her2 isoform s
MELAALCRWGLLLALLPPGAASTQVCTGTDMKLRLPASPETHLDMLRHLYQGCQVVQGNLELTYLPTNASLSFLQDIQEVQGYVLIAHNQVRQVPLQRLRIVRGTQLFEDNYALAVLDNGDPLNNTTPVTGASPGGLRELQLRSLTEILKGGVLIQRNPQLCYQDTILWKDIFHKNNQLALTLIDTNRSRACHPCSPMCKGSRCWGESSEDCQSLTRTVCAGGCARCKGPLPTDCCHEQCAAGCTGPKHSDCLACLHFNHSGICELHCPALVTYNTDTFESMPNPEGRYTFGASCVTACPYNYLSTDVGSCTLVCPLHNQEVTAEDGTQRCEKCSKPCARVCYGLGMEHLREVRAVTSANIQEFAGCKKIFGSLAFLPESFDGDPASNTAPLQPEQLQVFETLEEITGYLYISAWPDSLPDLSVFQNLQVIRGRILHNGAYSLTLQGLGISWLGLRSLRELGSGLALIHHNTHLCFVHTVPWDQLFRNPHQALLHTANRPEDECVGEGLACHQLCARGHCWGPGPTQCVNCSQFLRGQECVEECRVLQGLPREYVNARHCLPCHPECQPQNGSVTCFGPEADQCVACAHYKDPPFCVARCPSGVKPDLSYMPIWKFPDEEGACQPCPINCTHSCVDLDDKGCPAEQRASPLTSIISAVVGILLVVVLGVVFGILIKRRQQKIRKYTMRRLLQETELVEPLTPSGAMPNQAQMRILKETELRKVKVLGSGAFGTVYKEAYVMAGVGSPYVSRLLGICLTSTVQLVTQLMPYGCLLDHVRENRGRLGSQDLLNWCMQIAKGMSYLEDVRLVHRDLAARNVLVKSPNHVKITDFGLARLLDIDETEYHADGGKVPIKWMALESILRRRFTHQSDVWSYGVTVWELMTFGAKPYDGIPAREIPDLLEKGERLPQPPICTIDVYMIMVKCWMIDSECRPRFRELVSEFSRMARDPQRFVVIQNEDLGPASPLDSTFYRSLLEDDDMGDLVDAEEYLVPQQGFFCPDPAPGAGGMVHHRHRSSSTRSGGGDLTLGLEPSEEEAPRSPLAPSEGAGSDVFDGDLGMGAAKGLQSLPTHDPSPLQRYSEDPTVPLPSETDGYVAPLTCSPQPEYVNQPDVRPQPPSPREGPLPAARPAGATLERPKTLSPGKNGVVKDVFAFGGAVENPEYLTPQGGAAPQPHPPPAFSPAFDNLYYWDQDPPERGAPPSTFKGTPTAENPEYLGLDVPV

SEQ ID NO: 21 - protein, 1203 aa, Artificial Sequence
  her2 isoform t
MELAALCRWGLLLALLPPGAASTQVCTGTDMKLRLPASPETHLDMLRHLYQGCQVVQGNLELTYLPTNASLSFLQDIQEVQGYVLIAHNQVRQVPLQRLRIVRGTQLFEDNYALAVLDNGDPLNNTTPVTGASPGGLRELQLRSLTEILKGGVLIQRNPQLCYQDTILWKDIFHKNNQLALTLIDTNRSRACHPCSPMCKGSRCWGESSEDCQSLTRTVCAGGCARCKGPLPTDCCHEQCAAGCTGPKHSDCLACLHFNHSGICELHCPALVTYNTDTFESMPNPEGRYTFGASCVTACPYNYLSTDVGSCTLVCPLHNQEVTAEDGTQRCEKCSKPCARVCYGLGMEHLREVRAVTSANIQEFAGCKKIFGSLAFLPESFDGDPASNTAPLQPEQLQVFETLEEITGYLYISAWPDSLPDLSVFQNLQVIRGRILHNGAYSLTLQGLGISWLGLRSLRELGSGLALIHHNTHLCFVHTVPWDQLFRNPHQALLHTANRPEDECVGEGLACHQLCARGHCWGPGPTQCVNCSQFLRGQECVEECRVLQGLPREYVNARHCLPCHPECQPQNGSVTCFGPEADQCVACAHYKDPPFCVARCPSGVKPDLSYMPIWKFPDEEGACQPCPINCTHSCVDLDDKGCPAEQRASPLTSIISAVVGILLVVVLGVVFGILIKRRQQKIRKYTMRRLLQETELVEPLTPSGAMPNQAQMRILKETELRKVKVLGSGAFGTVYKGIWIPDGENVKIPVAIKVLRENTSPKANKEILDEAYVMAGVGSPYVSRLLGICLTSTVQLVTQLMPYGCLLDHVRENRGRLGSQDLLNWCMQIAKVPIKWMALESILRRRFTHQSDVWSYGVTVWELMTFGAKPYDGIPAREIPDLLEKGERLPQPPICTIDVYMIMVKCWMIDSECRPRFRELVSEFSRMARDPQRFVVIQNEDLGPASPLDSTFYRSLLEDDDMGDLVDAEEYLVPQQGFFCPDPAPGAGGMVHHRHRSSSTRSGGGDLTLGLEPSEEEAPRSPLAPSEGAGSDVFDGDLGMGAAKGLQSLPTHDPSPLQRYSEDPTVPLPSETDGYVAPLTCSPQPEYVNQPDVRPQPPSPREGPLPAARPAGATLERPKTLSPGKNGVVKDVFAFGGAVENPEYLTPQGGAAPQPHPPPAFSPAFDNLYYWDQDPPERGAPPSTFKGTPTAENPEYLGLDVPV

SEQ ID NO: 22 - protein, 1195 aa, Artificial Sequence
  her2 isoform u
MELAALCRWGLLLALLPPGAASTQVCTGTDMKLRLPASPETHLDMLRHLYQGCQVVQGNLELTYLPTNASLSFLQDIQEVQGYVLIAHNQVRQVPLQRLRIVRGTQLFEDNYALAVLDNGDPLNNTTPVTGASPGGLRELQLRSLTESSEDCQSLTRTVCAGGCARCKGPLPTDCCHEQCAAGCTGPKHSDCLACLHFNHSGICELHCPALVTYNTDTFESMPNPEGRYTFGASCVTACPYNYLSTDVGSCTLVCPLHNQEVTAEDGTQRCEKCSKPCARVCYGLGMEHLREVRAVTSANIQEFAGCKKIFGSLAFLPESFDGDPASNTAPLQPEQLQVFETLEEITGYLYISAWPDSLPDLSVFQNLQVIRGRILHNGAYSLTLQGLGISWLGLRSLRELGSGLALIHHNTHLCFVHTVPWDQLFRNPHQALLHTANRPEDECVGEGLACHQLCARGHCWGPGPTQCVNCSQFLRGQECVEECRVLQGLPREYVNARHCLPCHPECQPQNGSVTCFGPEADQCVACAHYKDPPFCVARCPSGVKPDLSYMPIWKFPDEEGACQPCPINCTHSCVDLDDKGCPAEQRASPLTSIISAVVGILLVVVLGVVFGILIKRRQQKIRKYTMRRLLQETELVEPLTPSGAMPNQAQMRILKETELRKVKVLGSGAFGTVYKGIWIPDGENVKIPVAIKVLRENTSPKANKEILDEAYVMAGVGSPYVSRLLGICLTSTVQLVTQLMPYGCLLDHVRENRGRLGSQDLLNWCMQIAKGMSYLEDVRLVHRDLAARNVLVKSPNHVKITDFGLARLLDIDETEYHADGGKVPIKWMALESILRRRFTHQSDVWSYGVTVWELMTFGAKPYDGIPAREIPDLLEKGERLPQPPICTIDVYMIMVKCWMIDSECRPRFRELVSEFSRMARDPQRFVVIQNEDLGPASPLDSTFYRSLLEDDDMGDLVDAEEYLVPQQGFFCPDPAPGAGGMVHHRHRSSSTRSGGGDLTLGLEPSEEEAPRSPLAPSEGAGSDVFDGDLGMGAAKGLQSLPTHDPSPLQRYSEDPTVPLPSETDGYVAPLTCSPQPEYVNQPDVRPQPPSPREGPLPAARPAGATLERPKTLSPGKNGVVKDVFAFGGAVENPEYLTPQGGAAPQPHPPPAFSPAFDNLYYWDQDPPERGAPPSTFKGTPTAENPEYLGLDVPV

SEQ ID NO: 23 - protein, 1193 aa, Artificial Sequence
  her2 isoform v
MELAALCRWGLLLALLPPGAASTQVCTGTDMKLRLPASPETHLDMLRHLYQGCQVVQGNLELTYLPTNASLSFLQDIQEVQGYVLIAHNQVRQVPLQRLRIVRGTQLFEDNYALAVLDNGDPLNNTTPVTGASPGGLRELQLRSLTEILKGGVLIQRNPQLCYQDTILWKDIFHKNNQLALTLIDTNRSRACHPCSPMCKGSRCWGESSEDCQSLTRTVCAGGCARCKGPLPTDCCHEQCAAGCTGPKHSDCLACLHFNHSGICELHCPALVTYNTDTFESMPNPEGRYTFGASCVTACPYNYLSTDVGSCTLVCPLHNQEVTAEDGTQRCEKCSKPCARVCYGLGMEHLREVRAVTSANIQEFAGCKKIFGSLAFLPESFDGDPASNTAPLQPEQLQVFETLEEITGYLYISAWPDSLPDLSVFQNLQVIRGRILHNGAYSLTLQGLGISWLGLRSLRELGSGLALIHHNTHLCFVHTVPWDQLFRNPHQALLHTANRPEDECVGEGLACHQLCARGHCWGPGPTQCVNCSQFLRGQECVEECRVLQGLPREYVNARHCLPCHPECQPQNGSVTCFGPEADQCVACAHYKDPPFCVARCPSGVKPDLSYMPIWKFPDEEGACQPCPINCTHSCVDLDDKGCPAEQRASPLTSIISAVVGILLVVVLGVVFGILIKRRQQKIRKYTMRRLLQETELVEPLTPSGAMPNQAQMRILKETELRKVKVLGSGAFGTVYKGIWIPDGENVKIPVAIKVLRENTSPKANKEILDGMSYLEDVRLVHRDLAARNVLVKSPNHVKITDFGLARLLDIDETEYHADGGKVPIKWMALESILRRRFTHQSDVWSYGVTVWELMTFGAKPYDGIPAREIPDLLEKGERLPQPPICTIDVYMIMVKCWMIDSECRPRFRELVSEFSRMARDPQRFVVIQNEDLGPASPLDSTFYRSLLEDDDMGDLVDAEEYLVPQQGFFCPDPAPGAGGMVHHRHRSSSTRSGGGDLTLGLEPSEEEAPRSPLAPSEGAGSDVFDGDLGMGAAKGLQSLPTHDPSPLQRYSEDPTVPLPSETDGYVAPLTCSPQPEYVNQPDVRPQPPSPREGPLPAARPAGATLERPKTLSPGKNGVVKDVFAFGGAVENPEYLTPQGGAAPQPHPPPAFSPAFDNLYYWDQDPPERGAPPSTFKGTPTAENPEYLGLDVPV

SEQ ID NO: 24 - protein, 1187 aa, Artificial Sequence
  her2 isoform w
MELAALCRWGLLLALLPPGAASTQVCTGTDMKLRLPASPETHLDMLRHLYQGCQVVQGNLELTYLPTNASLSFLQDIQEVQGYVLIAHNQVRQVPLQRLRIVRGTQLFEDNYALAVLDNGDPLNNTTPVTGASPGGLRELQLRSLTEILKGGVLIQRNPQLCYQDTILWKDIFHKNNQLALTLIDTNRSRACHPCSPMCKGSRCWGESSEDCQSLTRTVCAGGCARCKGPLPTDCCHEQCAAGCTGPKHSDCLACLHFNHSGICELHCPALVTYNTDTFESMPNPEGRYTFGASCVTACPYNYLSTDVGSCTLVCPLHNQEVTAEDGTQRCEKCSKPCARVCYGLGMEHLREVRAVTSANIQEFAGCKKIFGSLAFLPESFDGDPASNTAPLQPEQLQVFETLEEITGYLYISAWPDSLPDLSVFQNLQVIRGRILHNGAYSLTLQGLGISWLGLRSLRELGSGLALIHHNTHLCFVHTVPWDQLFRNPHQALLHTANRPEDECVGEGLACHQLCARGHCWGPGPTQCVNCSQFLRGQECVEECRVLQGLPREYVNARHCLPCHPECQPQNGSVTCFGPEADQCVACAHYKDPPFCVARCPSGVKPDLSYMPIWKFPDEEGACQPCPINCTHSPLTSIISAVVGILLVVVLGVVFGILIKRRQQKIRKYTMRRLLQETELVEPLTPSGAMPNQAQMRILKETELRKVKVLGSGAFGTVYKGIWIPDGENVKIPVAIKVLRENTSPKANKEILDEAYVMAGVGSPYVSRLLGICLTSTVQLVTQLMPYGCLLDHVRENRGRLGSQDLLNWCMQIAKVPIKWMALESILRRRFTHQSDVWSYGVTVWELMTFGAKPYDGIPAREIPDLLEKGERLPQPPICTIDVYMIMVKCWMIDSECRPRFRELVSEFSRMARDPQRFVVIQNEDLGPASPLDSTFYRSLLEDDDMGDLVDAEEYLVPQQGFFCPDPAPGAGGMVHHRHRSSSTRSGGGDLTLGLEPSEEEAPRSPLAPSEGAGSDVFDGDLGMGAAKGLQSLPTHDPSPLQRYSEDPTVPLPSETDGYVAPLTCSPQPEYVNQPDVRPQPPSPREGPLPAARPAGATLERPKTLSPGKNGVVKDVFAFGGAVENPEYLTPQGGAAPQPHPPPAFSPAFDNLYYWDQDPPERGAPPSTFKGTPTAENPEYLGLDVPV

SEQ ID NO: 25 - protein, 1169 aa, Artificial Sequence
  her2 isoform x
MELAALCRWGLLLALLPPGAASTQVCTGTDMKLRLPASPETHLDMLRHLYQGCQVVQGNLELTYLPTNASLSFLQDIQEVQGYVLIAHNQVRQVPLQRLRIVRGTQLFEDNYALAVLDNGDPLNNTTPVTGASPGGLRELQLRSLTEILKGGVLIQRNPQLCYQDTILWKDIFHKNNQLALTLIDTNRSRACHPCSPMCKGSRCWGESSEDCQSHNYLSTDVGSCTLVCPLHNQEVTAEDGTQRCEKCSKPCARVCYGLGMEHLREVRAVTSANIQEFAGCKKIFGSLAFLPESFDGDPASNTAPLQPEQLQVFETLEEITGYLYISAWPDSLPDLSVFQNLQVIRGRILHNGAYSLTLQGLGISWLGLRSLRELGSGLALIHHNTHLCFVHTVPWDQLFRNPHQALLHTANRPEDECVGEGLACHQLCARGHCWGPGPTQCVNCSQFLRGQECVEECRVLQGLPREYVNARHCLPCHPECQPQNGSVTCFGPEADQCVACAHYKDPPFCVARCPSGVKPDLSYMPIWKFPDEEGACQPCPINCTHSCVDLDDKGCPAEQRASPLTSIISAVVGILLVVVLGVVFGILIKRRQQKIRKYTMRRLLQETELVEPLTPSGAMPNQAQMRILKETELRKVKVLGSGAFGTVYKGIWIPDGENVKIPVAIKVLRENTSPKANKEILDEAYVMAGVGSPYVSRLLGICLTSTVQLVTQLMPYGCLLDHVRENRGRLGSQDLLNWCMQIAKGMSYLEDVRLVHRDLAARNVLVKSPNHVKITDFGLARLLDIDETEYHADGGKVPIKWMALESILRRRFTHQSDVWSYGVTVWELMTFGAKPYDGIPAREIPDLLEKGERLPQPPICTIDVYMIMVKCWMIDSECRPRFRELVSEFSRMARDPQRFVVIQNEDLGPASPLDSTFYRSLLEDDDMGDLVDAEEYLVPQQGFFCPDPAPGAGGMVHHRHRSSSTRSGGGDLTLGLEPSEEEAPRSPLAPSEGAGSDVFDGDLGMGAAKGLQSLPTHDPSPLQRYSEDPTVPLPSETDGYVAPLTCSPQPEYVNQPDVRPQPPSPREGPLPAARPAGATLERPKTLSPGKNGVVKDVFAFGGAVENPEYLTPQGGAAPQPHPPPAFSPAFDNLYYWDQDPPERGAPPSTFKGTPTAENPEYLGLDVPV

SEQ ID NO: 26 - protein, 1041 aa, Artificial Sequence
  her2 isoform y
MELAALCRWGLLLALLPPGAASTQVCTGTDMKLRLPASPETHLDMLRHLYQGCQVVQGNLELTYLPTNASLSFLQDIQEVQGYVLIAHNQVRQVPLQRLRIVRGTQLFEDNYALAVLDNGDPLNNTTPVTGASPGGLRELQLRSLTEILKGGVLIQRNPQLCYQDTILWKDIFHKNNQLALTLIDTNRSRACHPCSPMCKGSRCWGESSEDCQSLTRTVCAGGCARCKGPLPTDCCHEQCAAGCTGPKHSDCLACLHFNHSGICELHCPALVTYNTDTFESMPNPEGRYTFGASCVTACPYNYLSTDVGSCTLVCPLHNQEVTAEDGTQRCEKCSKPCARVCYGLGMEHLREVRAVTSANIQEFAGCKKIFGSLAFLPESFDGDPASNTAPLQPEQLQVFETLEEITGYLYISAWPDSLPDLSVFQNLQVIRGRILHNGAYSLTLQGLGISWLGLRSLRELGSGLALIHHNTHLCFVHTVPWDQLFRNPHQALLHTANRPEDECVGEGLACHQLCARGHCWGPGPTQCVNCSQFLRGQECVEECRVLQGLPREYVNARHCLPCHPECQPQNGSVTCFGPEADQCVACAHYKDPPFCVARCPSGVKPDLSYMPIWKFPDEEGACQPCPINCTHSCVDLDDKGCPAEQRASPLTSIISAVVGILLVVVLGVVFGILIKRRQQKIRKYTMRRLLQETELVEPLTPSGAMPNQAQMRILKETELRKGIWIPDGENVKIPVAIKVLRENTSPKANKEILDEAYVMAGVGSPYVSRLLGICLTSTVQLVTQLMPYGCLLDHVRENRGRLGSQDLLNWCMQIAKGMSYLEDVRLVHRDLAARNVLVKSPNHVKITDFGLARLLDIDETEYHADGGKVPIKWMALESILRRRFTHQSDVWSYGVTVWELMTFGAKPYDGIPAREIPDLLEKGERLPQPPICTIDVYMIMVKCWMIDSECRPRFRELVSEFSRMARDPQRFVVIQNEDLGPASPLDSTFYRSLLEDDDMGDLVDAEEYLVPQQGFFCPDPAPGAGGMVHHRHRSSSTRNM

SEQ ID NO: 27 - protein, 919 aa, Artificial Sequence
  her2 isoform z
PCARVCYGLGMEHLREVRAVTSANIQEFAGCKKIFGSLAFLPESFDGDPASNTAPLQPEQLQVFETLEEITGYLYISAWPDSLPDLSVFQNLQVIRGRILHNGAYSLTLQGLGISWLGLRSLRELGSGLALIHHNTHLCFVHTVPWDQLFRNPHQALLHTANRPEDECVGEGLACHQLCARGHCWGPGPTQCVNCSQFLRGQECVEECRVLQGLPREYVNARHCLPCHPECQPQNGSVTCFGPEADQCVACAHYKDPPFCVARCPSGVKPDLSYMPIWKFPDEEGACQPCPINCTHSCVDLDDKGCPAEQRASPLTSIISAVVGILLVVVLGVVFGILIKRRQQKIRKYTMRRLLQETELVEPLTPSGAMPNQAQMRILKETELRKVKVLGSGAFGTVYKGIWIPDGENVKIPVAIKVLRENTSPKANKEILDEAYVMAGVGSPYVSRLLGICLTSTVQLVTQLMPYGCLLDHVRENRGRLGSQDLLNWCMQIAKGMSYLEDVRLVHRDLAARNVLVKSPNHVKITDFGLARLLDIDETEYHADGGKVPIKWMALESILRRRFTHQSDVWSYGVTVWELMTFGAKPYDGIPAREIPDLLEKGERLPQPPICTIDVYMIMVKCWMIDSECRPRFRELVSEFSRMARDPQRFVVIQNEDLGPASPLDSTFYRSLLEDDDMGDLVDAEEYLVPQQGFFCPDPAPGAGGMVHHRHRSSSTRSGGGDLTLGLEPSEEEAPRSPLAPSEGAGSDVFDGDLGMGAAKGLQSLPTHDPSPLQRYSEDPTVPLPSETDGYVAPLTCSPQPEYVNQPDVRPQPPSPREGPLPAARPAGATLERPKTLSPGKNGVVKDVFAFGGAVENPEYLTPQGGAAPQPHPPPAFSPAFDNLYYWDQDPPERGAPPSTFKGTPTAENPEYLGLDVPV

SEQ ID NO: 28 - protein, 938 aa, Artificial Sequence
  her2 isoform aa
MELAALCRWGLLLALLPPGAASTQVCTGTDMKLRLPASPETHLDMLRHLYQGCQVVQGNLELTYLPTNASLSFLQDIQEVQGYVLIAHNQVRQVPLQRLRIVRGTQLFEDNYALAVLDNGDPLNNTTPVTGASPGGLRELQLRSLTEILKGGVLIQRNPQLCYQDTILWKDIFHKNNQLALTLIDTNRSRACHPCSPMCKGSRCWGESSEDCQSLTRTVCAGGCARCKGPLPTDCCHEQCAAGCTGPKHSDCLACLHFNHSGICELHCPALVTYNTDTFESMPNPEGRYTFGASCVTACPYNYLSTDVGSCTLVCPLHNQEVTAEDGTQRCEKCSKPCARVCYGLGMEHLREVRAVTSANIQEFAGCKKIFGSLAFLPESFDGDPASNTAPLQPEQLQVFETLEEITGYLYISAWPDSLPDLSVFQNLQVIRGRILHNGAYSLTLQGLGISWLGLRSLRELGSGLALIHHNTHLCFVHTVPWDQLFRNPHQALLHTANRPEDECVGEGLACHQLCARGHCWGPGPTQCVNCSQFLRGQECVEECRVLQGLPREYVNARHCLPCHPECQPQNGSVTCFGPEADQCVACAHYKDPPFCVARCPSGVKPDLSYMPIWKFPDEEGACQPCPINCTHSCVDLDDKGCPAEQRASPLTSIISAVVGILLVVVLGVVFGILIKRRQQKIRKYTMRRLLQETELVEPLTPSGAMPNQAQMRILKETELRKVKVLGSGAFGTVYKSGGGDLTLGLEPSEEEAPRSPLAPSEGAGSDVFDGDLGMGAAKGLQSLPTHDPSPLQRYSEDPTVPLPSETDGYVAPLTCSPQPEYVNQPDVRPQPPSPREGPLPAARPAGATLERPKTLSPGKNGVVKDVFAFGGAVENPEYLTPQGGAAPQPHPPPAFSPAFDNLYYWDQDPPERGAPPSTFKGTPTAENPEYLGLDVPV

SEQ ID NO: 29 - protein, 909 aa, Artificial Sequence
  her2 isoform bb
MELAALCRWGLLLALLPPGAASTQVCTGTDMKLRLPASPETHLDMLRHLYQGCQVVQGNLELTYLPTNASLSFLQDIQEVQGYVLIAHNQVRQVPLQRLRIVRGTQLFEDNYALAVLDNGDPLNNTTPVTGASPGGLRELQLRSLTEILKGGVLIQRNPQLCYQDTILWKDIFHKNNQLALTLIDTNRSRACHPCSPMCKGSRCWGESSEDCQSLTRTVCAGGCARCKGPLPTDCCHEQCAAGCTGPKHSDCLACLHFNHSGICELHCPALVTYNTDTFESMPNPEGRYTFGASCVTACPYNYLSTDVGSCTLVCPLHNQEVTAEDGTQRCEKCSKPCARVCYGLGMEHLREVRAVTSANIQEFAGCKKIFGSLAFLPESFDGDPASNTAPLQPEQLQVFETLEEITVLRENTSPKANKEILDEAYVMAGVGSPYVSRLLGICLTSTVQLVTQLMPYGCLLDHVRENRGRLGSQDLLNWCMQIAKGMSYLEDVRLVHRDLAARNVLVKSPNHVKITDFGLARLLDIDETEYHADGGKVPIKWMALESILRRRFTHQSDVWSYGVTVWELMTFGAKPYDGIPAREIPDLLEKGERLPQPPICTIDVYMIMVKCWMIDSECRPRFRELVSEFSRMARDPQRFVVIQNEDLGPASPLDSTFYRSLLEDDDMGDLVDAEEYLVPQQGFFCPDPAPGAGGMVHHRHRSSSTRSGGGDLTLGLEPSEEEAPRSPLAPSEGAGSDVFDGDLGMGAAKGLQSLPTHDPSPLQRYSEDPTVPLPSETDGYVAPLTCSPQPEYVNQPDVRPQPPSPREGPLPAARPAGATLERPKTLSPGKNGVVKDVFAFGGAVENPEYLTPQGGAAPQPHPPPAFSPAFDNLYYWDQDPPERGAPPSTFKGTPTAENPEYLGLDVPV

SEQ ID NO: 30 - protein, 11 aa, Artificial Sequence
  CDR-L1
RASQDVNTAVA

SEQ ID NO: 31 - protein, 11 aa, Artificial Sequence
  CDR-L1
KASQDVYNAVA

SEQ ID NO: 32 - protein, 6 aa, Artificial Sequence
  CDR-L2
SASFLY

SEQ ID NO: 33 - protein, 7 aa, Artificial Sequence
  CDR-L2
SASSRYT

SEQ ID NO: 34 - protein, 8 aa, Artificial Sequence
  CDR-L3
QQHYTTPP

SEQ ID NO: 35 - protein, 9 aa, Artificial Sequence
  CDR-L3
QQHFRTPFT

SEQ ID NO: 36 - protein, 10 aa, Artificial Sequence
  CDR-H1
GFNIKDTYIH

SEQ ID NO: 37 - protein, 5 aa, Artificial Sequence
  CDR-H1
NYGMN

SEQ ID NO: 38 - protein, 18 aa, Artificial Sequence
  CDR-H2
ARIYPTNGYTRYADSVKG

SEQ ID NO: 39 - protein, 17 aa, Artificial Sequence
  CDR-H2
WINTSTGESTFADDFKG

SEQ ID NO: 40 - protein, 13 aa, Artificial Sequence
  CDR-H3
SRWGGDGFYAMDY

SEQ ID NO: 41 - protein, 13 aa, Artificial Sequence
  CDR-H3
SRWGGDGFYAMDV

SEQ ID NO: 42 - protein, 10 aa, Artificial Sequence
  CDR-H3
WEVYHGYVPY

SEQ ID NO: 43 - protein, 123 aa, Artificial Sequence
  CT-292 VH full
EVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDVWGQGTLVTVSSAAA

SEQ ID NO: 44 - protein, 109 aa, Artificial Sequence
  CT-292 VL full
DIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRT

SEQ ID NO: 45 - protein, 119 aa, Artificial Sequence
  CT-297 /ct-1095VH full
QVQLQQSGPELKKPGETVKISCKASGYPFTNYGMNWVKQAPGQGLKWMGWINTSTGESTFADDFKGRFDFSLETSANTAYLQINNLKSEDSATYFCARWEVYHGYVPYWGQGTTVTVSS

SEQ ID NO: 46 - protein, 122 aa, Artificial Sequence
  CT-297 VL full
GGGGSGGGGSGGGGSDIQLTQSHKFLSTSVGDRVSITCKASQDVYNAVAWYQQKPGQSPKLLIYSASSRYTGVPSRFTGSGSGPDFTFTISSVQAEDLAVYFCQQHFRTPFTFGSGTKLEIK

SEQ ID NO: 47 - protein, 120 aa, Artificial Sequence [sequence omitted]

SEQ ID NO: 48 - protein, 107 aa, Artificial Sequence [sequence omitted]

SEQ ID NO: 49 - protein, 107 aa, Artificial Sequence
  CT-1095 VL full
DIQLTQSHKFLSTSVGDRVSITCKASQDVYNAVAWYQQKPGQSPKLLIYSASSRYTGVPSRFTGSGSGPDFTFTISSVQAEDLAVYFCQQHFRTPFTFGSGTKLEIK

SEQ ID NO: 50 - protein, 119 aa, Artificial Sequence
  VH full
QVQLQQSGPELKKPGETVKISCKASGYPFTNYGMNWVKQAPGQGLKWMGWINTSTGESTFADDFKGRFDFSLETSANTAYLQINNLKSEDMATYFCARWEVYHGYVPYWGQGTTVTVSS

SEQ ID NO: 51 - protein, 269 aa, Artificial Sequence
  CT292 scFv domain
MDFQVQIFSFLLISASVIMSRGDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTGSTSGSGKPGSGEGSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDVWGQGTLVTVSSAAA

SEQ ID NO: 52 - DNA, 807 bp, Artificial Sequence
  CT292 scFv domain
atggattttcaggtgcagattttcagcttcctgctaatcagtgcctcagtcataatgtccagaggagatatccagatgacccagtccccgagctccctgtccgcctctgtgggcgatagggtcaccatcacctgccgtgccagtcaggatgtgaatactgctgtagcctggtatcaacagaaaccaggaaaagctccgaaactactgatttactcggcatccttcctttattctggagtcccttctcgcttctctggatctagatctgggacggatttcactctgaccatcagcagtctgcagccggaagacttcgcaacttattactgtcagcaacattatactactcctcccacgttcggacagggtaccaaggtggagatcaaacgcactgggtctacatctggatctgggaagccgggttctggtgagggttctgaggttcagctggtggagtctggcggtggcctggtgcagccagggggctcactccgtttgtcctgtgcagcttctggcttcaacattaaagacacctatatacactgggtgcgtcaggccccgggtaagggcctggaatgggttgcaaggatttatcctacgaatggttatactagatatgccgatagcgtcaagggccgtttcactataagcgcagacacatccaaaaacacagcctacctgcagatgaacagcctgcgtgctgaggacactgccgtctattattgttctagatggggaggggacggcttctatgctatggacgtgtggggtcaaggaaccctggtcaccgtctcctcggcggccgca

SEQ ID NO: 53 - protein, 263 aa, Artificial Sequence
  CT297 scFv domain
MDMRVPAQLLGLLLLWLRGARCQVQLQQSGPELKKPGETVKISCKASGYPFTNYGMNWVKQAPGQGLKWMGWINTSTGESTFADDFKGRFDFSLETSANTAYLQINNLKSEDSATYFCARWEVYHGYVPYWGQGTTVTVSSGGGGSGGGGSGGGGSDIQLTQSHKFLSTSVGDRVSITCKASQDVYNAVAWYQQKPGQSPKLLIYSASSRYTGVPSRFTGSGSGPDFTFTISSVQAEDLAVYFCQQHFRTPFTFGSGTKLEIK

SEQ ID NO: 54 - DNA, 789 bp, Artificial Sequence
  CT297 scFv domain
atggacatgagggtccccgctcagctcctggggctcctgctactctggctccgaggtgccagatgtcaggtacaactgcagcagtcaggacctgaactgaagaagcctggagagacagtcaagatctcctgcaaggcctctgggtatcctttcacaaactatggaatgaactgggtgaagcaggctccaggacagggtttaaagtggatgggctggattaacacctccactggagagtcaacatttgctgatgacttcaagggacggtttgacttctctttggaaacctctgccaacactgcctatttgcagatcaacaacctcaaaagtgaagactcggctacatatttctgtgcaagatgggaggtttaccacggctacgttccttactggggccaagggaccacggtcaccgtttcctctggcggtggcggttctggtggcggtggctccggcggtggcggttctgacatccagctgacccagtctcacaaattcctgtccacttcagtaggagacagggtcagcatcacctgcaaggccagtcaggatgtgtataatgctgttgcctggtatcaacagaaaccaggacaatctcctaaacttctgatttactcggcatcctcccggtacactggagtcccttctcgcttcactggcagtggctctgggccggatttcactttcaccatcagcagtgtgcaggctgaagacctggcagtttatttctgtcagcaacattttcgtactccattcacgttcggctcggggacaaaattggagatcaaa

SEQ ID NO: 55 - protein, 267 aa, Artificial Sequence
  CT298 scFv domain
MLLLVTSLLLCELPHPAFLLIPDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGSTSGGGSGGGSGGGGSSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSS

SEQ ID NO: 56 - DNA, 801 bp, Artificial Sequence
  CT298 scFv domain
atgctgctactggtcaccagtctactgctgtgcgaactgccacatccggccttcctgctaataccggatatccagatgacccagtccccgagctccctgtccgcctctgtgggcgatagggtcaccatcacctgccgtgccagtcaggatgtgaatactgctgtagcctggtatcaacagaaaccaggaaaagctccgaaactactgatttactcggcatccttcctttattctggagtcccttctcgcttctctggatctagatctgggacggatttcactctgaccatcagcagtctgcagccggaagacttcgcaacttattactgtcagcaacattatactactcctcccacgttcggacagggtaccaaggtggagatcaaagggtctacatctggcggtggctctggtggcggttccggcggtggcggttcttccgaggttcagctggtggagtctggcggtggcctggtgcagccagggggctcactccgtttgtcctgtgcagcttctggcttcaacattaaagacacctatatacactgggtgcgtcaggccccgggtaagggcctggaatgggttgcaaggatttatcctacgaatggttatactagatatgccgatagcgtcaagggccgtttcactataagcgcagacacatccaaaaacacagcctacctgcagatgaacagcctgcgtgctgaggacactgccgtctattattgttctagatggggaggggacggcttctatgctatggactattggggtcaaggaaccctggtcaccgtctcctcg

SEQ ID NO: 57 - protein, 267 aa, Artificial Sequence; identical to SEQ ID NO: 55
  CT299 scFv domain

SEQ ID NO: 58 - DNA, 801 bp, Artificial Sequence; identical to SEQ ID NO: 56
  CT299 scFv domain

SEQ ID NO: 59 - protein, 263 aa, Artificial Sequence; identical to SEQ ID NO: 53
  CT1094 scFv domain

SEQ ID NO: 60 - DNA, 789 bp, Artificial Sequence; identical to SEQ ID NO: 54
  CT1094 scFv domain

SEQ ID NO: 61 - protein, 263 aa, Artificial Sequence
  CT1095 scFv domain
MDMRVPAQLLGLLLLWLRGARCQVQLQQSGPELKKPGETVKISCKASGYPFTNYGMNWVKQAPGQGLKWMGWINTSTGESTFADDFKGRFDFSLETSANTAYLQINNLKSEDMATYFCARWEVYHGYVPYWGQGTTVTVSSGGGGSGGGGSGGGGSDIQLTQSHKFLSTSVGDRVSITCKASQDVYNAVAWYQQKPGQSPKLLIYSASSRYTGVPSRFTGSGSGPDFTFTISSVQAEDLAVYFCQQHFRTPFTFGSGTKLEIK

SEQ ID NO: 62 - DNA, 789 bp, Artificial Sequence
  CT1095 scFv domain
atggacatgagggtccccgctcagctcctggggctcctgctactctggctccgaggtgccagatgtcaggtacaactgcagcagtcaggacctgaactgaagaagcctggagagacagtcaagatctcctgcaaggcctctgggtatcctttcacaaactatggaatgaactgggtgaagcaggctccaggacagggtttaaagtggatgggctggattaacacctccactggagagtcaacatttgctgatgacttcaagggacggtttgacttctctttggaaacctctgccaacactgcctatttgcagatcaacaacctcaaaagtgaagacatggctacatatttctgtgcaagatgggaggtttaccacggctacgttccttactggggccaagggaccacggtcaccgtttcctctggcggtggcggttctggtggcggtggctccggcggtggcggttctgacatccagctgacccagtctcacaaattcctgtccacttcagtaggagacagggtcagcatcacctgcaaggccagtcaggatgtgtataatgctgttgcctggtatcaacagaaaccaggacaatctcctaaacttctgatttactcggcatcctcccggtacactggagtcccttctcgcttcactggcagtggctctgggccggatttcactttcaccatcagcagtgtgcaggctgaagacctggcagtttatttctgtcagcaacattttcgtactccattcacgttcggctcggggacaaaattggagatcaaa

SEQ ID NO: 63 - protein, 247 aa, Artificial Sequence
  C-001765 PA2.1 scFv (mouse)
DVLMTQTPLSLPVSLGDQASISCRSSQSIVHSNGNTYLEWYLQKPGQSPKLLIYKVSNRFSGVPDRFSGSGSGTDFTLKISRVEAEDLGVYYCFQGSHVPRTSGGGTKLEIKGGGGSGGGGSGGGGSGGQVQLQQSGPELVKPGASVRISCKASGYTFTSYHIHWVKQRPGQGLEWIGWIYPGNVNTEYNEKFKGKATLTADKSSSTAYMHLSSLTSEDSAVYFCAREEITYAMDYWGQGTSVTVSS

SEQ ID NO: 64 - protein, 247 aa, Artificial Sequence
  C-002159 PA2.1.8 scFv (humanized)
QVQLVQSGAEVKKPGSSVKVSCKASGYTFTSYHIHWVRQAPGQGLEWMGWIYPGNVNTEYNEKFKGKATITADKSTSTAYMELSSLRSEDTAVYYCAREEITYAMDYWGQGTTVTVSSGGGGSGGGGSGGGGSGGEIVLTQSPGTLSLSPGERATLSCRSSQSIVHSNGNTYLEWYQQKPGQAPRLLIYKVSNRFSGIPDRFSGSGSGTDFTLTISRLEPEDFAVYYCFQGSHVPRTFGGGTKVEIK

SEQ ID NO: 65 - protein, 247 aa, Artificial Sequence
  C-002160 PA2.1.9 scFv (humanized)
QVQLVQSGAEVKKPGSSVKVSCKASGYTFTSYHIHWVRQAPGQGLEWMGWIYPGNVNTEYNEKFKGKATITADKSTSTAYMELSSLRSEDTAVYYCAREEITYAMDYWGQGTTVTVSSGGGGSGGGGSGGGGSGGDIVMTQTPLSLPVTPGEPASISCRSSQSIVHSNGNTYLEWYLQKPGQSPQLLIYKVSNRFSGVPDRFSGSGSGTDFTLKISRVEAEDVGVYYCFQGSHVPRTFGGGTKVEIK

SEQ ID NO: 66 - protein, 247 aa, Artificial Sequence
  C-002161 PA2.1.10 scFv (humanized)
EVQLVESGGGLVKPGGSLRLSCAASGYTFTSYHIHWVRQAPGKGLEWVGWIYPGNVNTEYNEKFKGRFTISRDDSKNTLYLQMNSLKTEDTAVYYCAREEITYAMDYWGQGTTVTVSSGGGGSGGGGSGGGGSGGDIQMTQSPSSLSASVGDRVTITCRSSQSIVHSNGNTYLEWYQQKPGKAPKLLIYKVSNRFSGVPSRFSGSGSGTDFTLTISSLQPEDFATYYCFQGSHVPRTFGGGTKVEIK

SEQ ID NO: 67 - protein, 247 aa, Artificial Sequence
  C-002162 PA2.1.14 scFv (humanized)
QVQLVQSGAEVKKPGSSVKVSCKASGYTFTSYHIHWVRQAPGQGLEWIGWIYPGNVNTEYNEKFKGKATITADESTNTAYMELSSLRSEDTAVYYCAREEITYAMDYWGQGTLVTVSSGGGGSGGGGSGGGGSGGDIQMTQSPSTLSASVGDRVTITCRSSQSIVHSNGNTYLEWYQQKPGKAPKLLIYKVSNRFSGVPARFSGSGSGTEFTLTISSLQPDDFATYYCFQGSHVPRTFGQGTKVEVK

SEQ ID NO: 68 - protein, 247 aa, Artificial Sequence
  C-002163 PA2.1.18 scFv (humanized)
QVQLVQSGAEVKKPGSSVKVSCKASGYTFTSYHMHWVRQAPGQGLEWIGYIYPGNVNTEYNEKFKGKATLTADKSTNTAYMELSSLRSEDTAVYFCAREEITYAMDYWGQGTLVTVSSGGGGSGGGGSGGGGSGGDVQMTQSPSTLSASVGDRVTITCSSSQSIVHSNGNTYMEWYQQKPGKAPKLLIYKVSNRFSGVPDRFSGSGSGTEFTLTISSLQPDDFATYYCHQGSHVPRTFGQGTKVEVK

SEQ ID NO: 69 - protein, 247 aa, Artificial Sequence
  C-002164 BB7.2 scFv (mouse)
QVQLQQSGPELVKPGASVKMSCKASGYTFTSYHIQWVKQRPGQGLEWIGWIYPGDGSTQYNEKFKGKTTLTADKSSSTAYMLLSSLTSEDSAIYFCAREGTYYAMDYWGQGTSVTVSSGGGGSGGGGSGGGGSGGDVLMTQTPLSLPVSLGDQVSISCRSSQSIVHSNGNTYLEWYLQKPGQSPKLLIYKVSNRFSGVPDRFSGSGSGTDFTLKISRVEAEDLGVYYCFQGSHVPRTFGGGTKLEIK

SEQ ID NO: 70 - protein, 247 aa, Artificial Sequence
  C-002165 BB7.2.1 scFv (humanized)
QLQLQESGPGLVKPSETLSLTCTVSGYTFTSYHIQWIRQPPGKGLEWIGWIYPGDGSTQYNEKFKGRATISVDTSKNQFSLNLDSVSAADTAIYYCAREGTYYAMDYWGKGSTVTVSSGGGGSGGGGSGGGGSGGDIQMTQSPSSLSASVGDRVTITCRSSQSIVHSNGNTYLEWYQQKPGKAPKLLIYKVSNRFSGVPSRFSGSGSGTDFTFTISSLQPEDIATYYCFQGSHVPRTFGPGTKVDIK

SEQ ID NO: 71 - protein, 247 aa, Artificial Sequence
  C-002166 BB7.2.2 scFv (humanized)
EVQLVQSGAELKKPGSSVKVSCKASGYTFTSYHIQWVKQAPGQGLEWIGWIYPGDGSTQYNEKFKGKATLTVDKSTNTAYMELSSLRSEDTAVYYCAREGTYYAMDYWGQGTLVTVSSGGGGSGGGGSGGGGSGGDIQMTQSPSTLSASVGDRVTITCRSSQSIVHSNGNTYLEWYQQKPGKAPKLLIYKVSNRFSGVPSRFSGSGSGTDFTLTISSLQPDDFATYYCFQGSHVPRTFGQGTKVEVK

SEQ ID NO: 72 - protein, 247 aa, Artificial Sequence
  C-002167 BB7.2.3 scFv (humanized)
QVQLVQSGAEVKKPGSSVKVSCKASGYTFTSYHIQWVRQAPGQGLEWMGWIYPGDGSTQYNEKFKGRVTITADKSTSTAYMELSSLRSEDTAVYYCAREGTYYAMDYWGQGTTVTVSSGGGGSGGGGSGGGGSGGEIVLTQSPGTLSLSPGERATLSCRSSQSIVHSNGNTYLEWYQQKPGQAPRLLIYKVSNRFSGIPDRFSGSGSGTDFTLTISRLEPEDFAVYYCFQGSHVPRTFGGGTKVEIK

SEQ ID NO: 73 - protein, 247 aa, Artificial Sequence
  C-002168 BB7.2.5 scFv (humanized)
QVTLKQSGAEVKKPGSSVKVSCTASGYTFTSYHVSWVRQAPGQGLEWLGRIYPGDGSTQYNEKFKGKVTITADKSMDTSFMELTSLTSEDTAVYYCAREGTYYAMDLWGQGTLVTVSSGGGGSGGGGSGGGGSGGEIVLTQSPGTLSLSPGERATLSCRSSQSIVHSNGNTYLAWYQQKPGQAPRLLISKVSNRFSGVPDRFSGSGSGTDFTLTISRLEPEDFAVYYCQQGSHVPRTFGGGTKVEIK

SEQ ID NO: 74 - protein, 247 aa, Artificial Sequence
  C-002169 BB7.2.6 scFv (humanized)
QVQLVQSGAEVKKPGASVKVSCKASGYTFTSYHMHWVRQAPGQRLEWMGWIYPGDGSTQYNEKFKGKVTITRDTSASTAYMELSSLRSEDTAVYYCAREGTYYAMDYWGQGTLVTVSSGGGGSGGGGSGGGGSGGDIVMTQTPLSLPVTPGEPASISCRSSQSIVHSNGNTYLDWYLQKPGQSPQLLIYKVSNRFSGVPDRFSGSGSGTDFTLKISRVEAEDVGVYYCMQGSHVPRTFGGGTKVEIK

SEQ ID NO: 75 - DNA, 741 bp, Artificial Sequence
  C-001765 PA2.1 scFv (mouse)
gatgttttgatgacccaaactccactctccctgcctgtcagtcttggagatcaagcctccatctcttgcagatctagtcagagcattgtacatagtaatggaaacacctatttagaatggtacctgcagaaaccaggccagtctccaaagctcctgatctacaaagtttccaaccgattttctggggtcccagacaggttcagtggcagtggatcagggacagatttcacactcaagatcagtagagtggaggctgaggatctgggagtttattactgctttcaaggttcacatgttcctcggacgtccggtggaggcaccaagctggaaatcaaaggcggaggtggaagcggagggggaggatctggcggcggaggaagcggaggccaggtccagctgcagcagtctggacctgagctggtgaagcctggggcttcagtgaggatatcctgcaaggcttctggctacaccttcacaagttaccatatacattgggtgaagcagaggcctggacagggacttgagtggattggatggatttatcctggaaatgttaatactgagtacaatgagaagttcaagggcaaggccacactgactgcagacaaatcgtccagcacagcctacatgcacctcagcagcctgacctctgaggactctgcggtctatttctgtgccagagaggagattacctatgctatggactactggggtcaaggaacctcagtcaccgtgtcctca

SEQ ID NO: 76 - DNA, 741 bp, Artificial Sequence
  C-002159 PA2.1.8 scFv (humanized)
caggtgcagctggtgcagtctggggctgaggtgaagaagcctgggtcctcagtgaaggtttcctgcaaggcttctggatacaccttcactagctatcatatacattgggtgcgccaggcccccggacaagggcttgagtggatgggatggatctaccctggcaatgttaacacagaatataatgagaagttcaagggcaaagccaccattaccgcggacaaatccacgagcacagcctacatggagctgagcagcctgagatctgaagacacggctgtgtattactgtgcgagggaggaaattacctacgctatggactactggggccagggaaccacagtcaccgtgtcctcaggcggaggtggaagcggagggggaggatctggcggcggaggaagcggaggcgagattgtattgacccagagcccaggcaccctgagcctctctccaggagagcgggccaccctcagttgtagatccagtcagagtattgtacacagtaatgggaacacctatttggaatggtatcagcagaaaccaggtcaagccccaagattgctcatctacaaagtctctaacagatttagtggtattccagacaggttcagcggttccggaagtggtactgatttcaccctcacgatctccaggctcgagccagaagatttcgccgtttattactgttttcaaggttcacatgtgccgcgcacattcggtgggggtactaaagtagaaatcaaa

SEQ ID NO: 77 - DNA, 741 bp, Artificial Sequence
  C-002160 PA2.1.9 scFv (humanized)
caggtgcagctggtgcagtctggggctgaggtgaagaagcctgggtcctcagtgaaggtttcctgcaaggcttctggatacaccttcactagctatcatatacattgggtgcgccaggcccccggacaagggcttgagtggatgggatggatctaccctggcaatgttaacacagaatataatgagaagttcaagggcaaagccaccattaccgcggacaaatccacgagcacagcctacatggagctgagcagcctgagatctgaagacacggctgtgtattactgtgcgagggaggaaattacctacgctatggactactggggccagggaaccacagtcaccgtgtcctcaggcggaggtggaagcggagggggaggatctggcggcggaggaagcggaggcgacattgtaatgacccagaccccactcagcctgcccgtcactccaggagagccggccagcatcagttgtagatccagtcagagtattgtacacagtaatgggaacacctatttggaatggtatctgcagaaaccaggtcaatccccacaattgctcatctacaaagtctctaacagatttagtggtgtaccagacaggttcagcggttccggaagtggtactgatttcaccctcaagatctccagggtcgaggcagaagatgtcggcgtttattactgttttcaaggttcacatgtgccgcgcacattcggtgggggtactaaagtagaaatcaaa

SEQ ID NO: 78 - DNA, 741 bp, Artificial Sequence
  C-002161 PA2.1.10 scFv (humanized)
gaggtgcagctggtggagtctgggggtgggctggtgaagcctgggggctcactgaggctttcctgcgcggcttctggatacaccttcactagctatcatatacattgggtgcgccaggcccccggaaaagggcttgagtgggtgggatggatctaccctggcaatgttaacacagaatataatgagaagttcaagggcagattcaccattagcagggacgattccaagaacacactctacctgcagatgaacagcctgaaaactgaagacacggctgtgtattactgtgcgagggaggaaattacctacgctatggactactggggccagggaaccacagtcaccgtgtcctcaggcggaggtggaagcggagggggaggatctggcggcggaggaagcggaggcgacattcaaatgacccagagcccatccagcctgagcgcatctgtaggtgaccgggtcaccatcacttgtagatccagtcagagtattgtacacagtaatgggaacacctatttggaatggtatcagcagaaaccaggtaaagccccaaaattgctcatctacaaagtctctaacagatttagtggtgtaccaagcaggttcagcggttccggaagtggtactgatttcaccctcacgatctcctctctccagccagaagatttcgccacttattactgttttcaaggttcacatgtgccgcgcacattcggtgggggtactaaagtagaaatcaaa

SEQ ID NO: 79 - DNA, 741 bp, Artificial Sequence
  C-002162 PA2.1.14 scFv (humanized)
caggtgcagctggtgcagtctggggctgaggtgaagaagcctgggtcctcagtgaaggtttcctgcaaggcttctggatacaccttcactagctatcatatacattgggtgcgccaggcccccggacaagggcttgagtggatcggatggatctaccctggcaatgttaacacagaatataatgagaagttcaagggcaaagccaccattaccgcggacgaatccacgaacacagcctacatggagctgagcagcctgagatctgaagacacggctgtgtattactgtgcgagggaggaaattacctacgctatggactactggggccagggaaccctggtcaccgtgtcctcaggcggaggtggaagcggagggggaggatctggcggcggaggaagcggaggcgacattcaaatgacccagagcccatccaccctgagcgcatctgtaggtgaccgggtcaccatcacttgtagatccagtcagagtattgtacacagtaatgggaacacctatttggaatggtatcagcagaaaccaggtaaagccccaaaattgctcatctacaaagtctctaacagatttagtggtgtaccagccaggttcagcggttccggaagtggtactgaattcaccctcacgatctcctctctccagccagatgatttcgccacttattactgttttcaaggttcacatgtgccgcgcacattcggtcagggtactaaagtagaagtcaaa

SEQ ID NO: 80 - DNA, 741 bp, Artificial Sequence
  C-002163 PA2.1.18 scFv (humanized)
caggtgcagctggtgcagtctggggctgaggtgaagaagcctgggtcctcagtgaaggtttcctgcaaggcttctggatacaccttcactagctatcatatgcattgggtgcgccaggcccccggacaagggcttgagtggatcggatacatctaccctggcaatgttaacacagaatataatgagaagttcaagggcaaagccacccttaccgcggacaaatccacgaacacagcctacatggagctgagcagcctgagatctgaagacacggctgtgtatttctgtgcgagggaggaaattacctacgctatggactactggggccagggaaccctggtcaccgtgtcctcaggcggaggtggaagcggagggggaggatctggcggcggaggaagcggaggcgacgttcaaatgacccagagcccatccaccctgagcgcatctgtaggtgaccgggtcaccatcacttgtagctccagtcagagtattgtacacagtaatgggaacacctatatggaatggtatcagcagaaaccaggtaaagccccaaaattgctcatctacaaagtctctaacagatttagtggtgtaccagacaggttcagcggttccggaagtggtactgaattcaccctcacgatctcctctctccagccagatgatttcgccacttattactgtcatcaaggttcacatgtgccgcgcacattcggtcagggtactaaagtagaagtcaaa

SEQ ID NO: 81 - DNA, 741 bp, Artificial Sequence
  C-002164 BB7.2 scFv (mouse)
caggtgcagctgcagcagtctgggcctgagctggtgaagcctggggcctcagtgaagatgtcctgcaaggcttctggatacaccttcactagctatcatatccagtgggtgaagcagaggcctggacaagggcttgagtggatcggatggatctaccctggcgatggtagtacacagtataatgagaagttcaagggcaaaaccacccttaccgcggacaaatcctccagcacagcctacatgttgctgagcagcctgacctctgaagactctgctatctatttctgtgcgagggaggggacctactacgctatggactactggggccagggaacctcagtcaccgtgtcctcaggcggaggtggaagcggagggggaggatctggcggcggaggaagcggaggcgatgttttgatgacccagactccactctccctgcctgtctctcttggagaccaagtctccatctcttgtagatccagtcagagtattgtacacagtaatgggaacacctatttagaatggtatctgcagaaaccaggtcagtctccaaagttgctcatctacaaagtctctaacagatttagtggtgtaccagacaggttcagcggttccggaagtggtactgatttcaccctcaagatctcgagagtggaggctgaggatctgggagtttattactgttttcaaggttcacatgtgccgcgcacattcggtggaggtactaaactggaaatcaaa

SEQ ID NO: 82 - DNA, 741 bp, Artificial Sequence
  C-002165 BB7.2.1 scFv (humanized)
cagctgcagctgcaggagtctgggcccgggctggtgaagccttcggaaacgctgagcctcacctgcacggtttctggatacaccttcaccagctatcatatccagtggatccgacagccccctggaaaagggcttgagtggatcggatggatctaccctggcgatggttcaacacagtacaatgagaagttcaagggcagagccacgattagcgtggacacatccaagaaccaattctccctgaacctggacagcgtgagtgctgcggacacggccatttattactgtgcgagagagggaacttactacgctatggactactggggcaaagggagcacggtcaccgtgtcctcaggcggaggtggaagcggagggggaggatctggcggcggaggaagcggaggcgacatccagatgacccagagcccaagctccctgagtgcgtccgtgggcgaccgcgtgaccatcacttgcagatcctctcagtccatcgtgcactccaacggcaacacgtacctcgagtggtaccagcagaagcccgggaaggccccgaaactgctcatctacaaggtgagcaaccggttctccggcgtccccagccgcttctcagggtccggctcggggacggatttcaccttcacgattagcagcttgcagcccgaagacatcgccacgtactactgctttcagggaagtcacgtgccgcgtaccttcgggccgggcacgaaagtggatattaag

SEQ ID NO: 83 - DNA, 741 bp, Artificial Sequence
  C-002166 BB7.2.2 scFv (humanized)
gaggtgcagctggtgcagtctggggccgagctgaagaagcctgggtcctcggtgaaggtgtcctgcaaggcttctggatacaccttcaccagctatcatatccagtgggtaaaacaggcccctggacaagggcttgagtggatcggatggatctaccctggcgatggttcaacacagtacaatgagaagttcaagggcaaagccacgcttaccgtggacaaatccacgaacacagcctacatggagctgagcagcctgagatctgaggacacggccgtatattactgtgcgagagagggaacttactacgctatggactactggggccaagggaccctggtcaccgtgtcctcaggcggaggtggaagcggagggggaggatctggcggcggaggaagcggaggcgacatccagatgacccagagcccatccaccctgagtgcgtccgtgggcgaccgcgtgaccatcacttgcagatcctctcagtccatcgtgcactccaacggcaacacgtacctcgagtggtaccagcagaagcccgggaaggccccgaaactgctcatctacaaggtgagcaaccggttctccggcgtccccagccgcttctcagggtccggctcggggacggatttcaccctcacgattagcagcttgcagcccgatgacttcgccacgtactactgctttcagggaagtcacgtgccgcgtaccttcgggcagggcacgaaagtggaagttaag

SEQ ID NO: 84 - DNA, 741 bp, Artificial Sequence
  C-002167 BB7.2.3 scFv (humanized)
caggtgcagctggtgcagtctggggccgaggtgaagaagcctgggtcctcggtgaaggtgtcctgcaaggcttctggatacaccttcaccagctatcatatccagtgggtacgacaggcccctggacaagggcttgagtggatgggatggatctaccctggcgatggttcaacacagtacaatgagaagttcaagggcagagtcacgattaccgcggacaaatccacgagcacagcctacatggagctgagcagcctgagatctgaggacacggccgtatattactgtgcgagagagggaacttactacgctatggactactggggccaagggaccacggtcaccgtgtcctcaggcggaggtggaagcggagggggaggatctggcggcggaggaagcggaggcgagatcgtcctgacccagagcccagggaccctgagtttgtccccgggcgagcgcgcgaccctcagttgcagatcctctcagtccatcgtgcactccaacggcaacacgtacctcgagtggtaccagcagaagcccgggcaggccccgcgactgctcatctacaaggtgagcaaccggttctccggcatccccgaccgcttctcagggtccggctcggggacggatttcaccctcacgattagccgcttggagcccgaagacttcgccgtgtactactgctttcagggaagtcacgtgccgcgtaccttcggggggggcacgaaagtggaaattaag

SEQ ID NO: 85 - DNA, 741 bp, Artificial Sequence
  C-002168 BB7.2.5 scFv (humanized)
caggtgaccctgaagcagtctggggccgaggtgaagaagcctgggtcctcggtgaaggtgtcctgcacggcttctggatacaccttcaccagctatcatgtcagctgggtacgacaggcccctggacaagggcttgagtggttgggaaggatctaccctggcgatggttcaacacagtacaatgagaagttcaagggcaaagtcacgattaccgcggacaaatccatggacacatccttcatggagctgaccagcctgacatctgaggacacggccgtatattactgtgcgagagagggaacttactacgctatggacctctggggccaagggaccctggtcaccgtgtcctcaggcggaggtggaagcggagggggaggatctggcggcggaggaagcggaggcgagatcgtcctgacccagagcccagggaccctgagtttgtccccgggcgagcgcgcgaccctcagttgcagatcctctcagtccatcgtgcactccaacggcaacacgtacctcgcgtggtaccagcagaagcccgggcaggccccgcgactgctcatctccaaggtgagcaaccggttctccggcgtccccgaccgcttctcagggtccggctcggggacggatttcaccctcacgattagccgcttggagcccgaagacttcgccgtgtactactgccaacagggaagtcacgtgccgcgtaccttcggggggggcacgaaagtggaaattaag

SEQ ID NO: 86 - DNA, 741 bp, Artificial Sequence
  C-002169 BB7.2.6 scFv (humanized)
caggtgcagctggtgcagtctggggccgaggtgaagaagcctggggcctcggtgaaggtgtcctgcaaggcttctggatacaccttcaccagctatcatatgcactgggtacgacaggcccctggacaaaggcttgagtggatgggatggatctaccctggcgatggttcaacacagtacaatgagaagttcaagggcaaagtcacgattacccgggacacatccgcgagcacagcctacatggagctgagcagcctgagatctgaggacacggccgtatattactgtgcgagagagggaacttactacgctatggactactggggccaagggaccctggtcaccgtgtcctcaggcggaggtggaagcggagggggaggatctggcggcggaggaagcggaggcgacatcgtcatgacccagaccccactgtccctgcctgtgaccccgggcgagcccgcgagcatcagttgcagatcctctcagtccatcgtgcactccaacggcaacacgtacctcgactggtacctgcagaagcccgggcagtccccgcaactgctcatctacaaggtgagcaaccggttctccggcgtccccgaccgcttctcagggtccggctcggggacggatttcaccctcaagattagccgcgtggaggccgaagacgtcggcgtgtactactgcatgcagggaagtcacgtgccgcgtaccttcggggggggcacgaaagtggaaattaag

SEQ ID NO: 87 - protein, 16 aa, Artificial Sequence
  CDR-L1
RSSQSIVHSNGNTYLE

SEQ ID NO: 88 - protein, 16 aa, Artificial Sequence
  CDR-L1
SSSQSIVHSNGNTYME

SEQ ID NO: 89 - protein, 16 aa, Artificial Sequence
  CDR-L1
RSSQSIVHSNGNTYLD

SEQ ID NO: 90 - protein, 12 aa, Artificial Sequence
  CDR-L2
KVSNRFSGVPDR

SEQ ID NO: 91 - protein, 12 aa, Artificial Sequence
  CDR-L2
KVSNRFSGVPAR

SEQ ID NO: 92 - protein, 9 aa, Artificial Sequence
  CDR-L3
FQGSHVPRT

SEQ ID NO: 93 - protein, 9 aa, Artificial Sequence
  CDR-L3
HQGSHVPRT

SEQ ID NO: 94 - protein, 9 aa, Artificial Sequence
  CDR-L3
MQGSHVPRT

SEQ ID NO: 95 - protein, 12 aa, Artificial Sequence
  CDR-H1
ASGYTFTSYHIH

SEQ ID NO: 96 - protein, 12 aa, Artificial Sequence
  CDR-H1
ASGYTFTSYHMH

SEQ ID NO: 97 - protein, 11 aa, Artificial Sequence
  CDR-H1
SGYTFTSYHMH

SEQ ID NO: 98 - protein, 18 aa, Artificial Sequence
  CDR-H2
WIYPGNVNTEYNEKFKGK

SEQ ID NO: 99 - protein, 18 aa, Artificial Sequence
  CDR-H2
YIYPGNVNTEYNEKFKGK

SEQ ID NO: 100 - protein, 17 aa, Artificial Sequence
  CDR-H2
WIYPGDGSTQYNEKFKG

SEQ ID NO: 101 - protein, 9 aa, Artificial Sequence
  CDR-H3
EEITYAMDY

SEQ ID NO: 102 - protein, 9 aa, Artificial Sequence
  CDR-H3
EGTYYAMDY

SEQ ID NO: 103 - protein, 10 aa, Artificial Sequence
  LB-CYBA-1Y
  SITE (10)..(10): Xaa is Tyr or His
STMERWGQKX

SEQ ID NO: 104 - protein, 11 aa, Artificial Sequence
  LB-OAS1-1R
  SITE (7)..(7): Xaa is Arg or Thr
ETDDPRXYQKY

SEQ ID NO: 105 - protein, 9 aa, Artificial Sequence
  HA-1/A2
  SITE (3)..(3): Xaa is His or Arg
VLXDDLLEA

SEQ ID NO: 106 - protein, 9 aa, Artificial Sequence
  HA-2
  SITE (9)..(9): Xaa is Val or Met
YIGEVLVSX

SEQ ID NO: 107 - protein, 9 aa, Artificial Sequence
  HA-8
  SITE (1)..(1): Xaa is Arg or Pro
XTLDKVLEV

SEQ ID NO: 108 - protein, 9 aa, Artificial Sequence
  HA-3
  SITE (2)..(2): Xaa is Thr or Met
VXEPGTAQY

SEQ ID NO: 109 - protein, 11 aa, Artificial Sequence
  HwA11-S
  SITE (6)..(6): Xaa is Ser or Thr
CIPPDXLLFPA

SEQ ID NO: 110 - protein, 11 aa, Artificial Sequence
  LB-ADIR-1F
  SITE (9)..(9): Xaa is Phe or Ser
SVAPALALXPA

SEQ ID NO: 111 - protein, 9 aa, Artificial Sequence
  LB-HIVEP1-1S
  SITE (6)..(6): Xaa is Ser or Asn
SLPKHXVTI

SEQ ID NO: 112 - protein, 9 aa, Artificial Sequence
  LB-NISCH-1A
  SITE (7)..(7): Xaa is Ala or Val
ALAPAPXEV

SEQ ID NO: 113 - protein, 9 aa, Artificial Sequence
  LB-SSR1-1S
  SITE (1)..(1): Xaa is Ser or Leu
XLAVAQDLT

SEQ ID NO: 114 - protein, 10 aa, Artificial Sequence
  LB-WNK1-1I
  SITE (7)..(7): Xaa is Ile or Met
RTLSPEXITV

SEQ ID NO: 115 - protein, 10 aa, Artificial Sequence
  T4A
  SITE (10)..(10): Xaa is Ala or Glu
GLYTYWSAGX

SEQ ID NO: 116 - protein, 9 aa, Artificial Sequence
  UTA2-1
  SITE (3)..(3): Xaa is Leu or Pro
QLXNSVLTL

SEQ ID NO: 117 - protein, 9 aa, Artificial Sequence
  LB-CLYBL-1Y
  SITE (5)..(5): Xaa is Tyr or Asp
SLAAXIPRL

SEQ ID NO: 118 - protein, 10 aa, Artificial Sequence
  TRIM22
  SITE (7)..(7): Xaa is Cys or Arg
MAVPPCXIGV

SEQ ID NO: 119 - protein, 11 aa, Artificial Sequence
  PARP10-1L
  SITE (3)..(3): Xaa is Leu or Pro
GLXGQEGLVEI

SEQ ID NO: 120 - protein, 9 aa, Artificial Sequence
  FAM119A-1T
  SITE (8)..(8): Xaa is Thr or Ile
AMLERQFXV

SEQ ID NO: 121 - protein, 9 aa, Artificial Sequence
  GLRX3-1S
  SITE (3)..(3): Xaa is Ser or Pro
FLXSANEHL

SEQ ID NO: 122 - protein, 9 aa, Artificial Sequence
  HNF4G-1M
  SITE (2)..(2): Xaa is Met or Ile
MXYKDILLL

SEQ ID NO: 123 - protein, 9 aa, Artificial Sequence
  HMMR-1V
  SITE (6)..(6): Xaa is Val or Ala
SLQEKXAKA

SEQ ID NO: 124 - protein, 9 aa, Artificial Sequence
  BCL2A1
  SITE (4)..(4): Xaa is Asn or Lys
VLQXVAFSV

SEQ ID NO: 125 - protein, 10 aa, Artificial Sequence
  CDC26-1F
  SITE (1)..(1): Xaa is Phe or Ser
XVAGTQEVFV

SEQ ID NO: 126 - protein, 10 aa, Artificial Sequence
  APOBEC3F-1S/A
  SITE (3)..(3): Xaa is Ser or Ala
FLXEHPNVTL

SEQ ID NO: 127 - protein, 9 aa, Artificial Sequence
  LB-PRCP-1D
  SITE (8)..(8): Xaa is Asp or Glu
FMWDVAEXL

SEQ ID NO: 128 - protein, 11 aa, Artificial Sequence
  LB-PRCP-1D
  SITE (8)..(8): Xaa is Asp or Glu
FMWDVAEXLKA

SEQ ID NO: 129 - protein, 9 aa, Artificial Sequence
  LB-CCL4-1T
  SITE (7)..(7): Xaa is Thr or Ser
CADPSEXWV

SEQ ID NO: 130 - protein, 9 aa, Artificial Sequence
  LB-NCAPD3-1Q
  SITE (3)..(3): Xaa is Gln or Arg
WLXGVVPVV

SEQ ID NO: 131 - protein, 9 aa, Artificial Sequence
  LB-NDC80-1P
  SITE (7)..(7): Xaa is Pro or Ala
HLEEQIXKV

SEQ ID NO: 132 - protein, 9 aa, Artificial Sequence
  LB-TTK-1D
  SITE (4)..(4): Xaa is Asp or Glu
RLHXGRVFV

SEQ ID NO: 133 - protein, 9 aa, Artificial Sequence
  WDR27-1L
  SITE (2)..(2): Xaa is Leu or Pro
SXDDHVVAV

SEQ ID NO: 134 - protein, 11 aa, Artificial Sequence
  MIIP
  SITE (8)..(8): Xaa is Lys or Glu
SEESAVPXRSW

SEQ ID NO: 135 - protein, 10 aa, Artificial Sequence
  MIIP
  SITE (7)..(7): Xaa is Lys or Glu
EESAVPXRSW

SEQ ID NO: 136 - protein, 9 aa, Artificial Sequence
  LB-DHX33-1C
  SITE (9)..(9): Xaa is Cys or Arg
YLYEGGISX

SEQ ID NO: 137 - protein, 10 aa, Artificial Sequence
  PANE1
RVWDLPGVLK

SEQ ID NO: 138 - protein, 10 aa, Artificial Sequence
  SP110
  SITE (4)..(4): Xaa is Arg or Gly
SLPXGTSTPK

SEQ ID NO: 139 - protein, 9 aa, Artificial Sequence
  ACC-1C/Y
  SITE (5)..(5): Xaa is Tyr or Cys
DYLQXVLQI

SEQ ID NO: 140 - protein, 9 aa, Artificial Sequence
  P2RX7
  SITE (6)..(6): Xaa is His or Arg
WFHHCXPKY

SEQ ID NO: 141 - protein, 9 aa, Artificial Sequence
  ACC-4
  SITE (9)..(9): Xaa is Arg or Gly
ATLPLLCAX

SEQ ID NO: 142 - protein, 10 aa, Artificial Sequence
  ACC-5
  SITE (10)..(10): Xaa is Arg or Gly
WATLPLLCAX

SEQ ID NO: 143 - protein, 9 aa, Artificial Sequence
  AKAP13
  SITE (9)..(9): Xaa is Met or Thr
APAGVREVX

SEQ ID NO: 144 - protein, 10 aa, Artificial Sequence
  LB-APOBEC3B-1K
  SITE (1)..(1): Xaa is Lys or Glu
XPQYHAEMCF

SEQ ID NO: 145 - protein, 9 aa, Artificial Sequence
  APOBEC3H
  SITE (5)..(5): Xaa is Lys or Glu
KPQQXGLRL

SEQ ID NO: 146 - protein, 9 aa, Artificial Sequence
  LB-ARHGDIB-1R
  SITE (7)..(7): Xaa is Arg or Pro
LPRACWXEA

SEQ ID NO: 147 - protein, 11 aa, Artificial Sequence
  LB-BCAT2-1R
  SITE (3)..(3): Xaa is Arg or Thr
QPXRALLFVIL

SEQ ID NO: 148 - protein, 11 aa, Artificial Sequence
  BFAR
  SITE (11)..(11): Xaa is Met or Arg
APNTGRANQQX

SEQ ID NO: 149 - protein, 11 aa, Artificial Sequence
  C14orf169
  SITE (4)..(4): Xaa is Ala or Val
RPRXPTEELAL

SEQ ID NO: 150 - protein, 11 aa, Artificial Sequence
  LB-C16ORF-1R
  SITE (1)..(1): Xaa is Arg or Trp
XPCPSVGLSFL

SEQ ID NO: 151 - protein, 9 aa, Artificial Sequence
  C18orf21
  SITE (6)..(6): Xaa is Ala or Thr
NPATPXSKL

SEQ ID NO: 152 - protein, 10 aa, Artificial Sequence
  LB-EBI3-1I
  SITE (8)..(8): Xaa is Ile or Val
RPRARYYXQV

SEQ ID NO: 153 - protein, 9 aa, Artificial Sequence
  POP1
  SITE (7)..(7): Xaa is Asn or Lys
LPQKKSXAL

SEQ ID NO: 154 - protein, 9 aa, Artificial Sequence
  SCRIB
  SITE (7)..(7): Xaa is Leu or Pro
LPQQPPXSL

SEQ ID NO: 155 - protein, 9 aa, Artificial Sequence
  MTRR
  SITE (5)..(5): Xaa is Ser or Leu
SPASXRTDL

SEQ ID NO: 156 - protein, 9 aa, Artificial Sequence
  LLGL2
  SITE (5)..(5): Xaa is Arg or His
SPSLXILAI

SEQ ID NO: 157 - protein, 11 aa, Artificial Sequence
  LB-ECGF-1H
  SITE (3)..(3): Xaa is His or Arg
RPXAIRRPLAL

SEQ ID NO: 158 - protein, 11 aa, Artificial Sequence
  LB-ERAP1-1R
  SITE (3)..(3): Xaa is Arg or Pro
HPXQEQIALLA

SEQ ID NO: 159 - protein, 9 aa, Artificial Sequence
  LB-ERAP1-1R
  SITE (3)..(3): Xaa is Arg or Pro
HPXQEQIAL

SEQ ID NO: 160 - protein, 9 aa, Artificial Sequence
  LB-FUCA2-1V
  SITE (5)..(5): Xaa is Val or Met
RLRQXGSWL

SEQ ID NO: 161 - protein, 9 aa, Artificial Sequence
  LB-GEMIN4-1V
  SITE (9)..(9): Xaa is Val or Glu
FPALRFVEX

SEQ ID NO: 162 - protein, 11 aa, Artificial Sequence
  HDGF
  SITE (11)..(11): Xaa is Leu or Pro
LPMEVEKNSTX

SEQ ID NO: 163 - protein, 11 aa, Artificial Sequence
  LB-PDCD11-1F
  SITE (8)..(8): Xaa is Phe or Leu
GPDSSKTXLCL

SEQ ID NO: 164 - protein, 9 aa, Artificial Sequence
  LB-PFAS-1P
  SITE (2)..(2): Xaa is Pro or Ser
AXGHTRRKL

SEQ ID NO: 165 - protein, 10 aa, Artificial Sequence
  LB-TEP1-1S
  SITE (9)..(9): Xaa is Ser or Pro
APDGAKVAXL

SEQ ID NO: 166 - protein, 11 aa, Artificial Sequence
  LB-TMEM8A-1I
  SITE (7)..(7): Xaa is Ile or Val
RPRSVTXQPLL

SEQ ID NO: 167 - protein, 10 aa, Artificial Sequence
  LB-USP15-1I
  SITE (8)..(8): Xaa is Ile or Thr
MPSHLRNXLL

SEQ ID NO: 168 - protein, 9 aa, Artificial Sequence
  LRH-1
TPNQRQNVC

SEQ ID NO: 169 - protein, 9 aa, Artificial Sequence
  LB-MOB3A-1C
  SITE (1)..(1): Xaa is Cys or Ser
XPRPGTWTC

SEQ ID NO: 170 - protein, 11 aa, Artificial Sequence
  LB-ZDHHC6-1Y
  SITE (4)..(4): Xaa is Tyr or His
RPRXWILLVKI

SEQ ID NO: 171 - protein, 10 aa, Artificial Sequence
  ZAPHIR
IPRDSWWVEL

SEQ ID NO: 172 - protein, 9 aa, Artificial Sequence
  HEATR1
  SITE (7)..(7): Xaa is Glu or Gly
ISKERAXAL

SEQ ID NO: 173 - protein, 9 aa, Artificial Sequence
  LB-GSTP1-1V
  SITE (7)..(7): Xaa is Val or Ile
DLRCKYXSL

SEQ ID NO: 174 - protein, 9 aa, Artificial Sequence
  HA-1/B60
  SITE (6)..(6): Xaa is His or Arg
KECVLXDDL

SEQ ID NO: 175 - protein, 9 aa, Artificial Sequence
  LB-SON-1R
  SITE (6)..(6): Xaa is Arg or Cys
SETKQXTVL

SEQ ID NO: 176 - protein, 9 aa, Artificial Sequence
  LB-SWAP70-1Q
  SITE (6)..(6): Xaa is Gln or Glu
MEQLEXLEL

SEQ ID NO: 177 - protein, 9 aa, Artificial Sequence
  LB-TRIP10-1EPC
  SITE (2)..(2): Xaa is Glu or Gly
  SITE (3)..(3): Xaa is Pro or Ser
  SITE (7)..(7): Xaa is Cys or Gly
GXXQDLXTL

SEQ ID NO: 178 - protein, 9 aa, Artificial Sequence
  LB-NUP133-1R
  SITE (8)..(8): Xaa is Arg or Gln
SEDLILCXL

SEQ ID NO: 179 - protein, 11 aa, Artificial Sequence
  LB-ZNFX1-1Q
  SITE (8)..(8): Xaa is Gln or His
NEIEDVWXLDL

SEQ ID NO: 180 - protein, 11 aa, Artificial Sequence
  SLC1A5
  SITE (3)..(3): Xaa is Ala or Pro
AEXTANGGLAL

SEQ ID NO: 181 - protein, 10 aa, Artificial Sequence
  ACC-2
  SITE (6)..(6): Xaa is Asp or Gly
KEFEDXIINW

SEQ ID NO: 182 - protein, 11 aa, Artificial Sequence
  ACC-6
MEIFIEVFSHF

SEQ ID NO: 183 - protein, 10 aa, Artificial Sequence
  HB-1H/Y
  SITE (8)..(8): Xaa is His or Tyr
EEKRGSLXVW

SEQ ID NO: 184 - protein, 9 aa, Artificial Sequence
  DPH1
  SITE (2)..(2): Xaa is Val or Leu
SXLPEVDVW

SEQ ID NO: 185 - protein, 9 aa, Artificial Sequence
  UGT2B17/A02
CVATMIFMI

SEQ ID NO: 186 - protein, 10 aa, Artificial Sequence
  UGT2B17/A29
AELLNIPFLY

SEQ ID NO: 187 - protein, 10 aa, Artificial Sequence
  UGT2B17/B44
AELLNIPFLY

SEQ ID NO: 188 - protein, 9 aa, Artificial Sequence
  DFFRY
  SITE (4)..(4): Xaa is Cys or Ser
IVDXLTEMY

SEQ ID NO: 189 - protein, 9 aa, Artificial Sequence
  SMCY
FIDSYICQV

SEQ ID NO: 190 - protein, 11 aa, Artificial Sequence
  TMSB4Y
EVLLRPGLHFR

SEQ ID NO: 191 - protein, 11 aa, Artificial Sequence
  SMCY
  SITE (3)..(3): Xaa is Ser or Ala
  SITE (8)..(8): Xaa is Arg or Gln
SPXVDKAXAEL

SEQ ID NO: 192 - protein, 8 aa, Artificial Sequence
  UTY
  SITE (5)..(5): Xaa is His or Arg
  SITE (7)..(7): Xaa is Asp or Asn
LPHNXTXL

SEQ ID NO: 193 - protein, 9 aa, Artificial Sequence
  RPS4Y
  SITE (8)..(8): Xaa is Val or Leu
TIRYPDPXI

SEQ ID NO: 194 - protein, 10 aa, Artificial Sequence
  UTY
  SITE (1)..(1): Xaa is Arg or Gly
  SITE (6)..(6): Xaa is Glu or Ala
  SITE (8)..(8): Xaa is Val or Pro
XESEEXSXSL

SEQ ID NO: 195 - protein, 9 aa, Artificial Sequence
  HA-1 variant H peptide
VLHDDLLEA

SEQ ID NO: 196 - protein, 19 aa, Artificial Sequence
  P2A self-cleaving polypeptide
ATNFSLLKQAGDVEENPGP

SEQ ID NO: 197 - protein, 608 aa, Artificial Sequence
  C-003754 KP7 HA-1H TCRalpha T48C P2A KP7 HA-1H TCRbeta S57C
MVKIRQFLLAILWLQLSCVSAAKNEVEQSPQNLTAQEGEFITINCSYSVGISALHWLQQHPGGGIVSLFMLSSGKKKHGRLIATINIQEKHSSLHITASHPRDSAVYICAVRSVSGAGSYQLTFGKGTKLSVIPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSGSGATNFSLLKQAGDVEENPGPMGTSLLCWMALCLLGADHADTGVSQNPRHKITKRGQNVTFRCDPISEHNRLYWYRQTLGQGPEFLTYFQNEAQLEKSRLLSDRFSAERPKGSFSTLEIQRTEQGDSAMYLCASSIDSFNEQFFGPGTRLTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 198 - protein, 250 aa, Artificial Sequence
  HA-1H TCR alpha
MVKIRQFLLAILWLQLSCVSAAKNEVEQSPQNLTAQEGEFITINCSYSVGISALHWLQQHPGGGIVSLFMLSSGKKKHGRLIATINIQEKHSSLHITASHPRDSAVYICAVRSVSGAGSYQLTFGKGTKLSVIPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLS

SEQ ID NO: 199 - protein, 276 aa, Artificial Sequence
  HA-1(H) TCRbeta
MGTSLLCWMALCLLGADHADTGVSQNPRHKITKRGQNVTFRCDPISEHNRLYWYRQTLGQGPEFLTYFQNEAQLEKSRLLSDRFSAERPKGSFSTLEIQRTEQGDSAMYLCASSIDSFNEQFFGPGTRLTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLS

SEQ ID NO: 200 - protein, 440 aa, Artificial Sequence
  C-003755 KP7 HA-1H FTCRalpha LIR1 TICD
MVKIRQFLLAILWLQLSCVSAAKNEVEQSPQNLTAQEGEFITINCSYSVGISALHWLQQHPGGGIVSLFMLSSGKKKHGRLIATINIQEKHSSLHITASHPRDSAVYICAVRSVSGAGSYQLTFGKGTKLSVIPNIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVVIGILVAVILLLLLLLLLFLILRHRRQGKHWTSTQRKADFQHPAGAVGPEPTDRGLQWRSSPAADAQEENLYAAVKHTQPEDGVEMDTRSPHDEDPQAVTYAEVKHSRPRREMASPPSPLSGEFLDTKDRQAEEDRQMDTEAAASEAPQDVTYAQLHSLTLRREATEPPPSQEGPSPAVPSIYATLAIH

SEQ ID NO: 201 - protein, 466 aa, Artificial Sequence
  C-003756 KP7 HA-1H FTCRbeta LIR1 TICD
MGTSLLCWMALCLLGADHADTGVSQNPRHKITKRGQNVTFRCDPISEHNRLYWYRQTLGQGPEFLTYFQNEAQLEKSRLLSDRFSAERPKGSFSTLEIQRTEQGDSAMYLCASSIDSFNEQFFGPGTRLTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSVVIGILVAVILLLLLLLLLFLILRHRRQGKHWTSTQRKADFQHPAGAVGPEPTDRGLQWRSSPAADAQEENLYAAVKHTQPEDGVEMDTRSPHDEDPQAVTYAEVKHSRPRREMASPPSPLSGEFLDTKDRQAEEDRQMDTEAAASEAPQDVTYAQLHSLTLRREATEPPPSQEGPSPAVPSIYATLAIH

SEQ ID NO: 202 - DNA, 1827 bp, Artificial Sequence
  C-003754 KP7 HA-1H TCRalpha T48C P2A KP7 HA-1H TCRbeta S57C
atggtgaagatccggcaatttttgttggctattttgtggcttcagctaagctgtgtaagtgccgccaaaaatgaagtggagcagagtcctcagaacctgactgcccaggaaggagaatttatcacaatcaactgcagttactcggtaggaataagtgccttacactggctgcaacagcatccaggaggaggcattgtttccttgtttatgctgagctcagggaagaagaagcatggaagattaattgccacaataaacatacaggaaaagcacagctccctgcacatcacagcctcccatcccagagactctgccgtctacatctgtgctgtcagaagcgtgtccggggccggctcctaccagctcacctttgggaaggggaccaaattatcagtcattccaaatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaatgtgtgctagacatgaggtctatggacttcaagagcaacagtgctgtggcctggagcaacaaatctgactttgcatgtgcaaacgccttcaacaacagcattattccagaagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctgtggtccagcggatccggagccaccaacttcagcctgctgaagcaggccggcgacgtggaggagaaccccggccccatgggcaccagcctcctctgctggatggccctgtgtctcctgggggcagatcacgcagatactggagtctcccagaaccccagacacaagatcacaaagaggggacagaatgtaactttcaggtgtgatccaatttctgaacacaaccgcctttattggtaccgacagaccctggggcagggcccagagtttctgacttacttccagaatgaagctcaactagaaaaatcaaggctgctcagtgatcggttctctgcagagaggcctaagggatctttctccaccttggagatccagcgcacagagcagggggactcggccatgtatctctgtgccagcagcatcgactccttcaacgagcagttcttcgggccgggcaccaggctcacggtcctcgaggacctgaaaaacgtgttcccacccgaggtcgctgtgtttgagccatcagaagcagagatctcccacacccaaaaggccacactggtgtgcctggccacaggcttctaccccgaccacgtggagctgagctggtgggtgaatgggaaggaggtgcacagtggggtctgcacagacccgcagcccctcaaggagcagcccgccctcaatgactccagatactgcctgagcagccgcctgagggtgtcggccaccttctggcagaacccccgcaaccacttccgctgtcaagtccagttctacgggctctcggagaatgacgagtggacccaggatagggccaaacctgtcacccagatcgtcagcgccgaggcctggggtagagcagactgtggcttcacctccgagtcttaccagcaaggggtcctgtctgccaccatcctctatgagatcttgctagggaaggccaccttgtatgccgtgctggtcagtgccctcgtgctgatggccatggtcaagagaaaggattccagaggctag

SEQ ID NO: 203 - DNA, 750 bp, Artificial Sequence
  HA-1H TCR alpha
atggtgaagatccggcaatttttgttggctattttgtggcttcagctaagctgtgtaagtgccgccaaaaatgaagtggagcagagtcctcagaacctgactgcccaggaaggagaatttatcacaatcaactgcagttactcggtaggaataagtgccttacactggctgcaacagcatccaggaggaggcattgtttccttgtttatgctgagctcagggaagaagaagcatggaagattaattgccacaataaacatacaggaaaagcacagctccctgcacatcacagcctcccatcccagagactctgccgtctacatctgtgctgtcagaagcgtgtccggggccggctcctaccagctcacctttgggaaggggaccaaattatcagtcattccaaatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaatgtgtgctagacatgaggtctatggacttcaagagcaacagtgctgtggcctggagcaacaaatctgactttgcatgtgcaaacgccttcaacaacagcattattccagaagacaccttcttccccagcccagaaagttcctgtgatgtcaagctggtcgagaaaagctttgaaacagatacgaacctaaactttcaaaacctgtca

SEQ ID NO: 204 - DNA, 828 bp, Artificial Sequence
  HA-1(H) TCRbeta
atgggcaccagcctcctctgctggatggccctgtgtctcctgggggcagatcacgcagatactggagtctcccagaaccccagacacaagatcacaaagaggggacagaatgtaactttcaggtgtgatccaatttctgaacacaaccgcctttattggtaccgacagaccctggggcagggcccagagtttctgacttacttccagaatgaagctcaactagaaaaatcaaggctgctcagtgatcggttctctgcagagaggcctaagggatctttctccaccttggagatccagcgcacagagcagggggactcggccatgtatctctgtgccagcagcatcgactccttcaacgagcagttcttcgggccgggcaccaggctcacggtcctcgaggacctgaaaaacgtgttcccacccgaggtcgctgtgtttgagccatcagaagcagagatctcccacacccaaaaggccacactggtgtgcctggccacaggcttctaccccgaccacgtggagctgagctggtgggtgaatgggaaggaggtgcacagtggggtctgcacagacccgcagcccctcaaggagcagcccgccctcaatgactccagatactgcctgagcagccgcctgagggtgtcggccaccttctggcagaacccccgcaaccacttccgctgtcaagtccagttctacgggctctcggagaatgacgagtggacccaggatagggccaaacctgtcacccagatcgtcagcgccgaggcctggggtagagcagactgtggcttcacctccgagtcttaccagcaaggggtcctgtct

SEQ ID NO: 205 - DNA, 1279 bp, Artificial Sequence
  C-003755 KP7 HA-1H FTCRalpha LIR1 TICD
atggtgaagatccggcaatttttgttggctattttgtggcttcagctaagctgtgtaagtgccgccaaaaatgaagtggagcagagtcctcagaacctgactgcccaggaaggagaatttatcacaatcaactgcagttactcggtaggaataagtgccttacactggctgcaacagcatccaggaggaggcattgtttccttgtttatgctgagctcagggaagaagaagcatggaagattaattgccacaataaacatacaggaaaagcacagctccctgcacatcacagcctcccatcccagagactctgccgtctacatctgtgctgtcagaagcgtgtccggggccggctcctaccagctcacctttgggaaggggaccaaattatcagtcattccaaatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaatgtgtgctagacatgaggtctatggacttcaagagcaacagtgctgtggcctggagcaacaaatctgactttgcatgtgcaaacgccttcaacaacagcattattccagaagacaccttcttccccagcccagaaagttcctgtgatgtcaagctggtcgagaaaagctttgaaacagatacgaacctaaactttcaaaacctgtcagttgtgatcggcatcttggtggccgtcatcctactgctcctcctcctcctcctcctcttcctcatcctccgacatcgacgtcagggcaaacactggacatcgacccagagaaaggctgatttccaacatcctgcaggggctgtggggccagagcccacagacagaggcctgcagtggaggtccagcccagctgccgatgcccaggaagaaaacctctatgctgccgtgaagcacacacagcctgaggatggggtggagatggacactcggagcccacacgatgaagacccccaggcagtgacgtatgccgaggtgaaacactccagacctaggagagaaatggcctctcctccttccccactgtctggggaattcctggacacaaaggacagacaggcggaagaggacaggcagatggacactgaggctgctgcatctgaagccccccaggatgtgacctacgcccagctgcacagcttgaccctcagacgggaggcaactgagcctcctccatcccaggaagggccct

SEQ ID NO: 206 - DNA, 1401 bp, Artificial Sequence
  C-003756 KP7 HA-1H FTCRbeta LIR1 TICD
atgggcaccagcctcctctgctggatggccctgtgtctcctgggggcagatcacgcagatactggagtctcccagaaccccagacacaagatcacaaagaggggacagaatgtaactttcaggtgtgatccaatttctgaacacaaccgcctttattggtaccgacagaccctggggcagggcccagagtttctgacttacttccagaatgaagctcaactagaaaaatcaaggctgctcagtgatcggttctctgcagagaggcctaagggatctttctccaccttggagatccagcgcacagagcagggggactcggccatgtatctctgtgccagcagcatcgactccttcaacgagcagttcttcgggccgggcaccaggctcacggtcctcgaggacctgaaaaacgtgttcccacccgaggtcgctgtgtttgagccatcagaagcagagatctcccacacccaaaaggccacactggtgtgcctggccacaggcttctaccccgaccacgtggagctgagctggtgggtgaatgggaaggaggtgcacagtggggtctgcacagacccgcagcccctcaaggagcagcccgccctcaatgactccagatactgcctgagcagccgcctgagggtgtcggccaccttctggcagaacccccgcaaccacttccgctgtcaagtccagttctacgggctctcggagaatgacgagtggacccaggatagggccaaacctgtcacccagatcgtcagcgccgaggcctggggtagagcagactgtggcttcacctccgagtcttaccagcaaggggtcctgtctgttgtgatcggcatcttggtggccgtcatcctactgctcctcctcctcctcctcctcttcctcatcctccgacatcgacgtcagggcaaacactggacatcgacccagagaaaggctgatttccaacatcctgcaggggctgtggggccagagcccacagacagaggcctgcagtggaggtccagcccagctgccgatgcccaggaagaaaacctctatgctgccgtgaagcacacacagcctgaggatggggtggagatggacactcggagcccacacgatgaagacccccaggcagtgacgtatgccgaggtgaaacactccagacctaggagagaaatggcctctcctccttccccactgtctggggaattcctggacacaaaggacagacaggcggaagaggacaggcagatggacactgaggctgctgcatctgaagccccccaggatgtgacctacgcccagctgcacagcttgaccctcagacgggaggcaactgagcctcctccatcccaggaagggccctctccagctgtgcccagcatctacgccactctggccatccactag

SEQ ID NO: 207 - protein, 269 aa, Artificial Sequence
  C-1765 (PA2.1, VL-VH)
MDMRVPAQLLGLLLLWLRGARCDVLMTQTPLSLPVSLGDQASISCRSSQSIVHSNGNTYLEWYLQKPGQSPKLLIYKVSNRFSGVPDRFSGSGSGTDFTLKISRVEAEDLGVYYCFQGSHVPRTSGGGTKLEIKGGGGSGGGGSGGGGSGGQVQLQQSGPELVKPGASVRISCKASGYTFTSYHIHWVKQRPGQGLEWIGWIYPGNVNTEYNEKFKGKATLTADKSSSTAYMHLSSLTSEDSAVYFCAREEITYAMDYWGQGTSVTVSS

SEQ ID NO: 208 - DNA, 807 bp, Artificial Sequence
  C-1765 (PA2.1, VL-VH)
atggacatgagggtccccgctcagctcctggggctcctgctactctggctccgaggtgccagatgtgatgttttgatgacccaaactccactctccctgcctgtcagtcttggagatcaagcctccatctcttgcagatctagtcagagcattgtacatagtaatggaaacacctatttagaatggtacctgcagaaaccaggccagtctccaaagctcctgatctacaaagtttccaaccgattttctggggtcccagacaggttcagtggcagtggatcagggacagatttcacactcaagatcagtagagtggaggctgaggatctgggagtttattactgctttcaaggttcacatgttcctcggacgtccggtggaggcaccaagctggaaatcaaaggcggaggtggaagcggagggggaggatctggcggcggaggaagcggaggccaggtccagctgcagcagtctggacctgagctggtgaagcctggggcttcagtgaggatatcctgcaaggcttctggctacaccttcacaagttaccatatacattgggtgaagcagaggcctggacagggacttgagtggattggatggatttatcctggaaatgttaatactgagtacaatgagaagttcaagggcaaggccacactgactgcagacaaatcgtccagcacagcctacatgcacctcagcagcctgacctctgaggactctgcggtctatttctgtgccagagaggagattacctatgctatggactactggggtcaaggaacctcagtcaccgtgtcctca

SEQ ID NO: 209 - protein, 269 aa, Artificial Sequence
  C-2162 (huPA2.1, VH-VL)
MDMRVPAQLLGLLLLWLRGARCQVQLVQSGAEVKKPGSSVKVSCKASGYTFTSYHIHWVRQAPGQGLEWIGWIYPGNVNTEYNEKFKGKATITADESTNTAYMELSSLRSEDTAVYYCAREEITYAMDYWGQGTLVTVSSGGGGSGGGGSGGGGSGGDIQMTQSPSTLSASVGDRVTITCRSSQSIVHSNGNTYLEWYQQKPGKAPKLLIYKVSNRFSGVPARFSGSGSGTEFTLTISSLQPDDFATYYCFQGSHVPRTFGQGTKVEVK

SEQ ID NO: 210 - DNA, 807 bp, Artificial Sequence
  C-2162 (huPA2.1, VH-VL)
atggacatgagggtccccgctcagctcctggggctcctgctactctggctccgaggtgccagatgtcaggtgcagctggtgcagtctggggctgaggtgaagaagcctgggtcctcagtgaaggtttcctgcaaggcttctggatacaccttcactagctatcatatacattgggtgcgccaggcccccggacaagggcttgagtggatcggatggatctaccctggcaatgttaacacagaatataatgagaagttcaagggcaaagccaccattaccgcggacgaatccacgaacacagcctacatggagctgagcagcctgagatctgaagacacggctgtgtattactgtgcgagggaggaaattacctacgctatggactactggggccagggaaccctggtcaccgtgtcctcaggcggaggtggaagcggagggggaggatctggcggcggaggaagcggaggcgacattcaaatgacccagagcccatccaccctgagcgcatctgtaggtgaccgggtcaccatcacttgtagatccagtcagagtattgtacacagtaatgggaacacctatttggaatggtatcagcagaaaccaggtaaagccccaaaattgctcatctacaaagtctctaacagatttagtggtgtaccagccaggttcagcggttccggaagtggtactgaattcaccctcacgatctcctctctccagccagatgatttcgccacttattactgttttcaaggttcacatgtgccgcgcacattcggtcagggtactaaagtagaagtcaaa

SEQ ID NO: 211 - protein, 269 aa, Artificial Sequence
  C-2163 (huPA2.1, VH-VL)
MDMRVPAQLLGLLLLWLRGARCQVQLVQSGAEVKKPGSSVKVSCKASGYTFTSYHMHWVRQAPGQGLEWIGYIYPGNVNTEYNEKFKGKATLTADKSTNTAYMELSSLRSEDTAVYFCAREEITYAMDYWGQGTLVTVSSGGGGSGGGGSGGGGSGGDVQMTQSPSTLSASVGDRVTITCSSSQSIVHSNGNTYMEWYQQKPGKAPKLLIYKVSNRFSGVPDRFSGSGSGTEFTLTISSLQPDDFATYYCHQGSHVPRTFGQGTKVEVK

SEQ ID NO: 212 - DNA, 807 bp, Artificial Sequence
  C-2163 (huPA2.1, VH-VL)
atggacatgagggtccccgctcagctcctggggctcctgctactctggctccgaggtgccagatgtcaggtgcagctggtgcagtctggggctgaggtgaagaagcctgggtcctcagtgaaggtttcctgcaaggcttctggatacaccttcactagctatcatatgcattgggtgcgccaggcccccggacaagggcttgagtggatcggatacatctaccctggcaatgttaacacagaatataatgagaagttcaagggcaaagccacccttaccgcggacaaatccacgaacacagcctacatggagctgagcagcctgagatctgaagacacggctgtgtatttctgtgcgagggaggaaattacctacgctatggactactggggccagggaaccctggtcaccgtgtcctcaggcggaggtggaagcggagggggaggatctggcggcggaggaagcggaggcgacgttcaaatgacccagagcccatccaccctgagcgcatctgtaggtgaccgggtcaccatcacttgtagctccagtcagagtattgtacacagtaatgggaacacctatatggaatggtatcagcagaaaccaggtaaagccccaaaattgctcatctacaaagtctctaacagatttagtggtgtaccagacaggttcagcggttccggaagtggtactgaattcaccctcacgatctcctctctccagccagatgatttcgccacttattactgtcatcaaggttcacatgtgccgcgcacattcggtcagggtactaaagtagaagtcaaa

SEQ ID NO: 213 - protein, 247 aa, Artificial Sequence
  C-001765 variant
MMTQTPLSLPVSLGDQASISCRSSQSIVHSNGNTYLEWYLQKPGQSPKLLIYKVSNRFSGVPDRFSGSGSGTDFTLKISRVEAEDLGVYYCFQGSHVPRTSGGGTKLEIKGGGGSGGGGSGGGGSGGQVQLQQSGPELVKPGASVRISCKASGYTFTSYHIHWVKQRPGQGLEWIGWIYPGNVNTEYNEKFKGKATLTADKSSSTAYMHLSSLTSEDSAVYFCAREEITYAMDYWGQGTSVTVSSYG

SEQ ID NO: 214 - protein, 245 aa, Artificial Sequence
  C-002159
QLVQSGAEVKKPGSSVKVSCKASGYTFTSYHIHWVRQAPGQGLEWMGWIYPGNVNTEYNEKFKGKATITADKSTSTAYMELSSLRSEDTAVYYCAREEITYAMDYWGQGTTVTVSSGGGGSGGGGSGGGGSGGEIVLTQSPGTLSLSPGERATLSCRSSQSIVHSNGNTYLEWYQQKPGQAPRLLIYKVSNRFSGIPDRFSGSGSGTDFTLTISRLEPEDFAVYYCFQGSHVPRTFGGGTKVEIK

SEQ ID NO: 215 - protein, 245 aa, Artificial Sequence
  C-002160
QLVQSGAEVKKPGSSVKVSCKASGYTFTSYHIHWVRQAPGQGLEWMGWIYPGNVNTEYNEKFKGKATITADKSTSTAYMELSSLRSEDTAVYYCAREEITYAMDYWGQGTTVTVSSGGGGSGGGGSGGGGSGGDIVMTQTPLSLPVTPGEPASISCRSSQSIVHSNGNTYLEWYLQKPGQSPQLLIYKVSNRFSGVPDRFSGSGSGTDFTLKISRVEAEDVGVYYCFQGSHVPRTFGGGTKVEIK

SEQ ID NO: 216 - protein, 245 aa, Artificial Sequence
  C-002161
QLVESGGGLVKPGGSLRLSCAASGYTFTSYHIHWVRQAPGKGLEWVGWIYPGNVNTEYNEKFKGRFTISRDDSKNTLYLQMNSLKTEDTAVYYCAREEITYAMDYWGQGTTVTVSSGGGGSGGGGSGGGGSGGDIQMTQSPSSLSASVGDRVTITCRSSQSIVHSNGNTYLEWYQQKPGKAPKLLIYKVSNRFSGVPSRFSGSGSGTDFTLTISSLQPEDFATYYCFQGSHVPRTFGGGTKVEIK

SEQ ID NO: 217 - protein, 245 aa, Artificial Sequence
  C-002162
QLVQSGAEVKKPGSSVKVSCKASGYTFTSYHIHWVRQAPGQGLEWIGWIYPGNVNTEYNEKFKGKATITADESTNTAYMELSSLRSEDTAVYYCAREEITYAMDYWGQGTLVTVSSGGGGSGGGGSGGGGSGGDIQMTQSPSTLSASVGDRVTITCRSSQSIVHSNGNTYLEWYQQKPGKAPKLLIYKVSNRFSGVPARFSGSGSGTEFTLTISSLQPDDFATYYCFQGSHVPRTFGQGTKVEVK

SEQ ID NO: 218 - protein, 245 aa, Artificial Sequence
  C-002163
QLVQSGAEVKKPGSSVKVSCKASGYTFTSYHMHWVRQAPGQGLEWIGYIYPGNVNTEYNEKFKGKATLTADKSTNTAYMELSSLRSEDTAVYFCAREEITYAMDYWGQGTLVTVSSGGGGSGGGGSGGGGSGGDVQMTQSPSTLSASVGDRVTITCSSSQSIVHSNGNTYMEWYQQKPGKAPKLLIYKVSNRFSGVPDRFSGSGSGTEFTLTISSLQPDDFATYYCHQGSHVPRTFGQGTKVEVK

SEQ ID NO: 219 - protein, 45 aa, Artificial Sequence
  CD8alpha hinge
TTTPAPRPPTPAPTIASQPLSLRPEACRPAAGGAVHTRGLDFACD

SEQ ID NO: 220 - DNA, 135 bp, Artificial Sequence
  CD8alpha hinge
accacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgat

SEQ ID NO: 221 - protein, 41 aa, Artificial Sequence
  CD28 hinge
CTIEVMYPPPYLDNEKSNGTIIHVKGKHLCPSPLFPGPSKP

SEQ ID NO: 222 - DNA, 123 bp, Artificial Sequence
  CD28 hinge
tgtaccattgaagttatgtatcctcctccttacctagacaatgagaagagcaatggaaccattatccatgtgaaagggaaacacctttgtccaagtcccctatttcccggaccttctaagccc

SEQ ID NO: 223 - protein, 55 aa, Artificial Sequence
  ct-292 hinge
FVPVFLPAKPTTTPAPRPPTPAPTIASQPLSLRPEACRPAAGGAVHTRGLDFACD

SEQ ID NO: 224 - DNA, 165 bp, Artificial Sequence
  ct-292 hinge
ttcgtgccggtcttcctgccagcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgat

SEQ ID NO: 225 - protein, 39 aa, Artificial Sequence
  ct-297 hinge
IEVMYPPPYLDNEKSNGTIIHVKGKHLCPSPLFPGPSKP

SEQ ID NO: 226 - DNA, 117 bp, Artificial Sequence
  ct-297 hinge
attgaagttatgtatcctcctccttacctagacaatgagaagagcaatggaaccattatccatgtgaaagggaaacacctttgtccaagtcccctatttcccggaccttctaagccc

SEQ ID NO: 227 - DNA, 30 bp, Artificial Sequence
  ct-298 hinge
ggtggcggttcttccggcggtggctctggt

SEQ ID NO: 228 - protein, 229 aa, Artificial Sequence
  ct-299 hinge
ESKYGPPCPSCPAPEFEGGPSVFLFPPKPKDTLMISRTPEVTCVVVDVSQEDPEVQFNWYVDGVEVHNAKTKPREEQFQSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 229 - DNA, 687 bp, Artificial Sequence
  ct-299 hinge
gagtccaaatatggtcccccatgcccatcatgcccagcacctgagttcgaggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttccagagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctcaccgtggacaagagcaggtggcaggaggggaatgtcttctcatgctccgtgatgcatgaggctctgcacaaccactacacacagaagagcctctccctgtctctgggtaaa

SEQ ID NO: 230 - protein, 20 aa, Artificial Sequence
  ct-1094 hinge
AEPKSPDKTHTCPPCPKDPK

SEQ ID NO: 231 - DNA, 60 bp, Artificial Sequence
  ct-1094 hinge
gccgagcccaagtcccctgataaaactcacacctgcccaccctgtcctaaggacccgaag

SEQ ID NO: 232 - protein, 27 aa, Artificial Sequence
  CD28 transmembrane
FWVLVVVGGVLACYSLLVTVAFIIFWV

SEQ ID NO: 233 - DNA, 81 bp, Artificial Sequence
  CD28 transmembrane
ttctgggtgctggtcgttgtgggcggcgtgctggcctgctacagcctgctggtgacagtggccttcatcatcttttgggtg

SEQ ID NO: 234 - protein, 25 aa, Artificial Sequence
  IL-2Rbeta transmembrane domain
IPWLGHLLVGLSGAFGFIILVYLLI

SEQ ID NO: 235 - DNA, 75 bp, Artificial Sequence
  IL-2Rbeta transmembrane domain
attccgtggctcggccacctcctcgtgggcctcagcggggcttttggcttcatcatcttagtgtacttgctgatc

SEQ ID NO: 236 - protein, 21 aa, Artificial Sequence
  CD TM domain
IYIWAPLAGTCGVLLLSLVIT

SEQ ID NO: 237 - DNA, 63 bp, Artificial Sequence
  CD TM domain
atctacatctgggcgcccttggccgggacttgtggggtccttctcctgtcactggttatcacc

SEQ ID NO: 238 - protein, 112 aa, Artificial Sequence
  CD3zeta activation domain
RVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 239 - DNA, 336 bp, Artificial Sequence
  CD3zeta activation domain
agagtgaagttcagcaggagcgcagacgcccccgcgtacaagcagggccagaaccagctctataacgagctcaatctaggacgaagagaggagtacgatgttttggacaagcgtagaggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggactcagtacagccaccaaggacacctacgacgcccttcacatgcaggccctgccccctcgc

SEQ ID NO: 240 - protein, 4 aa, Artificial Sequence
  ITAM
  SITE (2)..(3): Xaa is any amino acid
YXXL

SEQ ID NO: 241 - protein, 43 aa, Artificial Sequence
  CD3zeta activation domain comprising a single ITAM
RVKFSRSADAPAYQQGQNQLYNELNLGRREEYDVLHMQALPPR

SEQ ID NO: 242 - DNA, 129 bp, Artificial Sequence
  CD3zeta activation domain comprising a single ITAM
agagtgaagttcagcaggagcgcagacgcccccgcgtaccagcagggccagaaccagctctataacgagctcaatctaggacgaagagaggagtacgatgttttgcacatgcaggccctgccccctcgc

SEQ ID NO: 243 - protein, 41 aa, Artificial Sequence
  CD28 costimulatory domain
RSKRSRLLHSDYMNMTPRRPGPTRKHYQPYAPPRDFAAYRS

SEQ ID NO: 244 - DNA, 123 bp, Artificial Sequence
  CD28 costimulatory domain
aggagcaagcggagcagactgctgcacagcgactacatgaacatgaccccccggaggcctggccccacccggaagcactaccagccctacgcccctcccagggatttcgccgcctaccggagc

SEQ ID NO: 245 - protein, 94 aa, Artificial Sequence
  IL-2-Rbeta intracellular domain
NCRNTGPWLKKVLKCNTPDPSKFFSQLSSEHGGDVQKWLSSPFPSSSFSPGGLAPEISPLEVLERDKVTQLLPLNTDAYLSLQELQGQDPTHLV

SEQ ID NO: 246 - DNA, 282 bp, Artificial Sequence
  IL-2-Rbeta intracellular domain
aactgcaggaacaccgggccatggctgaagaaggtcctgaagtgtaacaccccagacccctcgaagttcttttcccagctgagctcagagcatggaggcgacgtccagaagtggctctcttcgcccttcccctcatcgtccttcagccctggcggcctggcacctgagatctcgccactagaagtgctggagagggacaaggtgacgcagctgctccccctgaacactgatgcctacttgtctctccaagaactccagggtcaggacccaactcacttggtg

SEQ ID NO: 247 - protein, 4 aa, Artificial Sequence
  STAT5-recruitment motif(s)
YLSL

SEQ ID NO: 248 - protein, 200 aa, Artificial Sequence
  CD28-4-1BB-CD3z
RSKRSRLLHSDYMNMTPRRPGPTRKHYQPYAPPRDFAAYRSRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 249 - DNA, 603 bp, Artificial Sequence
  CD28-4-1BB-CD3z
aggagtaagaggagcaggctcctgcacagtgactacatgaacatgactccccgccgccccgggcccacccgcaagcattaccagccctatgccccaccacgcgacttcgcagcctatcgctcccgtttctctgttgttaaacggggcagaaagaagctcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctag

SEQ ID NO: 250 - protein, 153 aa, Artificial Sequence
  CD28-CD3z
RSKRSRLLHSDYMNMTPRRPGPTRKHYQPYAPPRDFAAYRSRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 251 - DNA, 462 bp, Artificial Sequence
  CD28-CD3z
aggagcaagcggagcagactgctgcacagcgactacatgaacatgaccccccggaggcctggccccacccggaagcactaccagccctacgcccctcccagggatttcgccgcctaccggagcagagtgaagttcagcaggagcgcagacgcccccgcgtacaagcagggccagaaccagctctataacgagctcaatctaggacgaagagaggagtacgatgttttggacaagcgtagaggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggactcagtacagccaccaaggacacctacgacgcccttcacatgcaggccctgccccctcgctag

SEQ ID NO: 252 - protein, 157 aa, Artificial Sequence
  4-1BB-CD3z
KRGRKKLLYIFKQPFMRPVQTTQEEDGCSCRFPEEEEGGCELGGGRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 253 - DNA, 474 bp, Artificial Sequence
  4-1BB-CD3z
aaacggggcagaaagaagctcctgtatatattcaaacaaccatttatgagaccagtacaaactactcaagaggaagatggctgtagctgccgatttccagaagaagaagaaggaggatgtgaactgggcggtggcagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctag

SEQ ID NO: 254 - protein, 253 aa, Artificial Sequence
  Inhibitory Receptor Hinge, Transmembrane and Intracellular Domains
YGSQSSKPYLLTHPSDPLELVVSGPSGGPSSPTTGPTSTSGPEDQPLTPTGSDPQSGLGRHLGVVIGILVAVILLLLLLLLLFLILRHRRQGKHWTSTQRKADFQHPAGAVGPEPTDRGLQWRSSPAADAQEENLYAAVKHTQPEDGVEMDTRSPHDEDPQAVTYAEVKHSRPRREMASPPSPLSGEFLDTKDRQAEEDRQMDTEAAASEAPQDVTYAQLHSLTLRREATEPPPSQEGPSPAVPSIYATLAIH

SEQ ID NO: 255 - DNA, 762 bp, Artificial Sequence
  Inhibitory Receptor Hinge, Transmembrane and Intracellular Domains
tacggctcacagagctccaaaccctacctgctgactcaccccagtgaccccctggagctcgtggtctcaggaccgtctgggggccccagctccccgacaacaggccccacctccacatctggccctgaggaccagcccctcacccccaccgggtcggatccccagagtggtctgggaaggcacctgggggttgtgatcggcatcttggtggccgtcatcctactgctcctcctcctcctcctcctcttcctcatcctccgacatcgacgtcagggcaaacactggacatcgacccagagaaaggctgatttccaacatcctgcaggggctgtggggccagagcccacagacagaggcctgcagtggaggtccagcccagctgccgatgcccaggaagaaaacctctatgctgccgtgaagcacacacagcctgaggatggggtggagatggacactcggagcccacacgatgaagacccccaggcagtgacgtatgccgaggtgaaacactccagacctaggagagaaatggcctctcctccttccccactgtctggggaattcctggacacaaaggacagacaggcggaagaggacaggcagatggacactgaggctgctgcatctgaagccccccaggatgtgacctacgcccagctgcacagcttgaccctcagacgggaggcaactgagcctcctccatcccaggaagggccctctccagctgtgcccagcatctacgccactctggccatccactag

SEQ ID NO: 256 - protein, 6 aa, Artificial Sequence
  ITIM
NLYAAV

SEQ ID NO: 257 - protein, 6 aa, Artificial Sequence
  ITIM
VTYAEV

SEQ ID NO: 258 - protein, 6 aa, Artificial Sequence
  ITIM
VTYAQL

SEQ ID NO: 259 - protein, 6 aa, Artificial Sequence
  ITIM
SIYATL

SEQ ID NO: 260 - protein, 6 aa, Artificial Sequence
  ITIM Consensus
  SITE (1)..(1): Xaa is Ser, Ile, Val or Leu
  SITE (2)..(2): Xaa is any amino acid
  SITE (4)..(5): Xaa is any amino acid
  SITE (6)..(6): Xaa is Ile, Val or Leu
XXYXXX

SEQ ID NO: 261 - protein, 58 aa, Artificial Sequence
  ITIM2-3
VTYAEVKHSRPRREMASPPSPLSGEFLDTKDRQAEEDRQMDTEAAASEAPQDVTYAQL

SEQ ID NO: 262 - protein, 36 aa, Artificial Sequence
  ITIM3-4
VTYAQLHSLTLRREATEPPPSQEGPSPAVPSIYATL

SEQ ID NO: 263 - protein, 87 aa, Artificial Sequence
  ITIM1-3
NLYAAVKHTQPEDGVEMDTRSPHDEDPQAVTYAEVKHSRPRREMASPPSPLSGEFLDTKDRQAEEDRQMDTEAAASEAPQDVTYAQL

SEQ ID NO: 264 - protein, 88 aa, Artificial Sequence
  ITIM2-4
VTYAEVKHSRPRREMASPPSPLSGEFLDTKDRQAEEDRQMDTEAAASEAPQDVTYAQLHSLTLRREATEPPPSQEGPSPAVPSIYATL

SEQ ID NO: 265 - protein, 117 aa, Artificial Sequence
  ITIM1-4
NLYAAVKHTQPEDGVEMDTRSPHDEDPQAVTYAEVKHSRPRREMASPPSPLSGEFLDTKDRQAEEDRQMDTEAAASEAPQDVTYAQLHSLTLRREATEPPPSQEGPSPAVPSIYATL

SEQ ID NO: 266 - protein, 167 aa, Artificial Sequence
  LILRB1 intracellular domain
RHRRQGKHWTSTQRKADFQHPAGAVGPEPTDRGLQWRSSPAADAQEENLYAAVKHTQPEDGVEMDTRSPHDEDPQAVTYAEVKHSRPRREMASPPSPLSGEFLDTKDRQAEEDRQMDTEAAASEAPQDVTYAQLHSLTLRREATEPPPSQEGPSPAVPSIYATLAIH

SEQ ID NO: 267 - protein, 10 aa, Artificial Sequence
  TCR beta intracellular domain
MAMVKRKDSR

SEQ ID NO: 268 - DNA, 30 bp, Artificial Sequence
  TCR beta intracellular domain
atggccatggtcaagagaaaggattccaga

SEQ ID NO: 269 - protein, 23 aa, Artificial Sequence
  LILRB1 transmembrane domain
VVIGILVAVILLLLLLLLLFLIL

SEQ ID NO: 270 - protein, 23 aa, Artificial Sequence
  TCR alpha transmembrane
VIGFRILLLKVAGFNLLMTLRLW

SEQ ID NO: 271 - DNA, 69 bp, Artificial Sequence
  TCR alpha transmembrane
gtgattgggttccgaatcctcctcctgaaagtggccgggtttaatctgctcatgacgctgcggctgtgg

SEQ ID NO: 272 - protein, 23 aa, Artificial Sequence
  TCR beta transmembrane
TILYEILLGKATLYAVLVSALVL

SEQ ID NO: 273 - DNA, 69 bp, Artificial Sequence
  TCR beta transmembrane
accatcctctatgagatcttgctagggaaggccaccttgtatgccgtgctggtcagtgccctcgtgctg

SEQ ID NO: 274 - protein, 20 aa, Artificial Sequence
  D3D Domain
YGSQSSKPYLLTHPSDPLEL

SEQ ID NO: 275 - protein, 63 aa, Artificial Sequence
  LILRB1 hinge domain
YGSQSSKPYLLTHPSDPLELVVSGPSGGPSSPTTGPTSTSGPEDQPLTPTGSDPQSGLGRHLG

SEQ ID NO: 276 - protein, 43 aa, Artificial Sequence
  Short hinge
VVSGPSGGPSSPTTGPTSTSGPEDQPLTPTGSDPQSGLGRHLG

SEQ ID NO: 277 - protein, 86 aa, Artificial Sequence
  Hinge-transmembrane
YGSQSSKPYLLTHPSDPLELVVSGPSGGPSSPTTGPTSTSGPEDQPLTPTGSDPQSGLGRHLGVVIGILVAVILLLLLLLLLFLIL

SEQ ID NO: 278 - protein, 190 aa, Artificial Sequence
  Transmembrane-intracellular domain
VVIGILVAVILLLLLLLLLFLILRHRRQGKHWTSTQRKADFQHPAGAVGPEPTDRGLQWRSSPAADAQEENLYAAVKHTQPEDGVEMDTRSPHDEDPQAVTYAEVKHSRPRREMASPPSPLSGEFLDTKDRQAEEDRQMDTEAAASEAPQDVTYAQLHSLTLRREATEPPPSQEGPSPAVPSIYATLAIH

SEQ ID NO: 279 - protein, 233 aa, Artificial Sequence
  LILRB1 hinge-transmembrane-intracellular domain (w/o YGSQSSKPYLLTHPSDPLEL)
VVSGPSGGPSSPTTGPTSTSGPEDQPLTPTGSDPQSGLGRHLGVVIGILVAVILLLLLLLLLFLILRHRRQGKHWTSTQRKADFQHPAGAVGPEPTDRGLQWRSSPAADAQEENLYAAVKHTQPEDGVEMDTRSPHDEDPQAVTYAEVKHSRPRREMASPPSPLSGEFLDTKDRQAEEDRQMDTEAAASEAPQDVTYAQLHSLTLRREATEPPPSQEGPSPAVPSIYATLAIH

SEQ ID NO: 280 - protein, 650 aa, Artificial Sequence
  LILRB1 amio acid
MTPILTVLICLGLSLGPRTHVQAGHLPKPTLWAEPGSVITQGSPVTLRCQGGQETQEYRLYREKKTALWITRIPQELVKKGQFPIPSITWEHAGRYRCYYGSDTAGRSESSDPLELVVTGAYIKPTLSAQPSPVVNSGGNVILQCDSQVAFDGFSLCKEGEDEHPQCLNSQPHARGSSRAIFSVGPVSPSRRWWYRCYAYDSNSPYEWSLPSDLLELLVLGVSKKPSLSVQPGPIVAPEETLTLQCGSDAGYNRFVLYKDGERDFLQLAGAQPQAGLSQANFTLGPVSRSYGGQYRCYGAHNLSSEWSAPSDPLDILIAGQFYDRVSLSVQPGPTVASGENVTLLCQSQGWMQTFLLTKEGAADDPWRLRSTYQSQKYQAEFPMGPVTSAHAGTYRCYGSQSSKPYLLTHPSDPLELVVSGPSGGPSSPTTGPTSTSGPEDQPLTPTGSDPQSGLGRHLGVVIGILVAVILLLLLLLLLFLILRHRRQGKHWTSTQRKADFQHPAGAVGPEPTDRGLQWRSSPAADAQEENLYAAVKHTQPEDGVEMDTRSPHDEDPQAVTYAEVKHSRPRREMASPPSPLSGEFLDTKDRQAEEDRQMDTEAAASEAPQDVTYAQLHSLTLRREATEPPPSQEGPSPAVPSIYATLAIH

SEQ ID NO: 281 - protein, 35 aa, Artificial Sequence
  ITIM1-2
NLYAAVKHTQPEDGVEMDTRSPHDEDPQAVTYAEV

SEQ ID NO: 282 - protein, 64 aa, Artificial Sequence
  Hinge (iTIM hinge)
YGSQSSKPYLLTHPSDPLELVVSGPSGGPSSPTTGPTSTSGPEDQPLTPTGSDPQSGLGRHLGV

SEQ ID NO: 283 - protein, 44 aa, Artificial Sequence
  Short hinge 2
VVSGPSGGPSSPTTGPTSTSGPEDQPLTPTGSDPQSGLGRHLGV

SEQ ID NO: 284 - protein, 67 aa, Artificial Sequence
  Long hinge 1
AGSGGSGGSGGSPVPSTPPTPSPSTPPTPSPSGGSGNSSGSGGSPVPSTPPTPSPSTPPTPSPSASV

SEQ ID NO: 285 - protein, 75 aa, Artificial Sequence
  Long hinge 2
AGSGGSGGSGGSPVPSTPPTNSSSTPPTPSPSPVPSTPPTNSSSTPPTPSPSPVPSTPPTNSSSTPPTPSPSASV

SEQ ID NO: 286 - protein, 85 aa, Artificial Sequence
  2X short hinge
VVSGPSGGPSSPTTGPTSTSGPEDQPLTPTGSDPQSGLGRHVVSGPSGGPSSPTTGPTSTSGPEDQPLTPTGSDPQSGLGRHLGV

SEQ ID NO: 287 - protein, 32 aa, Artificial Sequence
  Hinge (truncated)
TTGPTSTSGPEDQPLTPTGSDPQSGLGRHLGV

SEQ ID NO: 288 - protein, 18 aa, Artificial Sequence
  T2A self-cleaving peptide
EGRGSLLTCGDVEENPGP

SEQ ID NO: 289 - protein, 20 aa, Artificial Sequence
  E2A self-cleaving peptide
QCTNYALLKLAGDVESNPGP

SEQ ID NO: 290 - protein, 22 aa, Artificial Sequence
  F2A self-cleaving peptide
VKQTLNFDLLKLAGDVESNPGP

SEQ ID NO: 291 - protein, 552 aa, Artificial Sequence
  CT292 full sequence
MDFQVQIFSFLLISASVIMSRGDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTGSTSGSGKPGSGEGSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDVWGQGTLVTVSSAAAFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 292 - DNA, 1659 bp, Artificial Sequence
  CT292 full sequence
atggattttcaggtgcagattttcagcttcctgctaatcagtgcctcagtcataatgtccagaggagatatccagatgacccagtccccgagctccctgtccgcctctgtgggcgatagggtcaccatcacctgccgtgccagtcaggatgtgaatactgctgtagcctggtatcaacagaaaccaggaaaagctccgaaactactgatttactcggcatccttcctttattctggagtcccttctcgcttctctggatctagatctgggacggatttcactctgaccatcagcagtctgcagccggaagacttcgcaacttattactgtcagcaacattatactactcctcccacgttcggacagggtaccaaggtggagatcaaacgcactgggtctacatctggatctgggaagccgggttctggtgagggttctgaggttcagctggtggagtctggcggtggcctggtgcagccagggggctcactccgtttgtcctgtgcagcttctggcttcaacattaaagacacctatatacactgggtgcgtcaggccccgggtaagggcctggaatgggttgcaaggatttatcctacgaatggttatactagatatgccgatagcgtcaagggccgtttcactataagcgcagacacatccaaaaacacagcctacctgcagatgaacagcctgcgtgctgaggacactgccgtctattattgttctagatggggaggggacggcttctatgctatggacgtgtggggtcaaggaaccctggtcaccgtttcctcggcggccgcattcgtgccggtcttcctgccagcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaccacaggaacaggagtaagaggagcaggctcctgcacagtgactacatgaacatgactccccgccgccccgggcccacccgcaagcattaccagccctatgccccaccacgcgacttcgcagcctatcgctcccgtttctctgttgttaaacggggcagaaagaagctcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctag

SEQ ID NO: 293 - protein, 455 aa, Artificial Sequence
  CT298 full sequence
MLLLVTSLLLCELPHPAFLLIPDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGSTSGGGSGGGSGGGGSSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSGGGSSGGGSGIYIWAPLAGTCGVLLLSLVITKRGRKKLLYIFKQPFMRPVQTTQEEDGCSCRFPEEEEGGCELGGGRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 294 - DNA, 1368 bp, Artificial Sequence
  CT298 full sequence
atgctgctactggtcaccagtctactgctgtgcgaactgccacatccggccttcctgctaataccggatatccagatgacccagtccccgagctccctgtccgcctctgtgggcgatagggtcaccatcacctgccgtgccagtcaggatgtgaatactgctgtagcctggtatcaacagaaaccaggaaaagctccgaaactactgatttactcggcatccttcctttattctggagtcccttctcgcttctctggatctagatctgggacggatttcactctgaccatcagcagtctgcagccggaagacttcgcaacttattactgtcagcaacattatactactcctcccacgttcggacagggtaccaaggtggagatcaaagggtctacatctggcggtggctctggtggcggttccggcggtggcggttcttccgaggttcagctggtggagtctggcggtggcctggtgcagccagggggctcactccgtttgtcctgtgcagcttctggcttcaacattaaagacacctatatacactgggtgcgtcaggccccgggtaagggcctggaatgggttgcaaggatttatcctacgaatggttatactagatatgccgatagcgtcaagggccgtttcactataagcgcagacacatccaaaaacacagcctacctgcagatgaacagcctgcgtgctgaggacactgccgtctattattgttctagatggggaggggacggcttctatgctatggactattggggtcaaggaaccctggtcaccgtctcctcgggtggcggttcttccggcggtggctctggtatctacatctgggcgcccttggccgggacttgtggggtccttctcctgtcactggttatcaccaaacggggcagaaagaagctcctgtatatattcaaacaaccatttatgagaccagtacaaactactcaagaggaagatggctgtagctgccgatttccagaagaagaagaaggaggatgtgaactgggcggtggcagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctag

SEQ ID NO: 295 - protein, 674 aa, Artificial Sequence
  CT299 full sequence
MLLLVTSLLLCELPHPAFLLIPDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGSTSGGGSGGGSGGGGSSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSESKYGPPCPSCPAPEFEGGPSVFLFPPKPKDTLMISRTPEVTCVVVDVSQEDPEVQFNWYVDGVEVHNAKTKPREEQFQSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKIYIWAPLAGTCGVLLLSLVITKRGRKKLLYIFKQPFMRPVQTTQEEDGCSCRFPEEEEGGCELGGGRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 296 - DNA, 2025 bp, Artificial Sequence
  CT299 full sequence
atgctgctactggtcaccagtctactgctgtgcgaactgccacatccggccttcctgctaataccggatatccagatgacccagtccccgagctccctgtccgcctctgtgggcgatagggtcaccatcacctgccgtgccagtcaggatgtgaatactgctgtagcctggtatcaacagaaaccaggaaaagctccgaaactactgatttactcggcatccttcctttattctggagtcccttctcgcttctctggatctagatctgggacggatttcactctgaccatcagcagtctgcagccggaagacttcgcaacttattactgtcagcaacattatactactcctcccacgttcggacagggtaccaaggtggagatcaaagggtctacatctggcggtggctctggtggcggttccggcggtggcggttcttccgaggttcagctggtggagtctggcggtggcctggtgcagccagggggctcactccgtttgtcctgtgcagcttctggcttcaacattaaagacacctatatacactgggtgcgtcaggccccgggtaagggcctggaatgggttgcaaggatttatcctacgaatggttatactagatatgccgatagcgtcaagggccgtttcactataagcgcagacacatccaaaaacacagcctacctgcagatgaacagcctgcgtgctgaggacactgccgtctattattgttctagatggggaggggacggcttctatgctatggactattggggtcaaggaaccctggtcaccgtctcctcggagtccaaatatggtcccccatgcccatcatgcccagcacctgagttcgaggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttccagagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctcaccgtggacaagagcaggtggcaggaggggaatgtcttctcatgctccgtgatgcatgaggctctgcacaaccactacacacagaagagcctctccctgtctctgggtaaaatctacatctgggcgcccttggccgggacttgtggggtccttctcctgtcactggttatcaccaaacggggcagaaagaagctcctgtatatattcaaacaaccatttatgagaccagtacaaactactcaagaggaagatggctgtagctgccgatttccagaagaagaagaaggaggatgtgaactgggcggtggcagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctag

SEQ ID NO: 297 - protein, 482 aa, Artificial Sequence
  CT297 full sequence
MDMRVPAQLLGLLLLWLRGARCQVQLQQSGPELKKPGETVKISCKASGYPFTNYGMNWVKQAPGQGLKWMGWINTSTGESTFADDFKGRFDFSLETSANTAYLQINNLKSEDSATYFCARWEVYHGYVPYWGQGTTVTVSSGGGGSGGGGSGGGGSDIQLTQSHKFLSTSVGDRVSITCKASQDVYNAVAWYQQKPGQSPKLLIYSASSRYTGVPSRFTGSGSGPDFTFTISSVQAEDLAVYFCQQHFRTPFTFGSGTKLEIKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 298 - DNA, 1449 bp, Artificial Sequence
  CT297 full sequence
atggacatgagggtccccgctcagctcctggggctcctgctactctggctccgaggtgccagatgtcaggtacaactgcagcagtcaggacctgaactgaagaagcctggagagacagtcaagatctcctgcaaggcctctgggtatcctttcacaaactatggaatgaactgggtgaagcaggctccaggacagggtttaaagtggatgggctggattaacacctccactggagagtcaacatttgctgatgacttcaagggacggtttgacttctctttggaaacctctgccaacactgcctatttgcagatcaacaacctcaaaagtgaagactcggctacatatttctgtgcaagatgggaggtttaccacggctacgttccttactggggccaagggaccacggtcaccgtttcctctggcggtggcggttctggtggcggtggctccggcggtggcggttctgacatccagctgacccagtctcacaaattcctgtccacttcagtaggagacagggtcagcatcacctgcaaggccagtcaggatgtgtataatgctgttgcctggtatcaacagaaaccaggacaatctcctaaacttctgatttactcggcatcctcccggtacactggagtcccttctcgcttcactggcagtggctctgggccggatttcactttcaccatcagcagtgtgcaggctgaagacctggcagtttatttctgtcagcaacattttcgtactccattcacgttcggctcggggacaaaattggagatcaaaattgaagttatgtatcctcctccttacctagacaatgagaagagcaatggaaccattatccatgtgaaagggaaacacctttgtccaagtcccctatttcccggaccttctaagcccttctgggtgctggtcgttgtgggcggcgtgctggcctgctacagcctgctggtgacagtggccttcatcatcttttgggtgaggagcaagcggagcagactgctgcacagcgactacatgaacatgaccccccggaggcctggccccacccggaagcactaccagccctacgcccctcccagggatttcgccgcctaccggagcagagtgaagttcagcaggagcgcagacgcccccgcgtacaagcagggccagaaccagctctataacgagctcaatctaggacgaagagaggagtacgatgttttggacaagcgtagaggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggactcagtacagccaccaaggacacctacgacgcccttcacatgcaggccctgccccctcgctag

SEQ ID NO: 299 - protein, 463 aa, Artificial Sequence
  CT1094 full sequence
MDMRVPAQLLGLLLLWLRGARCQVQLQQSGPELKKPGETVKISCKASGYPFTNYGMNWVKQAPGQGLKWMGWINTSTGESTFADDFKGRFDFSLETSANTAYLQINNLKSEDSATYFCARWEVYHGYVPYWGQGTTVTVSSGGGGSGGGGSGGGGSDIQLTQSHKFLSTSVGDRVSITCKASQDVYNAVAWYQQKPGQSPKLLIYSASSRYTGVPSRFTGSGSGPDFTFTISSVQAEDLAVYFCQQHFRTPFTFGSGTKLEIKAEPKSPDKTHTCPPCPKDPKFWVLVVVGGVLACYSLLVTVAFIIFWVRSKRSRLLHSDYMNMTPRRPGPTRKHYQPYAPPRDFAAYRSRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 300 - DNA, 1392 bp, Artificial Sequence
  CT1094 full sequence
atggacatgagggtccccgctcagctcctggggctcctgctactctggctccgaggtgccagatgtcaggtacaactgcagcagtcaggacctgaactgaagaagcctggagagacagtcaagatctcctgcaaggcctctgggtatcctttcacaaactatggaatgaactgggtgaagcaggctccaggacagggtttaaagtggatgggctggattaacacctccactggagagtcaacatttgctgatgacttcaagggacggtttgacttctctttggaaacctctgccaacactgcctatttgcagatcaacaacctcaaaagtgaagactcggctacatatttctgtgcaagatgggaggtttaccacggctacgttccttactggggccaagggaccacggtcaccgtttcctctggcggtggcggttctggtggcggtggctccggcggtggcggttctgacatccagctgacccagtctcacaaattcctgtccacttcagtaggagacagggtcagcatcacctgcaaggccagtcaggatgtgtataatgctgttgcctggtatcaacagaaaccaggacaatctcctaaacttctgatttactcggcatcctcccggtacactggagtcccttctcgcttcactggcagtggctctgggccggatttcactttcaccatcagcagtgtgcaggctgaagacctggcagtttatttctgtcagcaacattttcgtactccattcacgttcggctcggggacaaaattggagatcaaagccgagcccaagtcccctgataaaactcacacctgcccaccctgtcctaaggacccgaagttctgggtgctggtcgttgtgggcggcgtgctggcctgctacagcctgctggtgacagtggccttcatcatcttttgggtgaggagcaagcggagcagactgctgcacagcgactacatgaacatgaccccccggaggcctggccccacccggaagcactaccagccctacgcccctcccagggatttcgccgcctaccggagcagagtgaagttcagcaggagcgcagacgcccccgcgtacaagcagggccagaaccagctctataacgagctcaatctaggacgaagagaggagtacgatgttttggacaagcgtagaggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggactcagtacagccaccaaggacacctacgacgcccttcacatgcaggccctgccccctcgctag

SEQ ID NO: 301 - protein, 463 aa, Artificial Sequence
  CT1095 full sequence
MDMRVPAQLLGLLLLWLRGARCQVQLQQSGPELKKPGETVKISCKASGYPFTNYGMNWVKQAPGQGLKWMGWINTSTGESTFADDFKGRFDFSLETSANTAYLQINNLKSEDMATYFCARWEVYHGYVPYWGQGTTVTVSSGGGGSGGGGSGGGGSDIQLTQSHKFLSTSVGDRVSITCKASQDVYNAVAWYQQKPGQSPKLLIYSASSRYTGVPSRFTGSGSGPDFTFTISSVQAEDLAVYFCQQHFRTPFTFGSGTKLEIKAEPKSPDKTHTCPPCPKDPKFWVLVVVGGVLACYSLLVTVAFIIFWVRSKRSRLLHSDYMNMTPRRPGPTRKHYQPYAPPRDFAAYRSRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 302 - DNA, 1392 bp, Artificial Sequence
  CT1095 full sequence
atggacatgagggtccccgctcagctcctggggctcctgctactctggctccgaggtgccagatgtcaggtacaactgcagcagtcaggacctgaactgaagaagcctggagagacagtcaagatctcctgcaaggcctctgggtatcctttcacaaactatggaatgaactgggtgaagcaggctccaggacagggtttaaagtggatgggctggattaacacctccactggagagtcaacatttgctgatgacttcaagggacggtttgacttctctttggaaacctctgccaacactgcctatttgcagatcaacaacctcaaaagtgaagacatggctacatatttctgtgcaagatgggaggtttaccacggctacgttccttactggggccaagggaccacggtcaccgtttcctctggcggtggcggttctggtggcggtggctccggcggtggcggttctgacatccagctgacccagtctcacaaattcctgtccacttcagtaggagacagggtcagcatcacctgcaaggccagtcaggatgtgtataatgctgttgcctggtatcaacagaaaccaggacaatctcctaaacttctgatttactcggcatcctcccggtacactggagtcccttctcgcttcactggcagtggctctgggccggatttcactttcaccatcagcagtgtgcaggctgaagacctggcagtttatttctgtcagcaacattttcgtactccattcacgttcggctcggggacaaaattggagatcaaagccgagcccaagtcccctgataaaactcacacctgcccaccctgtcctaaggacccgaagttctgggtgctggtcgttgtgggcggcgtgctggcctgctacagcctgctggtgacagtggccttcatcatcttttgggtgaggagcaagcggagcagactgctgcacagcgactacatgaacatgaccccccggaggcctggccccacccggaagcactaccagccctacgcccctcccagggatttcgccgcctaccggagcagagtgaagttcagcaggagcgcagacgcccccgcgtacaagcagggccagaaccagctctataacgagctcaatctaggacgaagagaggagtacgatgttttggacaagcgtagaggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggactcagtacagccaccaaggacacctacgacgcccttcacatgcaggccctgccccctcgctag

SEQ ID NO: 303 - protein, 522 aa, Artificial Sequence
  C-1765 full sequence
MDMRVPAQLLGLLLLWLRGARCDVLMTQTPLSLPVSLGDQASISCRSSQSIVHSNGNTYLEWYLQKPGQSPKLLIYKVSNRFSGVPDRFSGSGSGTDFTLKISRVEAEDLGVYYCFQGSHVPRTSGGGTKLEIKGGGGSGGGGSGGGGSGGQVQLQQSGPELVKPGASVRISCKASGYTFTSYHIHWVKQRPGQGLEWIGWIYPGNVNTEYNEKFKGKATLTADKSSSTAYMHLSSLTSEDSAVYFCAREEITYAMDYWGQGTSVTVSSYGSQSSKPYLLTHPSDPLELVVSGPSGGPSSPTTGPTSTSGPEDQPLTPTGSDPQSGLGRHLGVVIGILVAVILLLLLLLLLFLILRHRRQGKHWTSTQRKADFQHPAGAVGPEPTDRGLQWRSSPAADAQEENLYAAVKHTQPEDGVEMDTRSPHDEDPQAVTYAEVKHSRPRREMASPPSPLSGEFLDTKDRQAEEDRQMDTEAAASEAPQDVTYAQLHSLTLRREATEPPPSQEGPSPAVPSIYATLAIH

SEQ ID NO: 304 - DNA, 1569 bp, Artificial Sequence
  C-1765 full sequence
atggacatgagggtccccgctcagctcctggggctcctgctactctggctccgaggtgccagatgtgatgttttgatgacccaaactccactctccctgcctgtcagtcttggagatcaagcctccatctcttgcagatctagtcagagcattgtacatagtaatggaaacacctatttagaatggtacctgcagaaaccaggccagtctccaaagctcctgatctacaaagtttccaaccgattttctggggtcccagacaggttcagtggcagtggatcagggacagatttcacactcaagatcagtagagtggaggctgaggatctgggagtttattactgctttcaaggttcacatgttcctcggacgtccggtggaggcaccaagctggaaatcaaaggcggaggtggaagcggagggggaggatctggcggcggaggaagcggaggccaggtccagctgcagcagtctggacctgagctggtgaagcctggggcttcagtgaggatatcctgcaaggcttctggctacaccttcacaagttaccatatacattgggtgaagcagaggcctggacagggacttgagtggattggatggatttatcctggaaatgttaatactgagtacaatgagaagttcaagggcaaggccacactgactgcagacaaatcgtccagcacagcctacatgcacctcagcagcctgacctctgaggactctgcggtctatttctgtgccagagaggagattacctatgctatggactactggggtcaaggaacctcagtcaccgtgtcctcatacggctcacagagctccaaaccctacctgctgactcaccccagtgaccccctggagctcgtggtctcaggaccgtctgggggccccagctccccgacaacaggccccacctccacatctggccctgaggaccagcccctcacccccaccgggtcggatccccagagtggtctgggaaggcacctgggggttgtgatcggcatcttggtggccgtcatcctactgctcctcctcctcctcctcctcttcctcatcctccgacatcgacgtcagggcaaacactggacatcgacccagagaaaggctgatttccaacatcctgcaggggctgtggggccagagcccacagacagaggcctgcagtggaggtccagcccagctgccgatgcccaggaagaaaacctctatgctgccgtgaagcacacacagcctgaggatggggtggagatggacactcggagcccacacgatgaagacccccaggcagtgacgtatgccgaggtgaaacactccagacctaggagagaaatggcctctcctccttccccactgtctggggaattcctggacacaaaggacagacaggcggaagaggacaggcagatggacactgaggctgctgcatctgaagccccccaggatgtgacctacgcccagctgcacagcttgaccctcagacgggaggcaactgagcctcctccatcccaggaagggccctctccagctgtgcccagcatctacgccactctggccatccactag

SEQ ID NO: 305 - protein, 522 aa, Artificial Sequence
  C-2162 full sequence
MDMRVPAQLLGLLLLWLRGARCQVQLVQSGAEVKKPGSSVKVSCKASGYTFTSYHIHWVRQAPGQGLEWIGWIYPGNVNTEYNEKFKGKATITADESTNTAYMELSSLRSEDTAVYYCAREEITYAMDYWGQGTLVTVSSGGGGSGGGGSGGGGSGGDIQMTQSPSTLSASVGDRVTITCRSSQSIVHSNGNTYLEWYQQKPGKAPKLLIYKVSNRFSGVPARFSGSGSGTEFTLTISSLQPDDFATYYCFQGSHVPRTFGQGTKVEVKYGSQSSKPYLLTHPSDPLELVVSGPSGGPSSPTTGPTSTSGPEDQPLTPTGSDPQSGLGRHLGVVIGILVAVILLLLLLLLLFLILRHRRQGKHWTSTQRKADFQHPAGAVGPEPTDRGLQWRSSPAADAQEENLYAAVKHTQPEDGVEMDTRSPHDEDPQAVTYAEVKHSRPRREMASPPSPLSGEFLDTKDRQAEEDRQMDTEAAASEAPQDVTYAQLHSLTLRREATEPPPSQEGPSPAVPSIYATLAIH

SEQ ID NO: 306 - DNA, 1569 bp, Artificial Sequence
  C-2162 full sequence
atggacatgagggtccccgctcagctcctggggctcctgctactctggctccgaggtgccagatgtcaggtgcagctggtgcagtctggggctgaggtgaagaagcctgggtcctcagtgaaggtttcctgcaaggcttctggatacaccttcactagctatcatatacattgggtgcgccaggcccccggacaagggcttgagtggatcggatggatctaccctggcaatgttaacacagaatataatgagaagttcaagggcaaagccaccattaccgcggacgaatccacgaacacagcctacatggagctgagcagcctgagatctgaagacacggctgtgtattactgtgcgagggaggaaattacctacgctatggactactggggccagggaaccctggtcaccgtgtcctcaggcggaggtggaagcggagggggaggatctggcggcggaggaagcggaggcgacattcaaatgacccagagcccatccaccctgagcgcatctgtaggtgaccgggtcaccatcacttgtagatccagtcagagtattgtacacagtaatgggaacacctatttggaatggtatcagcagaaaccaggtaaagccccaaaattgctcatctacaaagtctctaacagatttagtggtgtaccagccaggttcagcggttccggaagtggtactgaattcaccctcacgatctcctctctccagccagatgatttcgccacttattactgttttcaaggttcacatgtgccgcgcacattcggtcagggtactaaagtagaagtcaaatacggctcacagagctccaaaccctacctgctgactcaccccagtgaccccctggagctcgtggtctcaggaccgtctgggggccccagctccccgacaacaggccccacctccacatctggccctgaggaccagcccctcacccccaccgggtcggatccccagagtggtctgggaaggcacctgggggttgtgatcggcatcttggtggccgtcatcctactgctcctcctcctcctcctcctcttcctcatcctccgacatcgacgtcagggcaaacactggacatcgacccagagaaaggctgatttccaacatcctgcaggggctgtggggccagagcccacagacagaggcctgcagtggaggtccagcccagctgccgatgcccaggaagaaaacctctatgctgccgtgaagcacacacagcctgaggatggggtggagatggacactcggagcccacacgatgaagacccccaggcagtgacgtatgccgaggtgaaacactccagacctaggagagaaatggcctctcctccttccccactgtctggggaattcctggacacaaaggacagacaggcggaagaggacaggcagatggacactgaggctgctgcatctgaagccccccaggatgtgacctacgcccagctgcacagcttgaccctcagacgggaggcaactgagcctcctccatcccaggaagggccctctccagctgtgcccagcatctacgccactctggccatccactag

SEQ ID NO: 307 - protein, 522 aa, Artificial Sequence
  C-2163 full sequence
MDMRVPAQLLGLLLLWLRGARCQVQLVQSGAEVKKPGSSVKVSCKASGYTFTSYHMHWVRQAPGQGLEWIGYIYPGNVNTEYNEKFKGKATLTADKSTNTAYMELSSLRSEDTAVYFCAREEITYAMDYWGQGTLVTVSSGGGGSGGGGSGGGGSGGDVQMTQSPSTLSASVGDRVTITCSSSQSIVHSNGNTYMEWYQQKPGKAPKLLIYKVSNRFSGVPDRFSGSGSGTEFTLTISSLQPDDFATYYCHQGSHVPRTFGQGTKVEVKYGSQSSKPYLLTHPSDPLELVVSGPSGGPSSPTTGPTSTSGPEDQPLTPTGSDPQSGLGRHLGVVIGILVAVILLLLLLLLLFLILRHRRQGKHWTSTQRKADFQHPAGAVGPEPTDRGLQWRSSPAADAQEENLYAAVKHTQPEDGVEMDTRSPHDEDPQAVTYAEVKHSRPRREMASPPSPLSGEFLDTKDRQAEEDRQMDTEAAASEAPQDVTYAQLHSLTLRREATEPPPSQEGPSPAVPSIYATLAIH

SEQ ID NO: 308 - DNA, 1569 bp, Artificial Sequence
  C-2163 full sequence
atggacatgagggtccccgctcagctcctggggctcctgctactctggctccgaggtgccagatgtcaggtgcagctggtgcagtctggggctgaggtgaagaagcctgggtcctcagtgaaggtttcctgcaaggcttctggatacaccttcactagctatcatatgcattgggtgcgccaggcccccggacaagggcttgagtggatcggatacatctaccctggcaatgttaacacagaatataatgagaagttcaagggcaaagccacccttaccgcggacaaatccacgaacacagcctacatggagctgagcagcctgagatctgaagacacggctgtgtatttctgtgcgagggaggaaattacctacgctatggactactggggccagggaaccctggtcaccgtgtcctcaggcggaggtggaagcggagggggaggatctggcggcggaggaagcggaggcgacgttcaaatgacccagagcccatccaccctgagcgcatctgtaggtgaccgggtcaccatcacttgtagctccagtcagagtattgtacacagtaatgggaacacctatatggaatggtatcagcagaaaccaggtaaagccccaaaattgctcatctacaaagtctctaacagatttagtggtgtaccagacaggttcagcggttccggaagtggtactgaattcaccctcacgatctcctctctccagccagatgatttcgccacttattactgtcatcaaggttcacatgtgccgcgcacattcggtcagggtactaaagtagaagtcaaatacggctcacagagctccaaaccctacctgctgactcaccccagtgaccccctggagctcgtggtctcaggaccgtctgggggccccagctccccgacaacaggccccacctccacatctggccctgaggaccagcccctcacccccaccgggtcggatccccagagtggtctgggaaggcacctgggggttgtgatcggcatcttggtggccgtcatcctactgctcctcctcctcctcctcctcttcctcatcctccgacatcgacgtcagggcaaacactggacatcgacccagagaaaggctgatttccaacatcctgcaggggctgtggggccagagcccacagacagaggcctgcagtggaggtccagcccagctgccgatgcccaggaagaaaacctctatgctgccgtgaagcacacacagcctgaggatggggtggagatggacactcggagcccacacgatgaagacccccaggcagtgacgtatgccgaggtgaaacactccagacctaggagagaaatggcctctcctccttccccactgtctggggaattcctggacacaaaggacagacaggcggaagaggacaggcagatggacactgaggctgctgcatctgaagccccccaggatgtgacctacgcccagctgcacagcttgaccctcagacgggaggcaactgagcctcctccatcccaggaagggccctctccagctgtgcccagcatctacgccactctggccatccactag

SEQ ID NO: 309 - protein, 9 aa, Artificial Sequence
  HER2 peptide bound to MHC I
KIFGSLAFL

SEQ ID NO: 310 - protein, 13 aa, Artificial Sequence
  HER2 peptide bound to MHC II
GSPYVSRLLGICL

SEQ ID NO: 311 - protein, 7 aa, Artificial Sequence
  CDR-L2
SASFLYS

SEQ ID NO: 312 - protein, 9 aa, Artificial Sequence
  CDR-L3
QQHYTTPPT

SEQ ID NO: 313 - protein, 5 aa, Artificial Sequence
  CDR-H1
DTYIH

SEQ ID NO: 314 - protein, 17 aa, Artificial Sequence
  CDR-H2
RIYPTNGYTRYADSVKG

SEQ ID NO: 315 - protein, 11 aa, Artificial Sequence
  CDR-H3
WGGDGFYAMDV

SEQ ID NO: 316 - protein, 23 aa, Artificial Sequence
  TCR alpha transmembrane domain
VIGFRILLLKVAGFNLLMTLRLW

SEQ ID NO: 317 - DNA, 69 bp, Artificial Sequence; identical to SEQ ID NO: 271
  TCR alpha transmembrane domain

SEQ ID NO: 318 - protein, 23 aa, Artificial Sequence
  TCR beta transmembrane domain
TILYEILLGKATLYAVLVSALVL

SEQ ID NO: 319 - DNA, 69 bp, Artificial Sequence; identical to SEQ ID NO: 273
  TCR beta transmembrane domain

SEQ ID NO: 320 - protein, 10 aa, Artificial Sequence
  TCR beta intracellular domain
MAMVKRKDSR

SEQ ID NO: 321 - DNA, 30 bp, Artificial Sequence; identical to SEQ ID NO: 268
  TCR beta intracellular domain

SEQ ID NO: 322 - DNA, 6 bp, Artificial Sequence
  alpha intracelular domain coding
tccagc

SEQ ID NO: 323 - protein, 522 aa, Artificial Sequence; identical to SEQ ID NO: 303
  C1765 (anti-HLA-A*02 chimeric antigen receptor)

SEQ ID NO: 324 - protein, 522 aa, Artificial Sequence; identical to SEQ ID NO: 305
  C2162 (anti-HLA-A*02 chimeric antigen receptor)

SEQ ID NO: 325 - protein, 273 aa, Homo sapiens
MSGSQSEVAPSPQSPRSPEMGRDLRPGSRVLLLLLLLLLVYLTQPGNGNEGSVTGSCYCGKRISSDSPPSVQFMNRLRKHLRAYHRCLYYTRFQLLSWSVCGGNKDPWVQELMSCLDLKECGHAYSGIVAHQKHLLPTSPPISQASEGASSDIHTPAQMLLSTLQSTQRPTLPVGSLSSDKELTRPNETTIHTAGHSLAAGPEAGENQKQPEKNAGPTARTSATVPVLCLLAIIFILTAALSYVLCKRRRGQSPQSSPDLPVHYIPVAPDSNT

SEQ ID NO: 326 - protein, 742 aa, Homo sapiens
MKDDFAEEEEVQSFGYKRFGIQEGTQCTKCKNNWALKFSIILLYILCALLTITVAILGYKVVEKMDNVTGGMETSRQTYDDKLTAVESDLKKLGDQTGKKAISTNSELSTFRSDILDLRQQLREITEKTSKNKDTLEKLQASGDALVDRQSQLKETLENNSFLITTVNKTLQAYNGYVTNLQQDTSVLQGNLQNQMYSHNVVIMNLNNLNLTQVQQRNLITNLQRSVDDTSQAIQRIKNDFQNLQQVFLQAKKDTDWLKEKVQSLQTLAANNSALAKANNDTLEDMNSQLNSFTGQMENITTISQANEQNLKDLQDLHKDAENRTAIKFNQLEERFQLFETDIVNIISNISYTAHHLRTLTSNLNEVRTTCTDTLTKHTDDLTSLNNTLANIRLDSVSLRMQQDLMRSRLDTEVANLSVIMEEMKLVDSKHGQLIKNFTILQGPPGPRGPRGDRGSQGPPGPTGNKGQKGEKGEPGPPGPAGERGPIGPAGPPGERGGKGSKGSQGPKGSRGSPGKPGPQGSSGDPGPPGPPGKEGLPGPQGPPGFQGLQGTVGEPGVPGPRGLPGLPGVPGMPGPKGPPGPPGPSGAVVPLALQNEPTPAPEDNGCPPHWKNFTDKCYYFSVEKEIFEDAKLFCEDKSSHLVFINTREEQQWIKKQMVGRESHWIGLTDSERENEWKWLDGTSPDYKNWKAGQPDNWGHGHGPGEDCAGLIYAGQWNDFQCEDVNNFICEKDRETVLSSAL

SEQ ID NO: 327 - protein, 514 aa, Homo sapiens
MSWPRRLLLRYLFPALLLHGLGEGSALLHPDSRSHPRSLEKSAWRAFKESQCHHMLKHLHNGARITVQMPPTIEGHWVSTGCEVRSGPEFITRSYRFYHNNTFKAYQFYYGSNRCTNPTYTLIIRGKIRLRQASWIIRGGTEADYQLHNVQVICHTEAVAEKLGQQVNRTCPGFLADGGPWVQDVAYDLWREENGCECTKAVNFAMHELQLIRVEKQYLHHNLDHLVEELFLGDIHTDATQRMFYRPSSYQPPLQNAKNHDHACIACRIIYRSDEHHPPILPPKADLTIGLHGEWVSQRCEVRPEVLFLTRHFIFHDNNNTWEGHYYHYSDPVCKHPTFSIYARGRYSRGVLSSRVMGGTEFVFKVNHMKVTPMDAATASLLNVFNGNECGAEGSWQVGIQQDVTHTNGCVALGIKLPHTEYEIFKMEQDARGRYLLFNGQRPSDGSSPDRPEKRATSYQMPLVQCASSSPRAEDLAEDSGSSLYGRAPGRHTWSLLLAALACLVPLLHWNIRR

SEQ ID NO: 328 - protein, 226 aa, Homo sapiens
DVAYDLWREENGCECTKAVNFAMHELQLIRVEKQYLHHNLDHLVEELFLGDIHTDATQRMFYRPSSYQPPLQNAKCAAESSGSFQILPQDSSEKEQNGLSHWCLSRPGHQKDWALCAHAGPATAGCPSCLWPPAETGRKAGRTSSKTVHACPGEAGTSSFELFYFPNCWSIETKLKISLNAKLSFKPRASAPLETGHRVKIETLSQLVFLSFIQLCCEVQSPLANK

SEQ ID NO: 329 - protein, 94 aa, Homo sapiens
PEDVLPALQLPAPSAECQVEMGFHHVGQDGLQLPTSSDPPALASQSAGITGVSHRPPGRHLSNDLRTTTMPASPVGSSIGQTSTTLPSCPQRQT

SEQ ID NO: 330 - protein, 244 aa, Artificial Sequence
  BB7.1.10_scFv
QVQLQESGPGLVKPSQTLSLTCTVSGYSITSGYSWHWIRQPPGKGLEWIGYIHFSGSTHYHPSLKSRVTISVDTSKNQFSLKLSSVTAADTAVYYCARGGVVSHYAMDCWGQGTTVTVSSGGGGSGGGGSGGGGSGGDIQMTQSPSSLSASVGDRVTITCRASENIYSNLAWYQQKPGKAPKLLIYAATYLPDGVPSRFSGSGSGTDFTLTISSLQPEDFATYYCQHFWVTPYTFGGGTKVEIK

SEQ ID NO: 331 - protein, 244 aa, Artificial Sequence
  BB7.1.9_scFv
EVQLVESGGGLVKPGGSLRLSCAASGYSITSGYSWHWVRQAPGKGLEWVSYIHFSGSTHYHPSLKSRFTISRDNAKNSLYLQMNSLRAEDTAVYYCARGGVVSHYAMDCWGQGTTVTVSSGGGGSGGGGSGGGGSGGDIQMTQSPSSVSASVGDRVTITCRASENIYSNLAWYQQKPGKAPKLLIYAATYLPDGVPSRFSGSGSGTDFTLTISSLQPEDFATYYCQHFWVTPYTFGGGTKVEIK

SEQ ID NO: 332 - protein, 244 aa, Artificial Sequence
  BB7.1.8_scFv
EVQLVESGGGLVKPGGSLRLSCAASGYSITSGYSWHWVRQAPGKGLEWVGYIHFSGSTHYHPSLKSRFTISRDDSKNTLYLQMNSLKTEDTAVYYCARGGVVSHYAMDCWGQGTTVTVSSGGGGSGGGGSGGGGSGGEIVLTQSPATLSLSPGERATLSCRASENIYSNLAWYQQKPGQAPRLLIYAATYLPDGIPARFSGSGSGTDFTLTISSLEPEDFAVYYCQHFWVTPYTFGGGTKVEIK

SEQ ID NO: 333 - protein, 244 aa, Artificial Sequence
  BB7.1.7_scFv
QVQLQQSGPGLVKPSQTLSLTCAISGYSITSGYSWHWIRQSPSRGLEWLGYIHFSGSTHYHPSLKSRITINPDTSKNQFSLQLNSVTPEDTAVYYCARGGVVSHYAMDCWGQGTTVTVSSGGGGSGGGGSGGGGSGGEIVLTQSPATLSLSPGERATLSCRASENIYSNLAWYQQKPGQAPRLLIYAATYLPDGIPARFSGSGSGTDFTLTISRLEPEDFAVYYCQHFWVTPYTFGGGTKVEIK

SEQ ID NO: 334 - protein, 244 aa, Artificial Sequence
  BB7.1.6_scFv
EVQLVESGGGLVKPGGSLRLSCAASGYSITSGYSWHWVRQAPGKGLEWVGYIHFSGSTHYHPSLKSRFTISRDDSKNTLYLQMNSLKTEDTAVYYCARGGVVSHYAMDCWGQGTTVTVSSGGGGSGGGGSGGGGSGGDIQMTQSPSSVSASVGDRVTITCRASENIYSNLAWYQQKPGKAPKLLIYAATYLPDGVPSRFSGSGSGTDFTLTISSLQPEDFATYYCQHFWVTPYTFGGGTKVEIK

SEQ ID NO: 335 - protein, 244 aa, Artificial Sequence
  BB7.1.5_scFv
EVQLVESGGGLVQPGGSLRLSCAASGYSITSGYSWHWVRQAPGKGLEWVSYIHFSGSTHYHPSLKSRFTISRDNSKNTLYLQMNSLRAEDTAVYYCARGGVVSHYAMDCWGQGTTVTVSSGGGGSGGGGSGGGGSGGDIQMTQSPSSLSASVGDRVTITCRASENIYSNLAWYQQKPGKAPKLLIYAATYLPDGVPSRFSGSGSGTDFTLTISSLQPEDFATYYCQHFWVTPYTFGGGTKVEIK

SEQ ID NO: 336 - protein, 244 aa, Artificial Sequence
  BB7.1.4_scFv
EVQLVESGGGLVKPGGSLRLSCAASGYSITSGYSWHWVRQAPGKGLEWVGYIHFSGSTHYHPSLKSRFTISRDDSKNTLYLQMNSLKTEDTAVYYCARGGVVSHYAMDCWGQGTTVTVSSGGGGSGGGGSGGGGSGGDIQMTQSPSSLSASVGDRVTITCRASENIYSNLAWYQQKPGKAPKLLIYAATYLPDGVPSRFSGSGSGTDFTLTISSLQPEDFATYYCQHFWVTPYTFGGGTKVEIK

SEQ ID NO: 337 - protein, 244 aa, Artificial Sequence
  BB7.1.3_scFv
QVQLQQWGAGLLKPSETLSLTCAVYGYSITSGYSWHWIRQPPGKGLEWIGYIHFSGSTHYHPSLKSRVTISVDTSKNQFSLKLSSVTAADTAVYYCARGGVVSHYAMDCWGQGTTVTVSSGGGGSGGGGSGGGGSGGDIQMTQSPSSLSASVGDRVTITCRASENIYSNLAWYQQKPGKAPKLLIYAATYLPDGVPSRFSGSGSGTDFTLTISSLQPEDFATYYCQHFWVTPYTFGGGTKVEIK

SEQ ID NO: 338 - protein, 244 aa, Artificial Sequence
  BB7.1.2_scFv
QVQLQESGPGLVKPSQTLSLTCTVSGYSITSGYSWHWIRQHPGKGLEWIGYIHFSGSTHYHPSLKSRVTISVDTSKNQFSLKLSSVTAADTAVYYCARGGVVSHYAMDCWGQGTTVTVSSGGGGSGGGGSGGGGSGGDIQMTQSPSSLSASVGDRVTITCRASENIYSNLAWYQQKPGKAPKLLIYAATYLPDGVPSRFSGSGSGTDFTLTISSLQPEDFATYYCQHFWVTPYTFGGGTKVEIK

SEQ ID NO: 339 - protein, 244 aa, Artificial Sequence
  BB7.1.1_scFv
QVQLQQSGPGLVKPSQTLSLTCAISGYSITSGYSWHWIRQSPSRGLEWLGYIHFSGSTHYHPSLKSRITINPDTSKNQFSLQLNSVTPEDTAVYYCARGGVVSHYAMDCWGQGTTVTVSSGGGGSGGGGSGGGGSGGDIQMTQSPSSLSASVGDRVTITCRASENIYSNLAWYQQKPGKAPKLLIYAATYLPDGVPSRFSGSGSGTDFTLTISSLQPEDFATYYCQHFWVTPYTFGGGTKVEIK

SEQ ID NO: 340 - protein, 243 aa, Artificial Sequence
  HLA-A*11 scFv 9
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARHYYYYSMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 341 - protein, 244 aa, Artificial Sequence
  HLA-A*11 scFv 8
QITLKESGPTLVKPTQTLTLTCTFSGFSLSTSGVGVGWIRQPPGKALEWLALIYWNDDKRYSPSLKSRLTITKDTSKNQVVLTMTNMDPVDTATYYCAHRHMRLSCFDYWGQGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 342 - protein, 245 aa, Artificial Sequence
  HLA-A*11 scFv 7
QVQLVQSGAEVKKPGASVKVSCKASGYTFTSYAMHWVRQAPGQRLEWMGWINAGNGNTKYSQKFQGRVTITRDTSASTAYMELSSLRSEDTAVYYCAREGNGANPDAFDIWGQGTMVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 343 - protein, 243 aa, Artificial Sequence
  HLA-A*11 scFv 6
EVQLVESGGGLVQPGGSLRLSCAASGFTFSSYDMHWVRQATGKGLEWVSAIGTAGDTYYPGSVKGRFTISRENAKNSLYLQMNSLRAGDTAVYYCARDLPGSYWYFDLWGRGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 344 - protein, 243 aa, Artificial Sequence
  HLA-A*11 scFv 5
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARHYYYYYLDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 345 - protein, 243 aa, Artificial Sequence
  HLA-A*11 scFv 4
EVQLVESGGGLVQPGGSLRLSCAASGFTFSSYWMHWVRQAPGKGLVWVSRINSDGSSTSYADSVKGRFTISRDNAKNTLYLQMNSLRAEDTAVYYCCLGVLLYNWFDPWGQGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 346 - protein, 242 aa, Artificial Sequence
  HLA-A*11 scFv 3
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARHYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 347 - protein, 243 aa, Artificial Sequence
  HLA-A*11 scFv 2
QITLKESGPTLVKPTQTLTLTCTFSGFSLSTSGVGVGWIRQPPGKALEWLALIYWNDDKRYSPSLKSRLTITKDTSKNQVVLTMTNMDPVDTATYYCAHKTTSFYFDYWGQGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 348 - protein, 243 aa, Artificial Sequence
  HLA-A*11 scFv 1
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARHYYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 349 - protein, 240 aa, Artificial Sequence
  C7-45
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAVSFDWFDPWGQGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 350 - protein, 248 aa, Artificial Sequence
  C7-44
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARERSISPYYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 351 - protein, 247 aa, Artificial Sequence
  C7-43
QLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARDSVIWYWFDPWGQGTLVTVSSGGGGSGGGGSGGGGSGGQSVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGWVFGGGTKLTVL

SEQ ID NO: 352 - protein, 249 aa, Artificial Sequence
  C7-42
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCAREEILPRLSYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 353 - protein, 245 aa, Artificial Sequence
  C7-41
QVQLVQSGSELKKPGASVKVSCKASGYTFTSYAMNWVRQAPGQGLEWMGWINTNTGNPTYAQGFTGRFVFSFDTSVSTAYLQICSLKAEDTAVYYCARGGRAHSSWYFDLWGRGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 354 - protein, 251 aa, Artificial Sequence
  C7-40
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARDRIKILPRLGYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 355 - protein, 246 aa, Artificial Sequence
  C7-39
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARDTVIHYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 356 - protein, 250 aa, Artificial Sequence
  C7-38
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARDVIVEVFLSYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 357 - protein, 246 aa, Artificial Sequence
  C7-37
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARDIFIHYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 358 - protein, 247 aa, Artificial Sequence
  C7-36
EVQLVESGGGLVQPGGSLRLSCAASGFTFSSYSMNWVRQAPGKGLEWVSYISSSSSTIYYADSVKGRFTISRDNAKNSLYLQMNSLRAEDTAVYYCARDGTFYSYSPYYFDYWGQGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 359 - protein, 251 aa, Artificial Sequence
  C7-35
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCAREWIKILPRLGYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 360 - protein, 246 aa, Artificial Sequence
  C7-34
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARDRSLYYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 361 - protein, 248 aa, Artificial Sequence
  C7-33
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARDKILAPNYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 362 - protein, 250 aa, Artificial Sequence
  C7-32
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCAREKSWKYFYYYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 363 - protein, 249 aa, Artificial Sequence
  C7-31
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARENTSTIPYYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 364 - protein, 253 aa, Artificial Sequence
  C7-30
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCAREDVDKNTSTIYYYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 365 - protein, 250 aa, Artificial Sequence
  C7-29
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDGGDIVSSSAIYWYFDLWGRGTLVTVSSGGGGSGGGGSGGGGSGGAIQLTQSPSSLSASVGDRVTITCRASQGISSALAWYQQKPGKAPKLLIYDASSLESGVPSRFSGSGSGTDFTLTISSLQPEDFATYYCQQFNSYPLTFGGGTKVEIK

SEQ ID NO: 366 - protein, 248 aa, Artificial Sequence
  C7-28
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARDLILPPYYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 367 - protein, 253 aa, Artificial Sequence
  C7-27
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARETWIKILPRYYYYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 368 - protein, 246 aa, Artificial Sequence
  C7-26
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARDLSRYYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 369 - protein, 242 aa, Artificial Sequence
  C7-25
EVQLVESGGGLVQPGGSLRLSCAASGFTFSSYSMNWVRQAPGKGLEWVSYISSSSSTIYYADSVKGRFTISRDNAKNSLYLQMNSLRAEDTAVYYCAREHIVLCFDYWGQGTLVTVSSGGGGSGGGGSGGGGSGGDIQMTQSPSSLSASVGDRVTITCRASQGISSWLAWYQQKPEKAPKSLIYAASSLQSGVPSRFSGSGSGTDFTLTISSLQPEDFATYYCQQYNSYPLTFGGGTKVEIK

SEQ ID NO: 370 - protein, 249 aa, Artificial Sequence
  C7-24
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARDKILPRPYYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 371 - protein, 244 aa, Artificial Sequence
  C7-23
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARGSNEYFQHWGQGTLVTVSSGGGGSGGGGSGGGGSGGQSALTQPPSASGSPGQSVTISCTGTSSDVGGYNYVSWYQQHPGKAPKLMIYEVSKRPSGVPDRFSGSKSGNTASLTVSGLQAEDEADYYCSSYAGSNNWVFGGGTKLTVL

SEQ ID NO: 372 - protein, 242 aa, Artificial Sequence
  C7-22
QVQLVQSGSELKKPGASVKVSCKASGYTFTSYAMNWVRQAPGQGLEWMGWINTNTGNPTYAQGFTGRFVFSFDTSVSTAYLQICSLKAEDTAVYYCARGTSYWYFDLWGRGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 373 - protein, 248 aa, Artificial Sequence
  C7-21
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCAREEIVEVFYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 374 - protein, 241 aa, Artificial Sequence
  C7-20
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKVDDYYFDYWGQGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 375 - protein, 247 aa, Artificial Sequence
  C7-19
EVQLVESGGGLVQPGGSLRLSCAASGFTFSSYWMHWVRQAPGKGLVWVSRINSDGSSTSYADSVKGRFTISRDNAKNTLYLQMNSLRAEDTAVYYCAWSTNILLSYTKAFDIWGQGTMVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 376 - protein, 246 aa, Artificial Sequence
  C7-18
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARDKTYYYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 377 - protein, 253 aa, Artificial Sequence
  C7-17
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCAREKYFHDKYFHDYYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 378 - protein, 246 aa, Artificial Sequence
  C7-16
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARDTSVYYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 379 - protein, 248 aa, Artificial Sequence
  C7-15
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCAREKILPYYYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 380 - protein, 257 aa, Artificial Sequence
  C7-14
EVQLVESGGGLVQPGGSLRLSCAASGFTFSSYSMNWVRQAPGKGLEWVSYISSSSSTIYYADSVKGRFTISRDNAKNSLYLQMNSLRAEDTAVYYCAIQWIYIYINPRGFIFLHDAFDIWGQGTMVTVSSGGGGSGGGGSGGGGSGGQSVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGWVFGGGTKLTVL

SEQ ID NO: 381 - protein, 248 aa, Artificial Sequence
  C7-13
QVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAKEDVDFHHDAFDIWGQGTMVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 382 - protein, 253 aa, Artificial Sequence
  C7-12
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCAREGVDKNTSTIYYYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 383 - protein, 241 aa, Artificial Sequence
  C7-11
EVQLVESGGGLVQPGGSLRLSCAASGFTFSSYSMNWVRQAPGKGLEWVSYISSSSSTIYYADSVKGRFTISRDNAKNSLYLQMNSLRAEDTAVYYCARDRRGYFDLWGRGTLVTVSSGGGGSGGGGSGGGGSGGDIQMTQSPSSLSASVGDRVTITCRASQGISSWLAWYQQKPEKAPKSLIYAASSLQSGVPSRFSGSGSGTDFTLTISSLQPEDFATYYCQQYNSYPLTFGGGTKVEIK

SEQ ID NO: 384 - protein, 248 aa, Artificial Sequence
  C7-10
EVQLVQSGAEVKKPGATVKISCKVSGYTFTDYYMHWVQQAPGKGLEWMGLVDPEDGETIYAEKFQGRVTITADTSTDTAYMELSSLRSEDTAVYYCATGIHVDIRSMEDWFDPWGQGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 385 - protein, 246 aa, Artificial Sequence
  C7-9
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARDIGTSYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 386 - protein, 249 aa, Artificial Sequence
  C7-8
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCAREVVEVFLYYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 387 - protein, 246 aa, Artificial Sequence
  C7-7
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARDLYYYYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 388 - protein, 256 aa, Artificial Sequence
  C7-6
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARESWKYFYPRGSIFIHYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 389 - protein, 248 aa, Artificial Sequence
  C7-5
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARDRIVEVFYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 390 - protein, 250 aa, Artificial Sequence
  C7-4
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCAREKYFHDWLYYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 391 - protein, 250 aa, Artificial Sequence
  C7-3
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARDLVDKNTSYYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 392 - protein, 244 aa, Artificial Sequence
  C7-2
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARVQNEYFQHWGQGTLVTVSSGGGGSGGGGSGGGGSGGQSALTQPPSASGSPGQSVTISCTGTSSDVGGYNYVSWYQQHPGKAPKLMIYEVSKRPSGVPDRFSGSKSGNTASLTVSGLQAEDEADYYCSSYAGSNNWVFGGGTKLTVL

SEQ ID NO: 393 - protein, 239 aa, Artificial Sequence
  C7-1
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCATANWFDPWGQGTLVTVSSGGGGSGGGGSGGGGSGGDIQMTQSPSSVSASVGDRVTITCRASQGISSWLAWYQQKPGKAPKLLIYAASSLQSGVPSRFSGSGSGTDFTLTISSLQPEDFATYYCQQANSFPLTFGGGTKVEIK

SEQ ID NO: 394 - protein, 244 aa, Artificial Sequence
  HLA-A*03 scFv 15
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARERVSQRGAFDIWGQGTMVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 395 - protein, 243 aa, Artificial Sequence
  HLA-A*03 scFv 16
EVQLVESGGGLVQPGGSLRLSCAASGFTFSSYSMNWVRQAPGKGLEWVSYISSSSSTIYYADSVKGRFTISRDNAKNSLYLQMNSLRAEDTAVYYCARGNPDKDPFDYWGQGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 396 - protein, 245 aa, Artificial Sequence
  HLA-A*03 scFv 17
QVQLQESGPGLVKPSETLSLTCTVSGGSVSSGSYYWSWIRQPPGKGLEWIGYIYYSGSTNYNPSLKSRVTISVDTSKNQFSLKLSSVTAADTAVYYCARDFYCTNWYFDLWGRGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 397 - protein, 244 aa, Artificial Sequence
  HLA-A*03 scFv 18
QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCARESSSGSYWYFDLWGRGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 398 - protein, 250 aa, Artificial Sequence
  HLA-A*03 scFv 19
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARDSGYKYNLYYYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 399 - protein, 249 aa, Artificial Sequence
  HLA-A*03 scFv 20
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARGGDLSHYYYYMDVWGKGTTVTVSSGGGGSGGGGSGGGGSGGQTVVTQEPSLTVSPGGTVTLTCASSTGAVTSGYYPNWFQQKPGQAPRALIYSTSNKHSWTPARFSGSLLGGKAALTLSGVQPEDEAEYYCLLYYGGAQWVFGGGTKLTVL

SEQ ID NO: 400 - protein, 246 aa, Artificial Sequence
  HLA-A*03 scFv 21
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARENRRYNSCYYFDYWGQGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 401 - protein, 249 aa, Artificial Sequence
  HLA-A*03 scFv 22
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARGGDLSHYYYYLDVWGKGTTVTVSSGGGGSGGGGSGGGGSGGQTVVTQEPSLTVSPGGTVTLTCASSTGAVTSGYYPNWFQQKPGQAPRALIYSTSNKHSWTPARFSGSLLGGKAALTLSGVQPEDEAEYYCLLYYGGAQWVFGGGTKLTVL

SEQ ID NO: 402 - protein, 245 aa, Artificial Sequence
  HLA-A*03 scFv 23
EVQLVESGGGLVQPGGSLRLSCAASGFTVSSNYMSWVRQAPGKGLEWVSVIYSGGSTYYADSVKGRFTISRDNSKNTLYLQMNSLRAEDTAVYYCARATLLSLSYDAFDIWGQGTMVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 403 - protein, 248 aa, Artificial Sequence
  HLA-A*03 scFv 24
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARGGDLSHYYYMDVWGKGTTVTVSSGGGGSGGGGSGGGGSGGQTVVTQEPSLTVSPGGTVTLTCASSTGAVTSGYYPNWFQQKPGQAPRALIYSTSNKHSWTPARFSGSLLGGKAALTLSGVQPEDEAEYYCLLYYGGAQWVFGGGTKLTVL

SEQ ID NO: 404 - protein, 241 aa, Artificial Sequence
  HLA-A*03 scFv 25
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARERDRWFDPWGQGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 405 - protein, 247 aa, Artificial Sequence
  HLA-A*03 scFv 26
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARETPPSLGAFDIWGQGTMVTVSSGGGGSGGGGSGGGGSGGQSALTQPPSASGSPGQSVTISCTGTSSDVGGYNYVSWYQQHPGKAPKLMIYEVSKRPSGVPDRFSGSKSGNTASLTVSGLQAEDEADYYCSSYAGSNNWVFGGGTKLTVL

SEQ ID NO: 406 - protein, 251 aa, Artificial Sequence
  HLA-A*03 scFv 27
QLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCAREAYCLSDSYWYFDLWGRGTLVTVSSGGGGSGGGGSGGGGSGGQSVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGWVFGGGTKLTVL

SEQ ID NO: 407 - protein, 248 aa, Artificial Sequence
  HLA-A*03 scFv 28
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARESWKYFYPRGYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 408 - protein, 248 aa, Artificial Sequence
  A1-9
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARGGWTAWYYYMDVWGKGTTVTVSSGGGGSGGGGSGGGGSGGQTVVTQEPSLTVSPGGTVTLTCASSTGAVTSGYYPNWFQQKPGQAPRALIYSTSNKHSWTPARFSGSLLGGKAALTLSGVQPEDEAEYYCLLYYGGAQWVFGGGTKLTVL

SEQ ID NO: 409 - protein, 244 aa, Artificial Sequence
  A1-8
EVQLVESGGGLVQPGGSLRLSCAASGFTFSSYSMNWVRQAPGKGLEWVSYISSSSSTIYYADSVKGRFTISRDNAKNSLYLQMNSLRAEDTAVYYCARAKYYYMDVWGKGTTVTVSSGGGGSGGGGSGGGGSGGQSVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGWVFGGGTKLTVL

SEQ ID NO: 410 - protein, 248 aa, Artificial Sequence
  A1-7
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARDQVDKNTYYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 411 - protein, 243 aa, Artificial Sequence
  A1-6
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARACQLAEYFQHWGQGTLVTVSSGGGGSGGGGSGGGGSGGDIQMTQSPSSVSASVGDRVTITCRASQGISSWLAWYQQKPGKAPKLLIYAASSLQSGVPSRFSGSGSGTDFTLTISSLQPEDFATYYCQQANSFPLTFGGGTKVEIK

SEQ ID NO: 412 - protein, 248 aa, Artificial Sequence
  A1-5
QVQLQESGPGLVKPSQTLSLTCTVSGGSISSGGYYWSWIRQPPGKGLEWIGYIYYSGSTYYNPSLKSRVTISVDTSKNQFSLKLSSVTAADTAVYYCARDRVDKNTSYYYMDVWGKGTTVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 413 - protein, 245 aa, Artificial Sequence
  A1-4
QVQLQESGPGLVKPSDTLSLTCAVSGYSISSSNWWGWIRQPPGKGLEWIGYIYYSGSTYYNPSLKSRVTMSVDTSKNQFSLKLSSVTAVDTAVYYCARRVQLKLVHWFDPWGQGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 414 - protein, 245 aa, Artificial Sequence
  A1-3
QVQLVQSGAEVKKPGASVKVSCKASGYTFTSYDINWVRQATGQGLEWMGWMNPNSGNTGYAQKFQGRVTMTRNTSISTAYMELSSLRSEDTAVYYCATYYDYVTVFYFQHWGQGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 415 - protein, 245 aa, Artificial Sequence
  A1-2
QLQLQESGSGLVKPSQTLSLTCAVSGGSISSGGYSWSWIRQPPGKGLEWIGYIYHSGSTYYNPSLKSRVTISVDRSKNQFSLKLSSVTAADTAVYYCARESYPSFYAFDIWGQGTMVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 416 - protein, 249 aa, Artificial Sequence
  A1-1
QITLKESGPTLVKPTQTLTLTCTFSGFSLSTSGVGVGWIRQPPGKALEWLALIYWNDDKRYSPSLKSRLTITKDTSKNQVVLTMTNMDPVDTATYYCAHSNMWSYSLNDYYFDYWGQGTLVTVSSGGGGSGGGGSGGGGSGGDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 417 - protein, 11 aa, Artificial Sequence
  CDR-L1
RASQSISSYLN

SEQ ID NO: 418 - protein, 14 aa, Artificial Sequence
  CDR-L1
ASSTGAVTSGYYPN

SEQ ID NO: 419 - protein, 14 aa, Artificial Sequence
  CDR-L1
TGTSSDVGGYNYVS

SEQ ID NO: 420 - protein, 13 aa, Artificial Sequence
  CDR-L1
SGSSSNIGSNTVN

SEQ ID NO: 421 - protein, 11 aa, Artificial Sequence
  CDR-L1
RASENIYSNLA

SEQ ID NO: 422 - protein, 11 aa, Artificial Sequence
  CDR-L1
RASQGISSALA

SEQ ID NO: 423 - protein, 11 aa, Artificial Sequence
  CDR-L1
RASQGISSWLA

SEQ ID NO: 424 - protein, 7 aa, Artificial Sequence
  CDR-L2
AASSLQS

SEQ ID NO: 425 - protein, 7 aa, Artificial Sequence
  CDR-L2
STSNKHS

SEQ ID NO: 426 - protein, 7 aa, Artificial Sequence
  CDR-L2
EVSKRPS

SEQ ID NO: 427 - protein, 7 aa, Artificial Sequence
  CDR-L2
SNNQRPS

SEQ ID NO: 428 - protein, 7 aa, Artificial Sequence
  CDR-L2
AATYLPD

SEQ ID NO: 429 - protein, 7 aa, Artificial Sequence
  CDR-L2
DASSLES

SEQ ID NO: 430 - protein, 9 aa, Artificial Sequence
  CDR-L3
QQSYSTPLT

SEQ ID NO: 431 - protein, 10 aa, Artificial Sequence
  CDR-L3
LLYYGGAQWV

SEQ ID NO: 432 - protein, 10 aa, Artificial Sequence
  CDR-L3
SSYAGSNNWV

SEQ ID NO: 433 - protein, 11 aa, Artificial Sequence
  CDR-L3
AAWDDSLNGWV

SEQ ID NO: 434 - protein, 9 aa, Artificial Sequence
  CDR-L3
QHFWVTPYT

SEQ ID NO: 435 - protein, 9 aa, Artificial Sequence
  CDR-L3
QQFNSYPLT

SEQ ID NO: 436 - protein, 9 aa, Artificial Sequence
  CDR-L3
QQYNSYPLT

SEQ ID NO: 437 - protein, 9 aa, Artificial Sequence
  CDR-L3
QQANSFPLT

SEQ ID NO: 438 - protein, 5 aa, Artificial Sequence
  CDR-H1
SYGIS

SEQ ID NO: 439 - protein, 5 aa, Artificial Sequence
  CDR-H1
SYSMN

SEQ ID NO: 440 - protein, 7 aa, Artificial Sequence
  CDR-H1
SGSYYWS

SEQ ID NO: 441 - protein, 5 aa, Artificial Sequence
  CDR-H1
SYYWS

SEQ ID NO: 442 - protein, 5 aa, Artificial Sequence
  CDR-H1
SYWIG

SEQ ID NO: 443 - protein, 5 aa, Artificial Sequence
  CDR-H1
SNYMS

SEQ ID NO: 444 - protein, 7 aa, Artificial Sequence
  CDR-H1
SSSYYWG

SEQ ID NO: 445 - protein, 7 aa, Artificial Sequence
  CDR-H1
SGGYYWS

SEQ ID NO: 446 - protein, 6 aa, Artificial Sequence
  CDR-H1
SGYSWH

SEQ ID NO: 447 - protein, 7 aa, Artificial Sequence
  CDR-H1
TSGVGVG

SEQ ID NO: 448 - protein, 5 aa, Artificial Sequence
  CDR-H1
SYWMH

SEQ ID NO: 449 - protein, 5 aa, Artificial Sequence
  CDR-H1
SYDMH

SEQ ID NO: 450 - protein, 5 aa, Artificial Sequence
  CDR-H1
SYAMH

SEQ ID NO: 451 - protein, 5 aa, Artificial Sequence
  CDR-H1
SYAMS

SEQ ID NO: 452 - protein, 5 aa, Artificial Sequence
  CDR-H1
SYAMN

SEQ ID NO: 453 - protein, 5 aa, Artificial Sequence
  CDR-H1
DYYMS

SEQ ID NO: 454 - protein, 7 aa, Artificial Sequence
  CDR-H1
SNSAAWN

SEQ ID NO: 455 - protein, 5 aa, Artificial Sequence
  CDR-H1
DYYMH

SEQ ID NO: 456 - protein, 6 aa, Artificial Sequence
  CDR-H1
SSNWWG

SEQ ID NO: 457 - protein, 5 aa, Artificial Sequence
  CDR-H1
SYDIN

SEQ ID NO: 458 - protein, 7 aa, Artificial Sequence
  CDR-H1
SGGYSWS

SEQ ID NO: 459 - protein, 17 aa, Artificial Sequence
  CDR-H2
WISAYNGNTNYAQKLQG

SEQ ID NO: 460 - protein, 17 aa, Artificial Sequence
  CDR-H2
YISSSSSTIYYADSVKG

SEQ ID NO: 461 - protein, 16 aa, Artificial Sequence
  CDR-H2
YIYYSGSTNYNPSLKS

SEQ ID NO: 462 - protein, 17 aa, Artificial Sequence
  CDR-H2
IIYPGDSDTRYSPSFQG

SEQ ID NO: 463 - protein, 16 aa, Artificial Sequence
  CDR-H2
VIYSGGSTYYADSVKG

SEQ ID NO: 464 - protein, 16 aa, Artificial Sequence
  CDR-H2
SIYYSGSTYYNPSLKS

SEQ ID NO: 465 - protein, 16 aa, Artificial Sequence
  CDR-H2
YIYYSGSTYYNPSLKS

SEQ ID NO: 466 - protein, 16 aa, Artificial Sequence
  CDR-H2
YIHFSGSTHYHPSLKS

SEQ ID NO: 467 - protein, 16 aa, Artificial Sequence
  CDR-H2
LIYWNDDKRYSPSLKS

SEQ ID NO: 468 - protein, 17 aa, Artificial Sequence
  CDR-H2
RINSDGSSTSYADSVKG

SEQ ID NO: 469 - protein, 16 aa, Artificial Sequence
  CDR-H2
AIGTAGDTYYPGSVKG

SEQ ID NO: 470 - protein, 17 aa, Artificial Sequence
  CDR-H2
WINAGNGNTKYSQKFQG

SEQ ID NO: 471 - protein, 17 aa, Artificial Sequence
  CDR-H2
AISGSGGSTYYADSVKG

SEQ ID NO: 472 - protein, 17 aa, Artificial Sequence
  CDR-H2
WINTNTGNPTYAQGFTG

SEQ ID NO: 473 - protein, 17 aa, Artificial Sequence
  CDR-H2
YISSSGSTIYYADSVKG

SEQ ID NO: 474 - protein, 18 aa, Artificial Sequence
  CDR-H2
RTYYRSKWYNDYAVSVKS

SEQ ID NO: 475 - protein, 17 aa, Artificial Sequence
  CDR-H2
LVDPEDGETIYAEKFQG

SEQ ID NO: 476 - protein, 17 aa, Artificial Sequence
  CDR-H2
WMNPNSGNTGYAQKFQG

SEQ ID NO: 477 - protein, 16 aa, Artificial Sequence
  CDR-H2
YIYHSGSTYYNPSLKS

SEQ ID NO: 478 - protein, 11 aa, Artificial Sequence
  CDR-H3
ERVSQRGAFDI

SEQ ID NO: 479 - protein, 10 aa, Artificial Sequence
  CDR-H3
GNPDKDPFDY

SEQ ID NO: 480 - protein, 11 aa, Artificial Sequence
  CDR-H3
DFYCTNWYFDL

SEQ ID NO: 481 - protein, 12 aa, Artificial Sequence
  CDR-H3
ESSSGSYWYFDL

SEQ ID NO: 482 - protein, 17 aa, Artificial Sequence
  CDR-H3
DSGYKYNLYYYYYYMDV

SEQ ID NO: 483 - protein, 13 aa, Artificial Sequence
  CDR-H3
GGDLSHYYYYMDV

SEQ ID NO: 484 - protein, 13 aa, Artificial Sequence
  CDR-H3
ENRRYNSCYYFDY

SEQ ID NO: 485 - protein, 13 aa, Artificial Sequence
  CDR-H3
GGDLSHYYYYLDV

SEQ ID NO: 486 - protein, 13 aa, Artificial Sequence
  CDR-H3
ATLLSLSYDAFDI

SEQ ID NO: 487 - protein, 12 aa, Artificial Sequence
  CDR-H3
GGDLSHYYYMDV

SEQ ID NO: 488 - protein, 8 aa, Artificial Sequence
  CDR-H3
ERDRWFDP

SEQ ID NO: 489 - protein, 11 aa, Artificial Sequence
  CDR-H3
ETPPSLGAFDI

SEQ ID NO: 490 - protein, 14 aa, Artificial Sequence
  CDR-H3
EAYCLSDSYWYFDL

SEQ ID NO: 491 - protein, 14 aa, Artificial Sequence
  CDR-H3
ESWKYFYPRGYMDV

SEQ ID NO: 492 - protein, 11 aa, Artificial Sequence
  CDR-H3
GGVVSHYAMDC

SEQ ID NO: 493 - protein, 9 aa, Artificial Sequence
  CDR-H3
HYYYYYMDV

SEQ ID NO: 494 - protein, 9 aa, Artificial Sequence
  CDR-H3
KTTSFYFDY

SEQ ID NO: 495 - protein, 8 aa, Artificial Sequence
  CDR-H3
HYYYYMDV

SEQ ID NO: 496 - protein, 10 aa, Artificial Sequence
  CDR-H3
GVLLYNWFDP

SEQ ID NO: 497 - protein, 9 aa, Artificial Sequence
  CDR-H3
HYYYYYLDV

SEQ ID NO: 498 - protein, 11 aa, Artificial Sequence
  CDR-H3
DLPGSYWYFDL

SEQ ID NO: 499 - protein, 12 aa, Artificial Sequence
  CDR-H3
EGNGANPDAFDI

SEQ ID NO: 500 - protein, 10 aa, Artificial Sequence
  CDR-H3
RHMRLSCFDY

SEQ ID NO: 501 - protein, 9 aa, Artificial Sequence
  CDR-H3
HYYYYSMDV

SEQ ID NO: 502 - protein, 7 aa, Artificial Sequence
  CDR-H3
SFDWFDP

SEQ ID NO: 503 - protein, 14 aa, Artificial Sequence
  CDR-H3
ERSISPYYYYYMDV

SEQ ID NO: 504 - protein, 10 aa, Artificial Sequence
  CDR-H3
DSVIWYWFDP

SEQ ID NO: 505 - protein, 15 aa, Artificial Sequence
  CDR-H3
EEILPRLSYYYYMDV

SEQ ID NO: 506 - protein, 12 aa, Artificial Sequence
  CDR-H3
GGRAHSSWYFDL

SEQ ID NO: 507 - protein, 17 aa, Artificial Sequence
  CDR-H3
DRIKILPRLGYYYYMDV

SEQ ID NO: 508 - protein, 12 aa, Artificial Sequence
  CDR-H3
DTVIHYYYYMDV

SEQ ID NO: 509 - protein, 16 aa, Artificial Sequence
  CDR-H3
DVIVEVFLSYYYYMDV

SEQ ID NO: 510 - protein, 12 aa, Artificial Sequence
  CDR-H3
DIFIHYYYYMDV

SEQ ID NO: 511 - protein, 14 aa, Artificial Sequence
  CDR-H3
DGTFYSYSPYYFDY

SEQ ID NO: 512 - protein, 17 aa, Artificial Sequence
  CDR-H3
EWIKILPRLGYYYYMDV

SEQ ID NO: 513 - protein, 12 aa, Artificial Sequence
  CDR-H3
DRSLYYYYYMDV

SEQ ID NO: 514 - protein, 14 aa, Artificial Sequence
  CDR-H3
DKILAPNYYYYMDV

SEQ ID NO: 515 - protein, 16 aa, Artificial Sequence
  CDR-H3
EKSWKYFYYYYYYMDV

SEQ ID NO: 516 - protein, 15 aa, Artificial Sequence
  CDR-H3
ENTSTIPYYYYYMDV

SEQ ID NO: 517 - protein, 19 aa, Artificial Sequence
  CDR-H3
EDVDKNTSTIYYYYYYMDV

SEQ ID NO: 518 - protein, 17 aa, Artificial Sequence
  CDR-H3
DGGDIVSSSAIYWYFDL

SEQ ID NO: 519 - protein, 14 aa, Artificial Sequence
  CDR-H3
DLILPPYYYYYMDV

SEQ ID NO: 520 - protein, 19 aa, Artificial Sequence
  CDR-H3
ETWIKILPRYYYYYYYMDV

SEQ ID NO: 521 - protein, 12 aa, Artificial Sequence
  CDR-H3
DLSRYYYYYMDV

SEQ ID NO: 522 - protein, 9 aa, Artificial Sequence
  CDR-H3
EHIVLCFDY

SEQ ID NO: 523 - protein, 15 aa, Artificial Sequence
  CDR-H3
DKILPRPYYYYYMDV

SEQ ID NO: 524 - protein, 8 aa, Artificial Sequence
  CDR-H3
GSNEYFQH

SEQ ID NO: 525 - protein, 9 aa, Artificial Sequence
  CDR-H3
GTSYWYFDL

SEQ ID NO: 526 - protein, 14 aa, Artificial Sequence
  CDR-H3
EEIVEVFYYYYMDV

SEQ ID NO: 527 - protein, 8 aa, Artificial Sequence
  CDR-H3
VDDYYFDY

SEQ ID NO: 528 - protein, 14 aa, Artificial Sequence
  CDR-H3
STNILLSYTKAFDI

SEQ ID NO: 529 - protein, 12 aa, Artificial Sequence
  CDR-H3
DKTYYYYYYMDV

SEQ ID NO: 530 - protein, 19 aa, Artificial Sequence
  CDR-H3
EKYFHDKYFHDYYYYYMDV

SEQ ID NO: 531 - protein, 12 aa, Artificial Sequence
  CDR-H3
DTSVYYYYYMDV

SEQ ID NO: 532 - protein, 14 aa, Artificial Sequence
  CDR-H3
EKILPYYYYYYMDV

SEQ ID NO: 533 - protein, 21 aa, Artificial Sequence
  CDR-H3
QWIYIYINPRGFIFLHDAFDI

SEQ ID NO: 534 - protein, 12 aa, Artificial Sequence
  CDR-H3
EDVDFHHDAFDI

SEQ ID NO: 535 - protein, 19 aa, Artificial Sequence
  CDR-H3
EGVDKNTSTIYYYYYYMDV

SEQ ID NO: 536 - protein, 8 aa, Artificial Sequence
  CDR-H3
DRRGYFDL

SEQ ID NO: 537 - protein, 15 aa, Artificial Sequence
  CDR-H3
GIHVDIRSMEDWFDP

SEQ ID NO: 538 - protein, 12 aa, Artificial Sequence
  CDR-H3
DIGTSYYYYMDV

SEQ ID NO: 539 - protein, 15 aa, Artificial Sequence
  CDR-H3
EVVEVFLYYYYYMDV

SEQ ID NO: 540 - protein, 12 aa, Artificial Sequence
  CDR-H3
DLYYYYYYYMDV

SEQ ID NO: 541 - protein, 22 aa, Artificial Sequence
  CDR-H3
ESWKYFYPRGSIFIHYYYYMDV

SEQ ID NO: 542 - protein, 14 aa, Artificial Sequence
  CDR-H3
DRIVEVFYYYYMDV

SEQ ID NO: 543 - protein, 16 aa, Artificial Sequence
  CDR-H3
EKYFHDWLYYYYYMDV

SEQ ID NO: 544 - protein, 16 aa, Artificial Sequence
  CDR-H3
DLVDKNTSYYYYYMDV

SEQ ID NO: 545 - protein, 8 aa, Artificial Sequence
  CDR-H3
VQNEYFQH

SEQ ID NO: 546 - protein, 6 aa, Artificial Sequence
  CDR-H3
ANWFDP

SEQ ID NO: 547 - protein, 12 aa, Artificial Sequence
  CDR-H3
GGWTAWYYYMDV

SEQ ID NO: 548 - protein, 8 aa, Artificial Sequence
  CDR-H3
AKYYYMDV

SEQ ID NO: 549 - protein, 14 aa, Artificial Sequence
  CDR-H3
DQVDKNTYYYYMDV

SEQ ID NO: 550 - protein, 10 aa, Artificial Sequence
  CDR-H3
ACQLAEYFQH

SEQ ID NO: 551 - protein, 14 aa, Artificial Sequence
  CDR-H3
DRVDKNTSYYYMDV

SEQ ID NO: 552 - protein, 12 aa, Artificial Sequence
  CDR-H3
RVQLKLVHWFDP

SEQ ID NO: 553 - protein, 12 aa, Artificial Sequence
  CDR-H3
YYDYVTVFYFQH

SEQ ID NO: 554 - protein, 11 aa, Artificial Sequence
  CDR-H3
ESYPSFYAFDI

SEQ ID NO: 555 - protein, 15 aa, Artificial Sequence
  CDR-H3
SNMWSYSLNDYYFDY

SEQ ID NO: 556 - DNA, 3229 bp, Artificial Sequence
  LIRB1 coding sequence
aaatgagttttaaaaaggcttgtccaggaagcacatatgggagctggtcactctgcattttgggccctcctggaggtgtttagaccttccgagagagaaactgagacacatgagagggaagaaatgactcagtggtgagaccctgtggagtcccacccacaaccagcacactgtgacccactgcacaaacctctagcccacagctcacttcctcctttaagaagagaagagaaaagaggagaggagaggaggaacagaaaagaaaagaaaagaaaaagtgggaaacaaataatctaagaatgaggagaaagcaagaagagtgacccccttgtgggcactccattggttttatggcgcctctactttctggagtttgtgtaaaacaaaaatattatggtctttgtgcacatttacatcaagctcagcctgggcggcacagccagatgcgagatgcgtctctgctgatctgagtctgcctgcagcatggacctgggtcttccctgaagcatctccagggctggagggacgactgccatgcaccgagggctcatccatccacagagcagggcagtgggaggagacgccatgacccccatcctcacggtcctgatctgtctcgggctgagtctgggcccccggacccacgtgcaggcagggcacctccccaagcccaccctctgggctgaaccaggctctgtgatcacccaggggagtcctgtgaccctcaggtgtcaggggggccaggagacccaggagtaccgtctatatagagaaaagaaaacagcaccctggattacacggatcccacaggagcttgtgaagaagggccagttccccatcccatccatcacctgggaacacacagggcggtatcgctgttactatggtagcgacactgcaggccgctcagagagcagtgaccccctggagctggtggtgacaggagcctacatcaaacccaccctctcagcccagcccagccccgtggtgaactcaggagggaatgtaaccctccagtgtgactcacaggtggcatttgatggcttcattctgtgtaaggaaggagaagatgaacacccacaatgcctgaactcccagccccatgcccgtgggtcgtcccgcgccatcttctccgtgggccccgtgagcccgagtcgcaggtggtggtacaggtgctatgcttatgactcgaactctccctatgagtggtctctacccagtgatctcctggagctcctggtcctaggtgtttctaagaagccatcactctcagtgcagccaggtcctatcgtggcccctgaggagaccctgactctgcagtgtggctctgatgctggctacaacagatttgttctgtataaggacggggaacgtgacttccttcagctcgctggcgcacagccccaggctgggctctcccaggccaacttcaccctgggccctgtgagccgctcctacgggggccagtacagatgctacggtgcacacaacctctcctccgagtggtcggcccccagcgaccccctggacatcctgatcgcaggacagttctatgacagagtctccctctcggtgcagccgggccccacggtggcctcaggagagaacgtgaccctgctgtgtcagtcacagggatggatgcaaactttccttctgaccaaggagggggcagctgatgacccatggcgtctaagatcaacgtaccaatctcaaaaataccaggctgaattccccatgggtcctgtgacctcagcccatgcggggacctacaggtgctacggctcacagagctccaaaccctacctgctgactcaccccagtgaccccctggagctcgtggtctcaggaccgtctgggggccccagctccccgacaacaggccccacctccacatctggccctgaggaccagcccctcacccccaccgggtcggatccccagagtggtctgggaaggcacctgggggttgtgatcggcatcttggtggccgtcatcctactgctcctcctcctcctcctcctcttcctcatcctccgacatcgacgtcagggcaaacactggacatcgacccagagaaaggctgatttccaacatcctgcaggggctgtggggccagagcccacagacagaggcctgcagtggaggtccagcccagctgccgatgcccaggaagaaaacctctatgctgccgtgaagcacacacagcctgaggatggggtggagatggacactcggagcccacacgatgaagacccccaggcagtgacgtatgccgaggtgaaacactccagacctaggagagaaatggcctctcctccttccccactgtctggggaattcctggacacaaaggacagacaggcggaagaggacaggcagatggacactgaggctgctgcatctgaagccccccaggatgtgacctacgcccagctgcacagcttgaccctcagacgggaggcaactgagcctcctccatcccaggaagggccctctccagctgtgcccagcatctacgccactctggccatccactagcccagggggggacgcagaccccacactccatggagtctggaatgcatgggagctgcccccccagtggacaccattggaccccacccagcctggatctaccccaggagactctgggaacttttaggggtcactcaattctgcagtataaataactaatgtctctacaattttgaaataaagcaacagacttctcaataatcaatgaagtagctgagaaaactaagtcagaaagtgcattaaactgaatcacaatgtaaatattacacatcaagcgatgaaactggaaaactacaagccacgaatgaatgaattaggaaagaaaaaaagtaggaaatgaatgatcttggctttcctataagaaatttagggcagggcacggtggctcacgcctgtaattccagcactttgggaggccgaggcgggcagatcacgagttcaggagatcgagaccatcttggccaacatggtgaaaccctgtctctcctaaaaatacaaaaattagctggatgtggtggcagtgcctgtaatcccagctatttgggaggctgaggcaggagaatcgcttgaaccagggagtcagaggtttcagtgagccaagatcgcaccactgctctccagcctggcgacagagggagactccatctcaaattaaaaaaaaaaaaaaaaaagaaagaaaaaaaaaaaaaaaaaa

SEQ ID NO: 557 - protein, 21 aa, Artificial Sequence
  T2A self-cleaving peptide
GSGEGRGSLLTCGDVEENPGP

SEQ ID NO: 558 - DNA, 63 bp, Artificial Sequence
  T2A self-cleaving peptide
ggatccggagagggcagaggcagcctgctgacatgtggcgacgtggaagagaaccctggcccc

SEQ ID NO: 559 - DNA, 369 bp, Artificial Sequence
  CT292 VH
gaggttcagctggtggagtctggcggtggcctggtgcagccagggggctcactccgtttgtcctgtgcagcttctggcttcaacattaaagacacctatatacactgggtgcgtcaggccccgggtaagggcctggaatgggttgcaaggatttatcctacgaatggttatactagatatgccgatagcgtcaagggccgtttcactataagcgcagacacatccaaaaacacagcctacctgcagatgaacagcctgcgtgctgaggacactgccgtctattattgttctagatggggaggggacggcttctatgctatggacgtgtggggtcaaggaaccctggtcaccgtttcctcggcggccgca

SEQ ID NO: 560 - DNA, 327 bp, Artificial Sequence
  CT292 VL
gatatccagatgacccagtccccgagctccctgtccgcctctgtgggcgatagggtcaccatcacctgccgtgccagtcaggatgtgaatactgctgtagcctggtatcaacagaaaccaggaaaagctccgaaactactgatttactcggcatccttcctttattctggagtcccttctcgcttctctggatctagatctgggacggatttcactctgaccatcagcagtctgcagccggaagacttcgcaacttattactgtcagcaacattatactactcctcccacgttcggacagggtaccaaggtggagatcaaacgcact

SEQ ID NO: 561 - protein, 28 aa, Artificial Sequence
  CD TM domain
IYIWAPLAGTCGVLLLSLVITLYCNHRN

SEQ ID NO: 562 - DNA, 84 bp, Artificial Sequence
  CD TM domain
atctacatctgggcgcccttggccgggacttgtggggtccttctcctgtcactggttatcaccctttactgcaaccacaggaac

SEQ ID NO: 563 - protein, 15 aa, Artificial Sequence
  Linker
GSTSGSGKPGSGEGS

SEQ ID NO: 564 - DNA, 45 bp, Artificial Sequence
  Linker
gggtctacatctggatctgggaagccgggttctggtgagggttct

SEQ ID NO: 565 - protein, 7 aa, Artificial Sequence
  CDR L2
KVSNRFS

SEQ ID NO: 566 - protein, 5 aa, Artificial Sequence
  CDR H1
SYHIH

SEQ ID NO: 567 - protein, 17 aa, Artificial Sequence
  CDR H2
WIYPGNVNTEYNEKFKG

SEQ ID NO: 568 - DNA, 189 bp, Artificial Sequence
  LILRB1 hinge domain
tacggctcacagagctccaaaccctacctgctgactcaccctagtgatcctctggagctcgtggtctcaggaccgtctggaggcccaagctctccgacaacaggccccacctccacatctggccctgaggaccagcccctcacacccaccgggtcggatcctcagagtggtctgggaagacacctggga

SEQ ID NO: 569 - DNA, 69 bp, Artificial Sequence
  LILRB1 transmembrane domain
gttgtgatcggcatcttggtggccgtcatcctactgctcctcctcctgctcctgctcttcctcatcctc

SEQ ID NO: 570 - DNA, 501 bp, Artificial Sequence
  LILRB1 intracellular domain
cgacatcgacgtcagggcaaacactggacatcgacccagagaaaggctgatttccaacatcctgcaggggctgtggggccagagcccacagacagaggcctgcagtggaggtccagcccagctgccgatgcccaggaagaaaacctctatgctgccgtgaagcacacacagcctgaggatggggtggagatggatactcggagcccacacgatgaagatccacaggcagtgacgtatgccgaggtgaaacactccagacctagaagggaaatggcctctcctccttccccactgtctggagagttcctggacacaaaggacagacaggcggaagaggacaggcagatggacactgaggctgctgcatctgaagctcctcaggatgtgacctacgcccagctgcacagcttgaccctcagacgggaggcaactgagcctcctccatcccaggaagggccctctccagctgtgcccagcatctacgccactctggccatccac

SEQ ID NO: 571 - RNA, 943 nt, Homo sapiens
auuccugaagcugacagcauucgggccgagaugucucgcuccguggccuuagcugugcucgcgcuacucucucuuucuggccuggaggcuauccagcguacuccaaagauucagguuuacucacgucauccagcagagaauggaaagucaaauuuccugaauugcuaugugucuggguuucauccauccgacauugaaguugacuuacugaagaauggagagagaauugaaaaaguggagcauucagacuugucuuucagcaaggacuggucuuucuaucucuuguacuacacugaauucacccccacugaaaaagaugaguaugccugccgugugaaccaugugacuuugucacagcccaagauaguuaagugggaucgagacauguaagcagcaucauggagguuugaagaugccgcauuuggauuggaugaauuccaaauucugcuugcuugcuuuuuaauauugauaugcuuauacacuuacacuuuaugcacaaaauguaggguuauaauaauguuaacauggacaugaucuucuuuauaauucuacuuugagugcugucuccauguuugauguaucugagcagguugcuccacagguagcucuaggagggcuggcaacuuagagguggggagcagagaauucucuuauccaacaucaacaucuuggucagauuugaacucuucaaucucuugcacucaaagcuuguuaagauaguuaagcgugcauaaguuaacuuccaauuuacauacucugcuuagaauuugggggaaaauuuagaaauauaauugacaggauuauuggaaauuuguuauaaugaaugaaacauuuugucauauaagauucauauuuacuucuuauacauuugauaaaguaaggcaugguugugguuaaucugguuuauuuuuguuccacaaguuaaauaaaucauaaaacuuga

SEQ ID NO: 572 - DNA, 6654 bp, Homo sapiens
aagtggaggcgtcgcgctggcgggcattcctgaagctgacagcattcgggccgagatgtctcgctccgtggccttagctgtgctcgcgctactctctctttctggcctggaggctatccagcgtgagtctctcctaccctcccgctctggtccttcctctcccgctctgcaccctctgtggccctcgctgtgctctctcgctccgtgacttcccttctccaagttctccttggtggcccgccgtggggctagtccagggctggatctcggggaagcggcggggtggcctgggagtggggaagggggtgcgcacccgggacgcgcgctacttgcccctttcggcggggagcaggggagacctttggcctacggcgacgggagggtcgggacaaagtttagggcgtcgataagcgtcagagcgccgaggttgggggagggtttctcttccgctctttcgcggggcctctggctcccccagcgcagctggagtgggggacgggtaggctcgtcccaaaggcgcggcgctgaggtttgtgaacgcgtggaggggcgcttggggtctgggggaggcgtcgcccgggtaagcctgtctgctgcggctctgcttcccttagactggagagctgtggacttcgtctaggcgcccgctaagttcgcatgtcctagcacctctgggtctatgtggggccacaccgtggggaggaaacagcacgcgacgtttgtagaatgcttggctgtgatacaaagcggtttcgaataattaacttatttgttcccatcacatgtcacttttaaaaaattataagaactacccgttattgacatctttctgtgtgccaaggactttatgtgctttgcgtcatttaattttgaaaacagttatcttccgccatagataactactatggttatcttctgcctctcacagatgaagaaactaaggcaccgagattttaagaaacttaattacacaggggataaatggcagcaatcgagattgaagtcaagcctaaccagggcttttgcgggagcgcatgccttttggctgtaattcgtgcatttttttttaagaaaaacgcctgccttctgcgtgagattctccagagcaaactgggcggcatgggccctgtggtcttttcgtacagagggcttcctctttggctctttgcctggttgtttccaagatgtactgtgcctcttactttcggttttgaaaacatgagggggttgggcgtggtagcttacgcctgtaatcccagcacttagggaggccgaggcgggaggatggcttgaggtccgtagttgagaccagcctggccaacatggtgaagcctggtctctacaaaaaataataacaaaaattagccgggtgtggtggctcgtgcctgtggtcccagctgctccggtggctgaggcgggaggatctcttgagcttaggcttttgagctatcatggcgccagtgcactccagcgtgggcaacagagcgagaccctgtctctcaaaaaagaaaaaaaaaaaaaaagaaagagaaaagaaaagaaagaaagaagtgaaggtttgtcagtcaggggagctgtaaaaccattaataaagataatccaagatggttaccaagactgttgaggacgccagagatcttgagcactttctaagtacctggcaatacactaagcgcgctcaccttttcctctggcaaaacatgatcgaaagcagaatgttttgatcatgagaaaattgcatttaatttgaatacaatttatttacaacataaaggataatgtatatatcaccaccattactggtatttgctggttatgttagatgtcattttaaaaaataacaatctgatatttaaaaaaaaatcttattttgaaaatttccaaagtaatacatgccatgcatagaccatttctggaagataccacaagaaacatgtaatgatgattgcctctgaaggtctattttcctcctctgacctgtgtgtgggttttgtttttgttttactgtgggcataaattaatttttcagttaagttttggaagcttaaataactctccaaaagtcataaagccagtaactggttgagcccaaattcaaacccagcctgtctgatacttgtcctcttcttagaaaagattacagtgatgctctcacaaaatcttgccgccttccctcaaacagagagttccaggcaggatgaatctgtgctctgatccctgaggcatttaatatgttcttattattagaagctcagatgcaaagagctctcttagcttttaatgttatgaaaaaaatcaggtcttcattagattccccaatccacctcttgatggggctagtagcctttccttaatgatagggtgtttctagagagatatatctggtcaaggtggcctggtactcctccttctccccacagcctcccagacaaggaggagtagctgccttttagtgatcatgtaccctgaatataagtgtatttaaaagaattttatacacatatatttagtgtcaatctgtatatttagtagcactaacacttctcttcattttcaatgaaaaatatagagtttataatattttcttcccacttccccatggatggtctagtcatgcctctcattttggaaagtactgtttctgaaacattaggcaatatattcccaacctggctagtttacagcaatcacctgtggatgctaattaaaacgcaaatcccactgtcacatgcattactccatttgatcataatggaaagtatgttctgtcccatttgccatagtcctcacctatccctgttgtattttatcgggtccaactcaaccatttaaggtatttgccagctcttgtatgcatttaggttttgtttctttgttttttagctcatgaaattaggtacaaagtcagagaggggtctggcatataaaacctcagcagaaataaagaggttttgttgtttggtaagaacataccttgggttggttgggcacggtggctcgtgcctgtaatcccaacactttgggaggccaaggcaggctgatcacttgaagttgggagttcaagaccagcctggccaacatggtgaaatcccgtctctactgaaaatacaaaaattaaccaggcatggtggtgtgtgcctgtagtcccaggaatcacttgaacccaggaggcggaggttgcagtgagctgagatctcaccactgcacactgcactccagcctgggcaatggaatgagattccatcccaaaaaataaaaaaataaaaaaataaagaacataccttgggttgatccacttaggaacctcagataataacatctgccacgtatagagcaattgctatgtcccaggcactctactagacacttcatacagtttagaaaatcagatgggtgtagatcaaggcaggagcaggaaccaaaaagaaaggcataaacataagaaaaaaaatggaaggggtggaaacagagtacaataacatgagtaatttgatgggggctattatgaactgagaaatgaactttgaaaagtatcttggggccaaatcatgtagactcttgagtgatgtgttaaggaatgctatgagtgctgagagggcatcagaagtccttgagagcctccagagaaaggctcttaaaaatgcagcgcaatctccagtgacagaagatactgctagaaatctgctagaaaaaaaacaaaaaaggcatgtatagaggaattatgagggaaagataccaagtcacggtttattcttcaaaatggaggtggcttgttgggaaggtggaagctcatttggccagagtggaaatggaattgggagaaatcgatgaccaaatgtaaacacttggtgcctgatatagcttgacaccaagttagccccaagtgaaataccctggcaatattaatgtgtcttttcccgatattcctcaggtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtggggtaagtcttacattcttttgtaagctgctgaaagttgtgtatgagtagtcatatcataaagctgctttgatataaaaaaggtctatggccatactaccctgaatgagtcccatcccatctgatataaacaatctgcatattgggattgtcagggaatgttcttaaagatcagattagtggcacctgctgagatactgatgcacagcatggtttctgaaccagtagtttccctgcagttgagcagggagcagcagcagcacttgcacaaatacatatacactcttaacacttcttacctactggcttcctctagcttttgtggcagcttcaggtatatttagcactgaacgaacatctcaagaaggtataggcctttgtttgtaagtcctgctgtcctagcatcctataatcctggacttctccagtactttctggctggattggtatctgaggctagtaggaagggcttgttcctgctgggtagctctaaacaatgtattcatgggtaggaacagcagcctattctgccagccttatttctaaccattttagacatttgttagtacatggtattttaaaagtaaaacttaatgtcttccttttttttctccactgtctttttcatagatcgagacatgtaagcagcatcatggaggtaagtttttgaccttgagaaaatgtttttgtttcactgtcctgaggactatttatagacagctctaacatgataaccctcactatgtggagaacattgacagagtaacattttagcagggaaagaagaatcctacagggtcatgttcccttctcctgtggagtggcatgaagaaggtgtatggccccaggtatggccatattactgaccctctacagagagggcaaaggaactgccagtatggtattgcaggataaaggcaggtggttacccacattacctgcaaggctttgatctttcttctgccatttccacattggacatctctgctgaggagagaaaatgaaccactcttttcctttgtataatgttgttttattcttcagacagaagagaggagttatacagctctgcagacatcccattcctgtatggggactgtgtttgcctcttagaggttcccaggccactagaggagataaagggaaacagattgttataacttgatataatgatactataatagatgtaactacaaggagctccagaagcaagagagagggaggaacttggacttctctgcatctttagttggagtccaaaggcttttcaatgaaattctactgcccagggtacattgatgctgaaaccccattcaaatctcctgttatattctagaacagggaattgatttgggagagcatcaggaaggtggatgatctgcccagtcacactgttagtaaattgtagagccaggacctgaactctaatatagtcatgtgttacttaatgacggggacatgttctgagaaatgcttacacaaacctaggtgttgtagcctactacacgcataggctacatggtatagcctattgctcctagactacaaacctgtacagcctgttactgtactgaatactgtgggcagttgtaacacaatggtaagtatttgtgtatctaaacatagaagttgcagtaaaaatatgctattttaatcttatgagaccactgtcatatatacagtccatcattgaccaaaacatcatatcagcattttttcttctaagattttgggagcaccaaagggatacactaacaggatatactctttataatgggtttggagaactgtctgcagctacttcttttaaaaaggtgatctacacagtagaaattagacaagtttggtaatgagatctgcaatccaaataaaataaattcattgctaacctttttcttttcttttcaggtttgaagatgccgcatttggattggatgaattccaaattctgcttgcttgctttttaatattgatatgcttatacacttacactttatgcacaaaatgtagggttataataatgttaacatggacatgatcttctttataattctactttgagtgctgtctccatgtttgatgtatctgagcaggttgctccacaggtagctctaggagggctggcaacttagaggtggggagcagagaattctcttatccaacatcaacatcttggtcagatttgaactcttcaatctcttgcactcaaagcttgttaagatagttaagcgtgcataagttaacttccaatttacatactctgcttagaatttgggggaaaatttagaaatataattgacaggattattggaaatttgttataatgaatgaaacattttgtcatataagattcatatttacttcttatacatttgataaagtaaggcatggttgtggttaatctggtttatttttgttccacaagttaaataaatcataaaacttga

SEQ ID NO: 573 - DNA, 1698 bp, Artificial Sequence
  HLA-A*02:01:01:01 sequence encoding mRNA
cagaagcagaggggtcagggcgaagtcccagggccccaggcgtggctctcagggtctcaggccccgaaggcggtgtatggattggggagtcccagccttggggattccccaactccgcagtttcttttctccctctcccaacctatgtagggtccttcttcctggatactcacgacgcggacccagttctcactcccattgggtgtcgggtttccagagaagccaatcagtgtcgtcgcggtcgcggttctaaagtccgcacgcacccaccgggactcagattctccccagacgccgaggatggccgtcatggcgccccgaaccctcgtcctgctactctcgggggctctggccctgacccagacctgggcgggctctcactccatgaggtatttcttcacatccgtgtcccggcccggccgcggggagccccgcttcatcgcagtgggctacgtggacgacacgcagttcgtgcggttcgacagcgacgccgcgagccagaggatggagccgcgggcgccgtggatagagcaggagggtccggagtattgggacggggagacacggaaagtgaaggcccactcacagactcaccgagtggacctggggaccctgcgcggctactacaaccagagcgaggccggttctcacaccgtccagaggatgtatggctgcgacgtggggtcggactggcgcttcctccgcgggtaccaccagtacgcctacgacggcaaggattacatcgccctgaaagaggacctgcgctcttggaccgcggcggacatggcagctcagaccaccaagcacaagtgggaggcggcccatgtggcggagcagttgagagcctacctggagggcacgtgcgtggagtggctccgcagatacctggagaacgggaaggagacgctgcagcgcacggacgcccccaaaacgcatatgactcaccacgctgtctctgaccatgaagccaccctgaggtgctgggccctgagcttctaccctgcggagatcacactgacctggcagcgggatggggaggaccagacccaggacacggagctcgtggagaccaggcctgcaggggatggaaccttccagaagtgggcggctgtggtggtgccttctggacaggagcagagatacacctgccatgtgcagcatgagggtttgcccaagcccctcaccctgagatgggagccgtcttcccagcccaccatccccatcgtgggcatcattgctggcctggttctctttggagctgtgatcactggagctgtggtcgctgctgtgatgtggaggaggaagagctcagatagaaaaggagggagctactctcaggctgcaagcagtgacagtgcccagggctctgatgtgtctctcacagcttgtaaagtgtgagacagctgccttgtgtgggactgagaggcaagagttgttcctgcccttccctttgtgacttgaagaaccctgactttgtttctgcaaaggcacctgcatgtgtctgtgttcgtgtaggcataatgtgaggaggtggggagaccaccccacccccatgtccaccatgaccctcttcccacgctgacctgtgctccctccccaatcatctttcctgttccagagaggtggggctgaggtgtctccatctctgtctcaacttcatggtgcactgagctgtaacttcttccttccctattaaaa

SEQ ID NO: 574 - DNA, 3217 bp, Artificial Sequence
  HLA-A*02 (GenBank: LK021978.1)
atggccgtcatggcgccccgaaccctcgtcctgctactctcgggggctctggccctgacccagacctgggcgggtgagtgcggggtcgggagggaaacggcctctgtggggagaagcaacgggcccgcctggcgggggcgcaggacccgggaagccgcgccgggaggagggtcgggcgggtctcagccactcctcgtccccaggctctcactccatgaggtatttcttcacatccgtgtcccggcccggccgcggggagccccgcttcatcgcagtgggctacgtggacgacacgcagttcgtgcggttcgacagcgacgccgcgagccagaggatggagccgcgggcgccgtggatagagcaggagggtccggagtattgggacggggagacacggaaagtgaaggcccactcacagactcaccgagtggacctggggaccctgcgcggctactacaaccagagcgaggccggtgagtgaccccggcccggggcgcaggtcacgacctctcatcccccacggacgggccaggtcgcccacagtctccgggtccgagatccgccccgaagccgcgggaccccgagacccttgccccgggagaggcccaggcgcctttacccggtttcattttcagtttaggccaaaaatccccccaggttggtcggggcggggcggggctcgggggaccgggctgaccgcggggtccgggccaggttctcacaccgtccagaggatgtatggctgcgacgtggggtcggactggcgcttcctccgcgggtaccaccagtacgcctacgacggcaaggattacatcgccctgaaagaggacctgcgctctttgaccgcggcggacatggcagctcagaccaccaagcacaagtgggaggcggcccatgtggcggagcagttgagagcctacctggagggcacgtgcgtggagtggctccgcagatacctggagaacgggaaggagacgctgcagcgcacgggtaccaggggccacggggcgcctccctgatcgcctgtagatctcccgggctggcctcccacaaggaggggagacaattgggaccaacactagaatatcgccctccctctggtcctgagggagaggaatcctcctgggtttccagatcctgtaccagagagtgactctgaggttccgccctgctctctgacacaattaagggataaaatctctgaaggaatgacgggaagacgatccctcgaatactgatgagtggttccctttgacacacacaggcagcagccttgggcccgtgacttttcctctcaggccttgttctctgcttcacactcaatgtgtgtgggggtctgagtccagcacttctgagtccttcagcctccactcaggtcaggaccagaagtcgctgttccctcttcagggactagaattttccacggaataggagattatcccaggtgcctgtgtccaggctggtgtctgggttctgtgctcccttccccatcccaggtgtcctgtccattctcaagatagccacatgtgtgctggaggagtgtcccatgacagatgcaaaatgcctgaatgatctgactcttcctgacagacgcccccaaaacgcatatgactcaccacgctgtctctgaccatgaagccaccctgaggtgctgggccctgagcttctaccctgcggagatcacactgacctggcagcgggatggggaggaccagacccaggacacggagctcgtggagaccaggcctgcaggggatggaaccttccagaagtgggcggctgtggtggtgccttctggacaggagcagagatacacctgccatgtgcagcatgagggtttgcccaagcccctcaccctgagatggggtaaggagggagacgggggtgtcatgtcttttagggaaagcaggagcctctctgacctttagcagggtcagggcccctcaccttcccctcttttcccagagccgtcttcccagcccaccatccccatcgtgggcatcattgctggcctggttctctttggagctgtgatcactggagctgtggtcgctgctgtgatgtggaggaggaagagctcaggtggggaaggggtgaagggtgggtctgagatttcttgtctcactgagggttccaagacccaggtagaagtgtgccctgcctcgttactgggaagcaccacccacaattatgggcctacccagcctgggccctgtgtgccagcacttactcttttgtaaagcacctgttaaaatgaaggacagatttatcaccttgattacagcggtgatgggacctgatcccagcagtcacaagtcacaggggaaggtccctgaggaccttcaggagggcggttggtccaggacccacacctgctttcttcatgtttcctgatcccgccctgggtctgcagtcacacatttctggaaacttctctgaggtccaagacttggaggttcctctaggaccttaaggccctgactcctttctggtatctcacaggacattttcttcccacagatagaaaaggagggagctactctcaggctgcaagtaagtatgaaggaggctgatgcctgaggtccttgggatattgtgtttgggagcccatgggggagctcacccaccccacaattcctcctctagccacatcttctgtgggatctgaccaggttctgtttttgttctaccccaggcagtgacagtgcccagggctctgatgtgtctctcacagcttgtaaaggtgagagcctggagggcctgatgtgtgttgggtgttgggcggaacagtggacacagctgtgctatggggtttctttccattggatgtattgagcatgcgatgggctgtttaaagtgtgacccctcactgtgacagatacgaatttgttcatgaatatttttttctatagtgtgagacagctgccttgtgtgggactgagaggcaagagttgttcctgcccttccctttgtgacttgaagaaccctgactttgtttctgcaaaggcacctgcatgtgtctgtgttcgtgtaggcataatgtgaggaggtggggagaccaccccacccccatgtccaccatgaccctcttcccacgctgacctgtgctccctccccaatcatctttcctgttccagagaggtggggctgaggtgtctccatctctgtctcaacttcatggtgcactgagctgtaacttcttccttccctattaaaa

SEQ ID NO: 575 - DNA, 83 bp, Artificial Sequence
  CRISPR Cas9 scaffold sequence
gttttagagctagaaatagcaagttaaaataaggctagtccgttatcaacttgaaaaagtggcaccgagtcggtgcttttttt

SEQ ID NO: 576 - DNA, 20 bp, Artificial Sequence
  HLA-A targeting gRNA
tggacgacacgcagttcgtg

SEQ ID NO: 577 - DNA, 20 bp, Artificial Sequence
  HLA-A targeting gRNA
cagatacctggagaacggga

SEQ ID NO: 578 - DNA, 20 bp, Artificial Sequence
  HLA-A targeting gRNA
tcccgttctccaggtatctg

SEQ ID NO: 579 - DNA, 20 bp, Artificial Sequence
  HLA-A targeting gRNA
ccgccgcggtccaagagcgc

SEQ ID NO: 580 - DNA, 20 bp, Artificial Sequence
  HLA-A targeting gRNA
cctgcgctcttggaccgcgg

SEQ ID NO: 581 - DNA, 21 bp, Artificial Sequence
  HLA-A targeting gRNA
ggacctgcgctcttggaccgc

SEQ ID NO: 582 - DNA, 23 bp, Artificial Sequence
  HLA-A targeting gRNA
aaggagacgctgcagcgcacggg

SEQ ID NO: 583 - DNA, 23 bp, Artificial Sequence
  HLA-A targeting gRNA
gaaggagacgctgcagcgcacgg

SEQ ID NO: 584 - DNA, 23 bp, Artificial Sequence
  HLA-A targeting gRNA
gcgggcgccgtggatagagcagg

SEQ ID NO: 585 - DNA, 23 bp, Artificial Sequence
  HLA-A targeting gRNA
tgctctatccacggcgcccgcgg

SEQ ID NO: 586 - DNA, 23 bp, Artificial Sequence
  HLA-A targeting gRNA
cgatgaagcggggctccccgcgg

SEQ ID NO: 587 - DNA, 23 bp, Artificial Sequence
  HLA-A targeting gRNA
cgtgtcccggcccggccgcgggg

SEQ ID NO: 588 - DNA, 23 bp, Artificial Sequence
  HLA-A targeting gRNA
cggctccatcctctggctcgcgg

SEQ ID NO: 589 - DNA, 23 bp, Artificial Sequence
  HLA-A targeting gRNA
gatgtaatccttgccgtcgtagg

SEQ ID NO: 590 - DNA, 23 bp, Artificial Sequence
  HLA-A targeting gRNA
acagcgacgccgcgagccagagg

SEQ ID NO: 591 - DNA, 23 bp, Artificial Sequence
  HLA-A targeting gRNA
ggatggagccgcgggcgccgtgg

SEQ ID NO: 592 - DNA, 23 bp, Artificial Sequence
  HLA-A targeting gRNA
ggcgccgtggatagagcaggagg

SEQ ID NO: 593 - DNA, 23 bp, Artificial Sequence
  HLA-A targeting gRNA
gcgccgtggatagagcaggaggg

SEQ ID NO: 594 - DNA, 23 bp, Artificial Sequence
  HLA-A targeting gRNA
cggctactacaaccagagcgagg

SEQ ID NO: 595 - DNA, 23 bp, Artificial Sequence
  HLA-A targeting gRNA
ctggttgtagtagccgcgcaggg

SEQ ID NO: 596 - DNA, 23 bp, Artificial Sequence
  HLA-A targeting gRNA
tactacaaccagagcgaggccgg

SEQ ID NO: 597 - DNA, 23 bp, Artificial Sequence
  HLA-A targeting gRNA
ctacctggagggcacgtgcgtgg

SEQ ID NO: 598 - DNA, 23 bp, Artificial Sequence
  HLA-A targeting gRNA
cacgcacgtgccctccaggtagg

SEQ ID NO: 599 - DNA, 23 bp, Artificial Sequence
  HLA-A targeting gRNA
gcagggtccccaggtccactcgg

SEQ ID NO: 600 - DNA, 23 bp, Artificial Sequence
  HLA-A targeting gRNA
gtggacctggggaccctgcgcgg

SEQ ID NO: 601 - DNA, 23 bp, Artificial Sequence
  HLA-A targeting gRNA
tggagggcacgtgcgtggagtgg

SEQ ID NO: 602 - DNA, 23 bp, Artificial Sequence
  HLA-A targeting gRNA
gtatggctgcgacgtggggtcgg

SEQ ID NO: 603 - DNA, 23 bp, Artificial Sequence
  HLA-A targeting gRNA
ctgagctgccatgtccgccgcgg

SEQ ID NO: 604 - DNA, 23 bp, Artificial Sequence
  HLA-A targeting gRNA
ggattacatcgccctgaaagagg

SEQ ID NO: 605 - DNA, 23 bp, Artificial Sequence
  HLA-A targeting gRNA
caagtgggaggcggcccatgtgg

SEQ ID NO: 606 - DNA, 23 bp, Artificial Sequence
  HLA-A targeting gRNA
gtgggaggcggcccatgtggcgg

SEQ ID NO: 607 - DNA, 23 bp, Artificial Sequence
  HLA-A targeting gRNA
cagttgagagcctacctggaggg

SEQ ID NO: 608 - DNA, 23 bp, Artificial Sequence
  HLA-A targeting gRNA
gcagttgagagcctacctggagg

SEQ ID NO: 609 - DNA, 23 bp, Artificial Sequence
  HLA-A targeting gRNA
taccaccagtacgcctacgacgg

SEQ ID NO: 610 - DNA, 23 bp, Artificial Sequence
  HLA-A targeting gRNA
tgccgtcgtaggcgtactggtgg

SEQ ID NO: 611 - DNA, 23 bp, Artificial Sequence
  HLA-A targeting gRNA
ccagtacgcctacgacggcaagg

SEQ ID NO: 612 - DNA, 23 bp, Artificial Sequence
  HLA-A targeting gRNA
ggatgtgaagaaatacctcatgg

SEQ ID NO: 613 - DNA, 23 bp, Artificial Sequence
  HLA-A targeting gRNA
atttcttcacatccgtgtcccgg

SEQ ID NO: 614 - DNA, 23 bp, Artificial Sequence
  HLA-A targeting gRNA
aggcgtactggtggtacccgcgg

SEQ ID NO: 615 - DNA, 23 bp, Artificial Sequence
  HLA-A targeting gRNA
cgtactggtggtacccgcggagg

SEQ ID NO: 616 - DNA, 23 bp, Artificial Sequence
  HLA-A targeting gRNA
gaggatgtatggctgcgacgtgg

SEQ ID NO: 617 - DNA, 23 bp, Artificial Sequence
  HLA-A targeting gRNA
ggatgtatggctgcgacgtgggg

SEQ ID NO: 618 - DNA, 23 bp, Artificial Sequence
  HLA-A targeting gRNA
ctcagaccaccaagcacaagtgg

SEQ ID NO: 619 - DNA, 23 bp, Artificial Sequence
  HLA-A targeting gRNA
tcagaccaccaagcacaagtggg

SEQ ID NO: 620 - DNA, 23 bp, Artificial Sequence
  HLA-A targeting gRNA
caccaagcacaagtgggaggcgg

SEQ ID NO: 621 - DNA, 23 bp, Artificial Sequence
  HLA-A targeting gRNA
gaccaccaagcacaagtgggagg

SEQ ID NO: 622 - DNA, 23 bp, Artificial Sequence
  HLA-A targeting gRNA
gagccccgcttcatcgcagtggg

SEQ ID NO: 623 - DNA, 23 bp, Artificial Sequence
  HLA-A targeting gRNA
gtagcccactgcgatgaagcggg

SEQ ID NO: 624 - DNA, 23 bp, Artificial Sequence
  HLA-A targeting gRNA
tagcccactgcgatgaagcgggg

SEQ ID NO: 625 - DNA, 23 bp, Artificial Sequence
  HLA-A targeting gRNA
cgtagcccactgcgatgaagcgg

SEQ ID NO: 626 - DNA, 23 bp, Artificial Sequence
  HLA-A targeting gRNA
cttcatcgcagtgggctacgtgg

SEQ ID NO: 627 - DNA, 23 bp, Artificial Sequence
  HLA-A targeting gRNA
ggagccccgcttcatcgcagtgg

SEQ ID NO: 628 - DNA, 23 bp, Artificial Sequence
  HLA-A targeting gRNA
cggggagacacggaaagtgaagg

SEQ ID NO: 629 - DNA, 23 bp, Artificial Sequence
  HLA-A targeting gRNA
agtattgggacggggagacacgg

SEQ ID NO: 630 - DNA, 23 bp, Artificial Sequence
  HLA-A targeting gRNA
agggtccggagtattgggacggg

SEQ ID NO: 631 - DNA, 23 bp, Artificial Sequence
  HLA-A targeting gRNA
gagggtccggagtattgggacgg

SEQ ID NO: 632 - DNA, 23 bp, Artificial Sequence
  HLA-A targeting gRNA
ggaccctcctgctctatccacgg

SEQ ID NO: 633 - DNA, 23 bp, Artificial Sequence
  HLA-A targeting gRNA
gtggatagagcaggagggtccgg

SEQ ID NO: 634 - DNA, 23 bp, Artificial Sequence
  HLA-A targeting gRNA
agactcaccgagtggacctgggg

SEQ ID NO: 635 - DNA, 23 bp, Artificial Sequence
  HLA-A targeting gRNA
cactcggtgagtctgtgagtggg

SEQ ID NO: 636 - DNA, 23 bp, Artificial Sequence
  HLA-A targeting gRNA
cagactcaccgagtggacctggg

SEQ ID NO: 637 - DNA, 23 bp, Artificial Sequence
  HLA-A targeting gRNA
ccactcacagactcaccgagtgg

SEQ ID NO: 638 - DNA, 23 bp, Artificial Sequence
  HLA-A targeting gRNA
ccactcggtgagtctgtgagtgg

SEQ ID NO: 639 - DNA, 23 bp, Artificial Sequence
  HLA-A targeting gRNA
tcggactggcgcttcctccgcgg

SEQ ID NO: 640 - DNA, 23 bp, Artificial Sequence
  HLA-A targeting gRNA
gcagccatacatcctctggacgg

SEQ ID NO: 641 - DNA, 23 bp, Artificial Sequence
  HLA-A targeting gRNA
tctcaactgctccgccacatggg

SEQ ID NO: 642 - DNA, 23 bp, Artificial Sequence
  HLA-A targeting gRNA
accctcatgctgcacatggcagg

SEQ ID NO: 643 - DNA, 23 bp, Artificial Sequence
  HLA-A targeting gRNA
acctgccatgtgcagcatgaggg

SEQ ID NO: 644 - DNA, 23 bp, Artificial Sequence
  HLA-A targeting gRNA
cacctgccatgtgcagcatgagg

SEQ ID NO: 645 - DNA, 23 bp, Artificial Sequence
  HLA-A targeting gRNA
ggaggaccagacccaggacacgg

SEQ ID NO: 646 - DNA, 23 bp, Artificial Sequence
  HLA-A targeting gRNA
ggatggggaggaccagacccagg

SEQ ID NO: 647 - DNA, 23 bp, Artificial Sequence
  HLA-A targeting gRNA
gacctggcagcgggatggggagg

SEQ ID NO: 648 - DNA, 23 bp, Artificial Sequence
  HLA-A targeting gRNA
agatcacactgacctggcagcgg

SEQ ID NO: 649 - DNA, 23 bp, Artificial Sequence
  HLA-A targeting gRNA
gatcacactgacctggcagcggg

SEQ ID NO: 650 - DNA, 23 bp, Artificial Sequence
  HLA-A targeting gRNA
aggtcagtgtgatctccgcaggg

SEQ ID NO: 651 - DNA, 23 bp, Artificial Sequence
  HLA-A targeting gRNA
aagcccctcaccctgagatgggg

SEQ ID NO: 652 - DNA, 23 bp, Artificial Sequence
  HLA-A targeting gRNA
ctgcggagatcacactgacctgg

SEQ ID NO: 653 - DNA, 23 bp, Artificial Sequence
  HLA-A targeting gRNA
cagcaatgatgcccacgatgggg

SEQ ID NO: 654 - DNA, 23 bp, Artificial Sequence
  HLA-A targeting gRNA
ccagcaatgatgcccacgatggg

SEQ ID NO: 655 - DNA, 23 bp, Artificial Sequence
  HLA-A targeting gRNA
gccagcaatgatgcccacgatgg

SEQ ID NO: 656 - DNA, 23 bp, Artificial Sequence
  HLA-A targeting gRNA
ggatggaaccttccagaagtggg

SEQ ID NO: 657 - DNA, 23 bp, Artificial Sequence
  HLA-A targeting gRNA
gggatggaaccttccagaagtgg

SEQ ID NO: 658 - DNA, 23 bp, Artificial Sequence
  HLA-A targeting gRNA
atgcccacgatggggatggtggg

SEQ ID NO: 659 - DNA, 23 bp, Artificial Sequence
  HLA-A targeting gRNA
cagcccaccatccccatcgtggg

SEQ ID NO: 660 - DNA, 23 bp, Artificial Sequence
  HLA-A targeting gRNA
ccagcccaccatccccatcgtgg

SEQ ID NO: 661 - DNA, 23 bp, Artificial Sequence
  HLA-A targeting gRNA
gatgcccacgatggggatggtgg

SEQ ID NO: 662 - DNA, 23 bp, Artificial Sequence
  HLA-A targeting gRNA
cagggcccagcacctcagggtgg

SEQ ID NO: 663 - DNA, 23 bp, Artificial Sequence
  HLA-A targeting gRNA
aatgatgcccacgatggggatgg

SEQ ID NO: 664 - DNA, 23 bp, Artificial Sequence
  HLA-A targeting gRNA
ggccctgacccagacctgggcgg

SEQ ID NO: 665 - DNA, 23 bp, Artificial Sequence
  HLA-A targeting gRNA
gacccaggacacggagctcgtgg

SEQ ID NO: 666 - DNA, 23 bp, Artificial Sequence
  HLA-A targeting gRNA
acacggagctcgtggagaccagg

SEQ ID NO: 667 - DNA, 23 bp, Artificial Sequence
  HLA-A targeting gRNA
cgtggagaccaggcctgcagggg

SEQ ID NO: 668 - DNA, 23 bp, Artificial Sequence
  HLA-A targeting gRNA
tcgtggagaccaggcctgcaggg

SEQ ID NO: 669 - DNA, 23 bp, Artificial Sequence
  HLA-A targeting gRNA
agctgtgatcactggagctgtgg

SEQ ID NO: 670 - DNA, 23 bp, Artificial Sequence
  HLA-A targeting gRNA
aaaaggagggagctactctcagg

SEQ ID NO: 671 - DNA, 23 bp, Artificial Sequence
  HLA-A targeting gRNA
atgtggaggaggaagagctcagg

SEQ ID NO: 672 - DNA, 23 bp, Artificial Sequence
  HLA-A targeting gRNA
gtgtctctcacagcttgtaaagg

SEQ ID NO: 673 - DNA, 23 bp, Artificial Sequence
  HLA-A targeting gRNA
gagagacacatcagagccctggg

SEQ ID NO: 674 - DNA, 23 bp, Artificial Sequence
  HLA-A targeting gRNA
ctccgcagggtagaagctcaggg

SEQ ID NO: 675 - DNA, 23 bp, Artificial Sequence
  HLA-A targeting gRNA
ggccctgagcttctaccctgcgg

SEQ ID NO: 676 - DNA, 23 bp, Artificial Sequence
  HLA-A targeting gRNA
gctcagggcccagcacctcaggg

SEQ ID NO: 677 - DNA, 23 bp, Artificial Sequence
  HLA-A targeting gRNA
tatctctgctcctgtccagaagg

SEQ ID NO: 678 - DNA, 23 bp, Artificial Sequence
  HLA-A targeting gRNA
agtagcaggacgagggttcgggg

SEQ ID NO: 679 - DNA, 23 bp, Artificial Sequence
  HLA-A targeting gRNA
ccccgagagtagcaggacgaggg

SEQ ID NO: 680 - DNA, 23 bp, Artificial Sequence
  HLA-A targeting gRNA
ccctcgtcctgctactctcgggg

SEQ ID NO: 681 - DNA, 23 bp, Artificial Sequence
  HLA-A targeting gRNA
cctcgtcctgctactctcggggg

SEQ ID NO: 682 - DNA, 23 bp, Artificial Sequence
  HLA-A targeting gRNA
ctgtggtcgctgctgtgatgtgg

SEQ ID NO: 683 - DNA, 23 bp, Artificial Sequence
  HLA-A targeting gRNA
tcgctgctgtgatgtggaggagg

SEQ ID NO: 684 - DNA, 23 bp, Artificial Sequence
  HLA-A targeting gRNA
tggtcgctgctgtgatgtggagg

SEQ ID NO: 685 - DNA, 23 bp, Artificial Sequence
  HLA-A targeting gRNA
cacagccgcccacttctggaagg

SEQ ID NO: 686 - DNA, 23 bp, Artificial Sequence
  HLA-A targeting gRNA
ccagaagtgggcggctgtggtgg

SEQ ID NO: 687 - DNA, 23 bp, Artificial Sequence
  HLA-A targeting gRNA
tggaaccttccagaagtgggcgg

SEQ ID NO: 688 - DNA, 23 bp, Artificial Sequence
  HLA-A targeting gRNA
tcacagctccaaagagaaccagg

SEQ ID NO: 689 - DNA, 23 bp, Artificial Sequence
  HLA-A targeting gRNA
ctgaccatgaagccaccctgagg

SEQ ID NO: 690 - DNA, 23 bp, Artificial Sequence
  HLA-A targeting gRNA
gcaaaccctcatgctgcacatgg

SEQ ID NO: 691 - DNA, 23 bp, Artificial Sequence
  HLA-A targeting gRNA
tgaagccaccctgaggtgctggg

SEQ ID NO: 692 - DNA, 23 bp, Artificial Sequence
  HLA-A targeting gRNA
ggtgagtcatatgcgttttgggg

SEQ ID NO: 693 - DNA, 23 bp, Artificial Sequence
  HLA-A targeting gRNA
gtgagtcatatgcgttttggggg

SEQ ID NO: 694 - DNA, 23 bp, Artificial Sequence
  HLA-A targeting gRNA
cttcatggtcagagacagcgtgg

SEQ ID NO: 695 - DNA, 23 bp, Artificial Sequence
  HLA-A targeting gRNA
tctggccctgacccagacctggg

SEQ ID NO: 696 - DNA, 23 bp, Artificial Sequence
  HLA-A targeting gRNA
tggacgacacgcagttcgtgcgg

SEQ ID NO: 697 - DNA, 23 bp, Artificial Sequence
  HLA-A targeting gRNA
cagatacctggagaacgggaagg

SEQ ID NO: 698 - DNA, 23 bp, Artificial Sequence
  HLA-A targeting gRNA
tcccgttctccaggtatctgcgg

SEQ ID NO: 699 - DNA, 23 bp, Artificial Sequence
  HLA-A targeting gRNA
ccgccgcggtccaagagcgcagg

SEQ ID NO: 700 - DNA, 23 bp, Artificial Sequence
  HLA-A targeting gRNA
cctgcgctcttggaccgcggcgg

SEQ ID NO: 701 - DNA, 23 bp, Artificial Sequence
  HLA-A targeting gRNA
ggacctgcgctcttggaccgcgg

SEQ ID NO: 702 - DNA, 23 bp, Artificial Sequence
  HLA-A targeting gRNA
aaggagacgctgcagcgcacggg

SEQ ID NO: 703 - DNA, 23 bp, Artificial Sequence
  HLA-A targeting gRNA
gaaggagacgctgcagcgcacgg

SEQ ID NO: 704 - DNA, 23 bp, Artificial Sequence
  HLA-A targeting gRNA
gcgggcgccgtggatagagcagg

SEQ ID NO: 705 - DNA, 23 bp, Artificial Sequence
  HLA-A targeting gRNA
tgctctatccacggcgcccgcgg

SEQ ID NO: 706 - DNA, 23 bp, Artificial Sequence
  HLA-A targeting gRNA
cgatgaagcggggctccccgcgg

SEQ ID NO: 707 - DNA, 23 bp, Artificial Sequence
  HLA-A targeting gRNA
cgtgtcccggcccggccgcgggg

SEQ ID NO: 708 - DNA, 23 bp, Artificial Sequence
  HLA-A targeting gRNA
cggctccatcctctggctcgcgg

SEQ ID NO: 709 - DNA, 23 bp, Artificial Sequence
  HLA-A targeting gRNA
gatgtaatccttgccgtcgtagg

SEQ ID NO: 710 - DNA, 23 bp, Artificial Sequence
  HLA-A targeting gRNA
acagcgacgccgcgagccagagg

SEQ ID NO: 711 - DNA, 23 bp, Artificial Sequence
  HLA-A targeting gRNA
ggatggagccgcgggcgccgtgg

SEQ ID NO: 712 - DNA, 23 bp, Artificial Sequence
  HLA-A targeting gRNA
ggcgccgtggatagagcaggagg

SEQ ID NO: 713 - DNA, 23 bp, Artificial Sequence
  HLA-A targeting gRNA
gcgccgtggatagagcaggaggg

SEQ ID NO: 714 - DNA, 23 bp, Artificial Sequence
  HLA-A targeting gRNA
cggctactacaaccagagcgagg

SEQ ID NO: 715 - DNA, 23 bp, Artificial Sequence
  HLA-A targeting gRNA
ctggttgtagtagccgcgcaggg

SEQ ID NO: 716 - DNA, 23 bp, Artificial Sequence
  HLA-A targeting gRNA
tactacaaccagagcgaggccgg

SEQ ID NO: 717 - DNA, 23 bp, Artificial Sequence
  HLA-A targeting gRNA
ctacctggagggcacgtgcgtgg

SEQ ID NO: 718 - DNA, 23 bp, Artificial Sequence
  HLA-A targeting gRNA
cacgcacgtgccctccaggtagg

SEQ ID NO: 719 - DNA, 23 bp, Artificial Sequence
  HLA-A targeting gRNA
gcagggtccccaggtccactcgg

SEQ ID NO: 720 - DNA, 23 bp, Artificial Sequence
  HLA-A targeting gRNA
gtggacctggggaccctgcgcgg

SEQ ID NO: 721 - DNA, 23 bp, Artificial Sequence
  HLA-A targeting gRNA
tggagggcacgtgcgtggagtgg

SEQ ID NO: 722 - DNA, 23 bp, Artificial Sequence
  HLA-A targeting gRNA
gtatggctgcgacgtggggtcgg

SEQ ID NO: 723 - DNA, 23 bp, Artificial Sequence
  HLA-A targeting gRNA
ctgagctgccatgtccgccgcgg

SEQ ID NO: 724 - DNA, 23 bp, Artificial Sequence
  HLA-A targeting gRNA
ggattacatcgccctgaaagagg

SEQ ID NO: 725 - DNA, 23 bp, Artificial Sequence
  HLA-A targeting gRNA
caagtgggaggcggcccatgtgg

SEQ ID NO: 726 - DNA, 23 bp, Artificial Sequence
  HLA-A targeting gRNA
gtgggaggcggcccatgtggcgg

SEQ ID NO: 727 - DNA, 23 bp, Artificial Sequence
  HLA-A targeting gRNA
cagttgagagcctacctggaggg

SEQ ID NO: 728 - DNA, 23 bp, Artificial Sequence
  HLA-A targeting gRNA
gcagttgagagcctacctggagg

SEQ ID NO: 729 - DNA, 23 bp, Artificial Sequence
  HLA-A targeting gRNA
taccaccagtacgcctacgacgg

SEQ ID NO: 730 - DNA, 23 bp, Artificial Sequence
  HLA-A targeting gRNA
tgccgtcgtaggcgtactggtgg

SEQ ID NO: 731 - DNA, 23 bp, Artificial Sequence
  HLA-A targeting gRNA
ccagtacgcctacgacggcaagg

SEQ ID NO: 732 - DNA, 23 bp, Artificial Sequence
  HLA-A targeting gRNA
ggatgtgaagaaatacctcatgg

SEQ ID NO: 733 - DNA, 23 bp, Artificial Sequence
  HLA-A targeting gRNA
atttcttcacatccgtgtcccgg

SEQ ID NO: 734 - DNA, 23 bp, Artificial Sequence
  HLA-A targeting gRNA
aggcgtactggtggtacccgcgg

SEQ ID NO: 735 - DNA, 23 bp, Artificial Sequence
  HLA-A targeting gRNA
cgtactggtggtacccgcggagg

SEQ ID NO: 736 - DNA, 23 bp, Artificial Sequence
  HLA-A targeting gRNA
gaggatgtatggctgcgacgtgg

SEQ ID NO: 737 - DNA, 23 bp, Artificial Sequence
  HLA-A targeting gRNA
ggatgtatggctgcgacgtgggg

SEQ ID NO: 738 - DNA, 23 bp, Artificial Sequence
  HLA-A targeting gRNA
ctcagaccaccaagcacaagtgg

SEQ ID NO: 739 - DNA, 23 bp, Artificial Sequence
  HLA-A targeting gRNA
tcagaccaccaagcacaagtggg

SEQ ID NO: 740 - DNA, 23 bp, Artificial Sequence
  HLA-A targeting gRNA
caccaagcacaagtgggaggcgg

SEQ ID NO: 741 - DNA, 23 bp, Artificial Sequence
  HLA-A targeting gRNA
gaccaccaagcacaagtgggagg

SEQ ID NO: 742 - DNA, 23 bp, Artificial Sequence
  HLA-A targeting gRNA
gagccccgcttcatcgcagtggg

SEQ ID NO: 743 - DNA, 23 bp, Artificial Sequence
  HLA-A targeting gRNA
gtagcccactgcgatgaagcggg

SEQ ID NO: 744 - DNA, 23 bp, Artificial Sequence
  HLA-A targeting gRNA
tagcccactgcgatgaagcgggg

SEQ ID NO: 745 - DNA, 23 bp, Artificial Sequence
  HLA-A targeting gRNA
cgtagcccactgcgatgaagcgg

SEQ ID NO: 746 - DNA, 23 bp, Artificial Sequence
  HLA-A targeting gRNA
cttcatcgcagtgggctacgtgg

SEQ ID NO: 747 - DNA, 23 bp, Artificial Sequence
  HLA-A targeting gRNA
ggagccccgcttcatcgcagtgg

SEQ ID NO: 748 - DNA, 23 bp, Artificial Sequence
  HLA-A targeting gRNA
cggggagacacggaaagtgaagg

SEQ ID NO: 749 - DNA, 23 bp, Artificial Sequence
  HLA-A targeting gRNA
agtattgggacggggagacacgg

SEQ ID NO: 750 - DNA, 23 bp, Artificial Sequence
  HLA-A targeting gRNA
agggtccggagtattgggacggg

SEQ ID NO: 751 - DNA, 23 bp, Artificial Sequence
  HLA-A targeting gRNA
gagggtccggagtattgggacgg

SEQ ID NO: 752 - DNA, 23 bp, Artificial Sequence
  HLA-A targeting gRNA
ggaccctcctgctctatccacgg

SEQ ID NO: 753 - DNA, 23 bp, Artificial Sequence
  HLA-A targeting gRNA
gtggatagagcaggagggtccgg

SEQ ID NO: 754 - DNA, 23 bp, Artificial Sequence
  HLA-A targeting gRNA
agactcaccgagtggacctgggg

SEQ ID NO: 755 - DNA, 23 bp, Artificial Sequence
  HLA-A targeting gRNA
cactcggtgagtctgtgagtggg

SEQ ID NO: 756 - DNA, 23 bp, Artificial Sequence
  HLA-A targeting gRNA
cagactcaccgagtggacctggg

SEQ ID NO: 757 - DNA, 23 bp, Artificial Sequence
  HLA-A targeting gRNA
ccactcacagactcaccgagtgg

SEQ ID NO: 758 - DNA, 23 bp, Artificial Sequence
  HLA-A targeting gRNA
ccactcggtgagtctgtgagtgg

SEQ ID NO: 759 - DNA, 23 bp, Artificial Sequence
  HLA-A targeting gRNA
tcggactggcgcttcctccgcgg

SEQ ID NO: 760 - DNA, 23 bp, Artificial Sequence
  HLA-A targeting gRNA
gcagccatacatcctctggacgg

SEQ ID NO: 761 - DNA, 23 bp, Artificial Sequence
  HLA-A targeting gRNA
tctcaactgctccgccacatggg

SEQ ID NO: 762 - DNA, 23 bp, Artificial Sequence
  HLA-A targeting gRNA
accctcatgctgcacatggcagg

SEQ ID NO: 763 - DNA, 23 bp, Artificial Sequence
  HLA-A targeting gRNA
acctgccatgtgcagcatgaggg

SEQ ID NO: 764 - DNA, 23 bp, Artificial Sequence
  HLA-A targeting gRNA
cacctgccatgtgcagcatgagg

SEQ ID NO: 765 - DNA, 23 bp, Artificial Sequence
  HLA-A targeting gRNA
ggaggaccagacccaggacacgg

SEQ ID NO: 766 - DNA, 23 bp, Artificial Sequence
  HLA-A targeting gRNA
ggatggggaggaccagacccagg

SEQ ID NO: 767 - DNA, 23 bp, Artificial Sequence
  HLA-A targeting gRNA
gacctggcagcgggatggggagg

SEQ ID NO: 768 - DNA, 23 bp, Artificial Sequence
  HLA-A targeting gRNA
agatcacactgacctggcagcgg

SEQ ID NO: 769 - DNA, 23 bp, Artificial Sequence
  HLA-A targeting gRNA
gatcacactgacctggcagcggg

SEQ ID NO: 770 - DNA, 23 bp, Artificial Sequence
  HLA-A targeting gRNA
aggtcagtgtgatctccgcaggg

SEQ ID NO: 771 - DNA, 23 bp, Artificial Sequence
  HLA-A targeting gRNA
aagcccctcaccctgagatgggg

SEQ ID NO: 772 - DNA, 23 bp, Artificial Sequence
  HLA-A targeting gRNA
ctgcggagatcacactgacctgg

SEQ ID NO: 773 - DNA, 23 bp, Artificial Sequence
  HLA-A targeting gRNA
cagcaatgatgcccacgatgggg

SEQ ID NO: 774 - DNA, 23 bp, Artificial Sequence
  HLA-A targeting gRNA
ccagcaatgatgcccacgatggg

SEQ ID NO: 775 - DNA, 23 bp, Artificial Sequence
  HLA-A targeting gRNA
gccagcaatgatgcccacgatgg

SEQ ID NO: 776 - DNA, 23 bp, Artificial Sequence
  HLA-A targeting gRNA
ggatggaaccttccagaagtggg

SEQ ID NO: 777 - DNA, 23 bp, Artificial Sequence
  HLA-A targeting gRNA
gggatggaaccttccagaagtgg

SEQ ID NO: 778 - DNA, 23 bp, Artificial Sequence
  HLA-A targeting gRNA
atgcccacgatggggatggtggg

SEQ ID NO: 779 - DNA, 23 bp, Artificial Sequence
  HLA-A targeting gRNA
cagcccaccatccccatcgtggg

SEQ ID NO: 780 - DNA, 23 bp, Artificial Sequence
  HLA-A targeting gRNA
ccagcccaccatccccatcgtgg

SEQ ID NO: 781 - DNA, 23 bp, Artificial Sequence
  HLA-A targeting gRNA
gatgcccacgatggggatggtgg

SEQ ID NO: 782 - DNA, 23 bp, Artificial Sequence
  HLA-A targeting gRNA
cagggcccagcacctcagggtgg

SEQ ID NO: 783 - DNA, 23 bp, Artificial Sequence
  HLA-A targeting gRNA
aatgatgcccacgatggggatgg

SEQ ID NO: 784 - DNA, 23 bp, Artificial Sequence
  HLA-A targeting gRNA
ggccctgacccagacctgggcgg

SEQ ID NO: 785 - DNA, 23 bp, Artificial Sequence
  HLA-A targeting gRNA
gacccaggacacggagctcgtgg

SEQ ID NO: 786 - DNA, 23 bp, Artificial Sequence
  HLA-A targeting gRNA
acacggagctcgtggagaccagg

SEQ ID NO: 787 - DNA, 23 bp, Artificial Sequence
  HLA-A targeting gRNA
cgtggagaccaggcctgcagggg

SEQ ID NO: 788 - DNA, 23 bp, Artificial Sequence
  HLA-A targeting gRNA
tcgtggagaccaggcctgcaggg

SEQ ID NO: 789 - DNA, 23 bp, Artificial Sequence
  HLA-A targeting gRNA
agctgtgatcactggagctgtgg

SEQ ID NO: 790 - DNA, 23 bp, Artificial Sequence
  HLA-A targeting gRNA
aaaaggagggagctactctcagg

SEQ ID NO: 791 - DNA, 23 bp, Artificial Sequence
  HLA-A targeting gRNA
atgtggaggaggaagagctcagg

SEQ ID NO: 792 - DNA, 23 bp, Artificial Sequence
  HLA-A targeting gRNA
gtgtctctcacagcttgtaaagg

SEQ ID NO: 793 - DNA, 23 bp, Artificial Sequence
  HLA-A targeting gRNA
gagagacacatcagagccctggg

SEQ ID NO: 794 - DNA, 23 bp, Artificial Sequence
  HLA-A targeting gRNA
ctccgcagggtagaagctcaggg

SEQ ID NO: 795 - DNA, 23 bp, Artificial Sequence
  HLA-A targeting gRNA
ggccctgagcttctaccctgcgg

SEQ ID NO: 796 - DNA, 23 bp, Artificial Sequence
  HLA-A targeting gRNA
gctcagggcccagcacctcaggg

SEQ ID NO: 797 - DNA, 23 bp, Artificial Sequence
  HLA-A targeting gRNA
tatctctgctcctgtccagaagg

SEQ ID NO: 798 - DNA, 23 bp, Artificial Sequence
  HLA-A targeting gRNA
agtagcaggacgagggttcgggg

SEQ ID NO: 799 - DNA, 23 bp, Artificial Sequence
  HLA-A targeting gRNA
ccccgagagtagcaggacgaggg

SEQ ID NO: 800 - DNA, 23 bp, Artificial Sequence
  HLA-A targeting gRNA
ccctcgtcctgctactctcgggg

SEQ ID NO: 801 - DNA, 23 bp, Artificial Sequence
  HLA-A targeting gRNA
cctcgtcctgctactctcggggg

SEQ ID NO: 802 - DNA, 23 bp, Artificial Sequence
  HLA-A targeting gRNA
ctgtggtcgctgctgtgatgtgg

SEQ ID NO: 803 - DNA, 23 bp, Artificial Sequence
  HLA-A targeting gRNA
tcgctgctgtgatgtggaggagg

SEQ ID NO: 804 - DNA, 23 bp, Artificial Sequence
  HLA-A targeting gRNA
tggtcgctgctgtgatgtggagg

SEQ ID NO: 805 - DNA, 23 bp, Artificial Sequence
  HLA-A targeting gRNA
cacagccgcccacttctggaagg

SEQ ID NO: 806 - DNA, 23 bp, Artificial Sequence
  HLA-A targeting gRNA
ccagaagtgggcggctgtggtgg

SEQ ID NO: 807 - DNA, 23 bp, Artificial Sequence
  HLA-A targeting gRNA
tggaaccttccagaagtgggcgg

SEQ ID NO: 808 - DNA, 23 bp, Artificial Sequence
  HLA-A targeting gRNA
tcacagctccaaagagaaccagg

SEQ ID NO: 809 - DNA, 23 bp, Artificial Sequence
  HLA-A targeting gRNA
ctgaccatgaagccaccctgagg

SEQ ID NO: 810 - DNA, 23 bp, Artificial Sequence
  HLA-A targeting gRNA
gcaaaccctcatgctgcacatgg

SEQ ID NO: 811 - DNA, 23 bp, Artificial Sequence
  HLA-A targeting gRNA
tgaagccaccctgaggtgctggg

SEQ ID NO: 812 - DNA, 23 bp, Artificial Sequence
  HLA-A targeting gRNA
ggtgagtcatatgcgttttgggg

SEQ ID NO: 813 - DNA, 23 bp, Artificial Sequence
  HLA-A targeting gRNA
gtgagtcatatgcgttttggggg

SEQ ID NO: 814 - DNA, 23 bp, Artificial Sequence
  HLA-A targeting gRNA
cttcatggtcagagacagcgtgg

SEQ ID NO: 815 - DNA, 23 bp, Artificial Sequence
  HLA-A targeting gRNA
tctggccctgacccagacctggg

SEQ ID NO: 816 - DNA, 23 bp, Artificial Sequence
  HLA-A targeting gRNA
caggctgcaagtaagtatgaagg

SEQ ID NO: 817 - DNA, 23 bp, Artificial Sequence
  HLA-A targeting gRNA
cagtcacaagtcacaggggaagg

SEQ ID NO: 818 - DNA, 23 bp, Artificial Sequence
  HLA-A targeting gRNA
ccagcagtcacaagtcacagggg

SEQ ID NO: 819 - DNA, 23 bp, Artificial Sequence
  HLA-A targeting gRNA
cccctgtgacttgtgactgctgg

SEQ ID NO: 820 - DNA, 23 bp, Artificial Sequence
  HLA-A targeting gRNA
ctttacaaaagagtaagtgctgg

SEQ ID NO: 821 - DNA, 23 bp, Artificial Sequence
  HLA-A targeting gRNA
gagatttcttgtctcactgaggg

SEQ ID NO: 822 - DNA, 23 bp, Artificial Sequence
  HLA-A targeting gRNA
gaggttcctctaggaccttaagg

SEQ ID NO: 823 - DNA, 23 bp, Artificial Sequence
  HLA-A targeting gRNA
gctgcaagtaagtatgaaggagg

SEQ ID NO: 824 - DNA, 23 bp, Artificial Sequence
  HLA-A targeting gRNA
tgagatttcttgtctcactgagg

SEQ ID NO: 825 - DNA, 23 bp, Artificial Sequence
  HLA-A targeting gRNA
gcctaaactgaaaatgaaaccgg

SEQ ID NO: 826 - DNA, 23 bp, Artificial Sequence
  HLA-A targeting gRNA
tctggtcctgacctgagtggagg

SEQ ID NO: 827 - DNA, 23 bp, Artificial Sequence
  HLA-A targeting gRNA
aagagtaagtgctggcacacagg

SEQ ID NO: 828 - DNA, 23 bp, Artificial Sequence
  HLA-A targeting gRNA
agagtaagtgctggcacacaggg

SEQ ID NO: 829 - DNA, 23 bp, Artificial Sequence
  HLA-A targeting gRNA
ccaggcagtgacagtgcccaggg

SEQ ID NO: 830 - DNA, 23 bp, Artificial Sequence
  HLA-A targeting gRNA
cccaggcagtgacagtgcccagg

SEQ ID NO: 831 - DNA, 23 bp, Artificial Sequence
  HLA-A targeting gRNA
ccctgggcactgtcactgcctgg

SEQ ID NO: 832 - DNA, 23 bp, Artificial Sequence
  HLA-A targeting gRNA
cctgggcactgtcactgcctggg

SEQ ID NO: 833 - DNA, 23 bp, Artificial Sequence
  HLA-A targeting gRNA
ctgggcactgtcactgcctgggg

SEQ ID NO: 834 - DNA, 23 bp, Artificial Sequence
  HLA-A targeting gRNA
caattgtctcccctccttgtggg

SEQ ID NO: 835 - DNA, 23 bp, Artificial Sequence
  HLA-A targeting gRNA
cacaaggaggggagacaattggg

SEQ ID NO: 836 - DNA, 23 bp, Artificial Sequence
  HLA-A targeting gRNA
caggaggattcctctccctcagg

SEQ ID NO: 837 - DNA, 23 bp, Artificial Sequence
  HLA-A targeting gRNA
ccaattgtctcccctccttgtgg

SEQ ID NO: 838 - DNA, 23 bp, Artificial Sequence
  HLA-A targeting gRNA
ccacaaggaggggagacaattgg

SEQ ID NO: 839 - DNA, 23 bp, Artificial Sequence
  HLA-A targeting gRNA
cgggctggcctcccacaaggagg

SEQ ID NO: 840 - DNA, 23 bp, Artificial Sequence
  HLA-A targeting gRNA
ctccttgtgggaggccagcccgg

SEQ ID NO: 841 - DNA, 23 bp, Artificial Sequence
  HLA-A targeting gRNA
ctgagggagaggaatcctcctgg

SEQ ID NO: 842 - DNA, 23 bp, Artificial Sequence
  HLA-A targeting gRNA
ggaacctcagagtcactctctgg

SEQ ID NO: 843 - DNA, 23 bp, Artificial Sequence
  HLA-A targeting gRNA
ggctggcctcccacaaggagggg

SEQ ID NO: 844 - DNA, 23 bp, Artificial Sequence
  HLA-A targeting gRNA
gggctggcctcccacaaggaggg

SEQ ID NO: 845 - DNA, 23 bp, Artificial Sequence
  HLA-A targeting gRNA
tcccgggctggcctcccacaagg

SEQ ID NO: 846 - DNA, 23 bp, Artificial Sequence
  HLA-A targeting gRNA
tccttgtgggaggccagcccggg

SEQ ID NO: 847 - DNA, 23 bp, Artificial Sequence
  HLA-A targeting gRNA
tgagggagaggaatcctcctggg

SEQ ID NO: 848 - DNA, 23 bp, Artificial Sequence
  HLA-A targeting gRNA
tgtaccagagagtgactctgagg

SEQ ID NO: 849 - DNA, 23 bp, Artificial Sequence
  HLA-A targeting gRNA
ttgtctcccctccttgtgggagg

SEQ ID NO: 850 - DNA, 23 bp, Artificial Sequence
  HLA-A targeting gRNA
aggcctgagaggaaaagtcacgg

SEQ ID NO: 851 - DNA, 23 bp, Artificial Sequence
  HLA-A targeting gRNA
cagcctggacacaggcacctggg

SEQ ID NO: 852 - DNA, 23 bp, Artificial Sequence
  HLA-A targeting gRNA
ccagcctggacacaggcacctgg

SEQ ID NO: 853 - DNA, 23 bp, Artificial Sequence
  HLA-A targeting gRNA
ccaggtgcctgtgtccaggctgg

SEQ ID NO: 854 - DNA, 23 bp, Artificial Sequence
  HLA-A targeting gRNA
tatcccaggtgcctgtgtccagg

SEQ ID NO: 855 - DNA, 23 bp, Artificial Sequence
  HLA-A targeting gRNA
acttctggtcctgacctgagtgg

SEQ ID NO: 856 - DNA, 23 bp, Artificial Sequence
  HLA-A targeting gRNA
aaggcgcctgggcctctcccggg

SEQ ID NO: 857 - DNA, 23 bp, Artificial Sequence
  HLA-A targeting gRNA
atctcggacccggagactgtggg

SEQ ID NO: 858 - DNA, 23 bp, Artificial Sequence
  HLA-A targeting gRNA
gatctcggacccggagactgtgg

SEQ ID NO: 859 - DNA, 23 bp, Artificial Sequence
  HLA-A targeting gRNA
ggaaaagaggggaaggtgagggg

SEQ ID NO: 860 - DNA, 23 bp, Artificial Sequence
  HLA-A targeting gRNA
gggaaaagaggggaaggtgaggg

SEQ ID NO: 861 - DNA, 23 bp, Artificial Sequence
  HLA-A targeting gRNA
tgggaaaagaggggaaggtgagg

SEQ ID NO: 862 - DNA, 23 bp, Artificial Sequence
  HLA-A targeting gRNA
ctccctccttaccccatctcagg

SEQ ID NO: 863 - DNA, 23 bp, Artificial Sequence
  HLA-A targeting gRNA
tccctccttaccccatctcaggg

SEQ ID NO: 864 - DNA, 23 bp, Artificial Sequence
  HLA-A targeting gRNA
agcagagaacaaggcctgagagg

SEQ ID NO: 865 - DNA, 23 bp, Artificial Sequence
  HLA-A targeting gRNA
aggggccctgaccctgctaaagg

SEQ ID NO: 866 - DNA, 23 bp, Artificial Sequence
  HLA-A targeting gRNA
cttcacactcaatgtgtgtgggg

SEQ ID NO: 867 - DNA, 23 bp, Artificial Sequence
  HLA-A targeting gRNA
gcttcacactcaatgtgtgtggg

SEQ ID NO: 868 - DNA, 23 bp, Artificial Sequence
  HLA-A targeting gRNA
tgagtgtgaagcagagaacaagg

SEQ ID NO: 869 - DNA, 23 bp, Artificial Sequence
  HLA-A targeting gRNA
tgcttcacactcaatgtgtgtgg

SEQ ID NO: 870 - DNA, 23 bp, Artificial Sequence
  HLA-A targeting gRNA
ttcacactcaatgtgtgtggggg

SEQ ID NO: 871 - DNA, 23 bp, Artificial Sequence
  HLA-A targeting gRNA
ctgtgtccaggctggtgtctggg

SEQ ID NO: 872 - DNA, 23 bp, Artificial Sequence
  HLA-A targeting gRNA
ggatgtattgagcatgcgatggg

SEQ ID NO: 873 - DNA, 23 bp, Artificial Sequence
  HLA-A targeting gRNA
tggatgtattgagcatgcgatgg

SEQ ID NO: 874 - DNA, 23 bp, Artificial Sequence
  HLA-A targeting gRNA
gtcctccccatcccgctgccagg

SEQ ID NO: 875 - DNA, 23 bp, Artificial Sequence
  HLA-A targeting gRNA
cccggtttcattttcagtttagg

SEQ ID NO: 876 - DNA, 23 bp, Artificial Sequence
  HLA-A targeting gRNA
cctaaactgaaaatgaaaccggg

SEQ ID NO: 877 - DNA, 23 bp, Artificial Sequence
  HLA-A targeting gRNA
acagaacccagacaccagcctgg

SEQ ID NO: 878 - DNA, 23 bp, Artificial Sequence
  HLA-A targeting gRNA
accctgagatggggtaaggaggg

SEQ ID NO: 879 - DNA, 23 bp, Artificial Sequence
  HLA-A targeting gRNA
caccctgagatggggtaaggagg

SEQ ID NO: 880 - DNA, 23 bp, Artificial Sequence
  HLA-A targeting gRNA
cctcaccctgagatggggtaagg

SEQ ID NO: 881 - DNA, 23 bp, Artificial Sequence
  HLA-A targeting gRNA
ccttaccccatctcagggtgagg

SEQ ID NO: 882 - DNA, 23 bp, Artificial Sequence
  HLA-A targeting gRNA
cttaccccatctcagggtgaggg

SEQ ID NO: 883 - DNA, 23 bp, Artificial Sequence
  HLA-A targeting gRNA
ttaccccatctcagggtgagggg

SEQ ID NO: 884 - DNA, 23 bp, Artificial Sequence
  HLA-A targeting gRNA
aaatgtgtgactgcagacccagg

SEQ ID NO: 885 - DNA, 23 bp, Artificial Sequence
  HLA-A targeting gRNA
ggtctgcagtcacacatttctgg

SEQ ID NO: 886 - DNA, 23 bp, Artificial Sequence
  HLA-A targeting gRNA
ctccctcaggaccagagggaggg

SEQ ID NO: 887 - DNA, 23 bp, Artificial Sequence
  HLA-A targeting gRNA
tcactctctggtacaggatctgg

SEQ ID NO: 888 - DNA, 23 bp, Artificial Sequence
  HLA-A targeting gRNA
tcagagtcactctctggtacagg

SEQ ID NO: 889 - DNA, 23 bp, Artificial Sequence
  HLA-A targeting gRNA
tccctctggtcctgagggagagg

SEQ ID NO: 890 - DNA, 23 bp, Artificial Sequence
  HLA-A targeting gRNA
tcctctccctcaggaccagaggg

SEQ ID NO: 891 - DNA, 23 bp, Artificial Sequence
  HLA-A targeting gRNA
tctccctcaggaccagagggagg

SEQ ID NO: 892 - DNA, 23 bp, Artificial Sequence
  HLA-A targeting gRNA
ttcctctccctcaggaccagagg

SEQ ID NO: 893 - DNA, 23 bp, Artificial Sequence
  HLA-A targeting gRNA
caagcccctcaccctgagatggg

SEQ ID NO: 894 - DNA, 23 bp, Artificial Sequence
  HLA-A targeting gRNA
catctcagggtgaggggcttggg

SEQ ID NO: 895 - DNA, 23 bp, Artificial Sequence
  HLA-A targeting gRNA
ccaagcccctcaccctgagatgg

SEQ ID NO: 896 - DNA, 23 bp, Artificial Sequence
  HLA-A targeting gRNA
ccatctcagggtgaggggcttgg

SEQ ID NO: 897 - DNA, 23 bp, Artificial Sequence
  HLA-A targeting gRNA
ccagacaccagcctggacacagg

SEQ ID NO: 898 - DNA, 23 bp, Artificial Sequence
  HLA-A targeting gRNA
cctgtgtccaggctggtgtctgg

SEQ ID NO: 899 - DNA, 23 bp, Artificial Sequence
  HLA-A targeting gRNA
ctccgcagatacctggagaacgg

SEQ ID NO: 900 - DNA, 23 bp, Artificial Sequence
  HLA-A targeting gRNA
tgtcctgtgagataccagaaagg

SEQ ID NO: 901 - DNA, 23 bp, Artificial Sequence
  HLA-A targeting gRNA
aatgtgtgactgcagacccaggg

SEQ ID NO: 902 - DNA, 23 bp, Artificial Sequence
  HLA-A targeting gRNA
gagaccaggcctgcaggggatgg

SEQ ID NO: 903 - DNA, 23 bp, Artificial Sequence
  HLA-A targeting gRNA
actgacctggcagcgggatgggg

SEQ ID NO: 904 - DNA, 23 bp, Artificial Sequence
  HLA-A targeting gRNA
cactgacctggcagcgggatggg

SEQ ID NO: 905 - DNA, 23 bp, Artificial Sequence
  HLA-A targeting gRNA
acactgacctggcagcgggatgg

SEQ ID NO: 906 - DNA, 23 bp, Artificial Sequence
  HLA-A targeting gRNA
gagggttcggggcgccatgacgg

SEQ ID NO: 907 - DNA, 23 bp, Artificial Sequence
  HLA-A targeting gRNA
gcgtctccttcccgttctccagg

SEQ ID NO: 908 - DNA, 23 bp, Artificial Sequence
  HLA-A targeting gRNA
tccgcagatacctggagaacggg

SEQ ID NO: 909 - DNA, 23 bp, Artificial Sequence
  HLA-A targeting gRNA
caggtcagtgtgatctccgcagg

SEQ ID NO: 910 - DNA, 23 bp, Artificial Sequence
  HLA-A targeting gRNA
ctcttggaccgcggcggacatgg

SEQ ID NO: 911 - DNA, 23 bp, Artificial Sequence
  HLA-A targeting gRNA
cccatcgtgggcatcattgctgg

SEQ ID NO: 912 - DNA, 23 bp, Artificial Sequence
  HLA-A targeting gRNA
gctgcagcgcacgggtaccaggg

SEQ ID NO: 913 - DNA, 23 bp, Artificial Sequence
  HLA-A targeting gRNA
cacgggtaccaggggccacgggg

SEQ ID NO: 914 - DNA, 23 bp, Artificial Sequence
  HLA-A targeting gRNA
cgcacgggtaccaggggccacgg

SEQ ID NO: 915 - DNA, 23 bp, Artificial Sequence
  HLA-A targeting gRNA
ctgcagcgcacgggtaccagggg

SEQ ID NO: 916 - DNA, 23 bp, Artificial Sequence
  HLA-A targeting gRNA
gcacgggtaccaggggccacggg

SEQ ID NO: 917 - DNA, 23 bp, Artificial Sequence
  HLA-A targeting gRNA
cgctgcagcgcacgggtaccagg

SEQ ID NO: 918 - DNA, 23 bp, Artificial Sequence
  HLA-A targeting gRNA
atgaaggaggctgatgcctgagg

SEQ ID NO: 919 - DNA, 23 bp, Artificial Sequence
  HLA-A targeting gRNA
acagaagatgtggctagaggagg

SEQ ID NO: 920 - DNA, 23 bp, Artificial Sequence
  HLA-A targeting gRNA
atcttctgtgggatctgaccagg

SEQ ID NO: 921 - DNA, 23 bp, Artificial Sequence
  HLA-A targeting gRNA
cccacagaagatgtggctagagg

SEQ ID NO: 922 - DNA, 23 bp, Artificial Sequence
  HLA-A targeting gRNA
cctctagccacatcttctgtggg

SEQ ID NO: 923 - DNA, 23 bp, Artificial Sequence
  HLA-A targeting gRNA
gtcagatcccacagaagatgtgg

SEQ ID NO: 924 - DNA, 23 bp, Artificial Sequence
  HLA-A targeting gRNA
tcctctagccacatcttctgtgg

SEQ ID NO: 925 - DNA, 23 bp, Artificial Sequence
  HLA-A targeting gRNA
gggctccccgcggccgggccggg

SEQ ID NO: 926 - DNA, 23 bp, Artificial Sequence
  HLA-A targeting gRNA
aggctgatgcctgaggtccttgg

SEQ ID NO: 927 - DNA, 23 bp, Artificial Sequence
  HLA-A targeting gRNA
cacaatatcccaaggacctcagg

SEQ ID NO: 928 - DNA, 23 bp, Artificial Sequence
  HLA-A targeting gRNA
ggctgatgcctgaggtccttggg

SEQ ID NO: 929 - DNA, 23 bp, Artificial Sequence
  HLA-A targeting gRNA
aggcattttgcatctgtcatggg

SEQ ID NO: 930 - DNA, 23 bp, Artificial Sequence
  HLA-A targeting gRNA
caggcattttgcatctgtcatgg

SEQ ID NO: 931 - DNA, 23 bp, Artificial Sequence
  HLA-A targeting gRNA
cccagcagtcacaagtcacaggg

SEQ ID NO: 932 - DNA, 23 bp, Artificial Sequence
  HLA-A targeting gRNA
ccctgtgacttgtgactgctggg

SEQ ID NO: 933 - DNA, 23 bp, Artificial Sequence
  HLA-A targeting gRNA
tggaaggttccatcccctgcagg

SEQ ID NO: 934 - DNA, 23 bp, Artificial Sequence
  HLA-A targeting gRNA
aagcggggctccccgcggccggg

SEQ ID NO: 935 - DNA, 23 bp, Artificial Sequence
  HLA-A targeting gRNA
gaagcggggctccccgcggccgg

SEQ ID NO: 936 - DNA, 23 bp, Artificial Sequence
  HLA-A targeting gRNA
ggggctccccgcggccgggccgg

SEQ ID NO: 937 - DNA, 23 bp, Artificial Sequence
  HLA-A targeting gRNA
aattgtgtcagagagcagggcgg

SEQ ID NO: 938 - DNA, 23 bp, Artificial Sequence
  HLA-A targeting gRNA
cctgctctctgacacaattaagg

SEQ ID NO: 939 - DNA, 23 bp, Artificial Sequence
  HLA-A targeting gRNA
ccttaattgtgtcagagagcagg

SEQ ID NO: 940 - DNA, 23 bp, Artificial Sequence
  HLA-A targeting gRNA
ctgctctctgacacaattaaggg

SEQ ID NO: 941 - DNA, 23 bp, Artificial Sequence
  HLA-A targeting gRNA
cttaattgtgtcagagagcaggg

SEQ ID NO: 942 - DNA, 23 bp, Artificial Sequence
  HLA-A targeting gRNA
agtgctggcacacagggcccagg

SEQ ID NO: 943 - DNA, 23 bp, Artificial Sequence
  HLA-A targeting gRNA
ctagaggaggaattgtggggtgg

SEQ ID NO: 944 - DNA, 23 bp, Artificial Sequence
  HLA-A targeting gRNA
ctggcacacagggcccaggctgg

SEQ ID NO: 945 - DNA, 23 bp, Artificial Sequence
  HLA-A targeting gRNA
gtggctagaggaggaattgtggg

SEQ ID NO: 946 - DNA, 23 bp, Artificial Sequence
  HLA-A targeting gRNA
tggcacacagggcccaggctggg

SEQ ID NO: 947 - DNA, 23 bp, Artificial Sequence
  HLA-A targeting gRNA
tggctagaggaggaattgtgggg

SEQ ID NO: 948 - DNA, 23 bp, Artificial Sequence
  HLA-A targeting gRNA
tgtggctagaggaggaattgtgg

SEQ ID NO: 949 - DNA, 23 bp, Artificial Sequence
  HLA-A targeting gRNA
ctcggggtcccgcggcttcgggg

SEQ ID NO: 950 - DNA, 23 bp, Artificial Sequence
  HLA-A targeting gRNA
gtctcggggtcccgcggcttcgg

SEQ ID NO: 951 - DNA, 23 bp, Artificial Sequence
  HLA-A targeting gRNA
tctcggggtcccgcggcttcggg

SEQ ID NO: 952 - DNA, 23 bp, Artificial Sequence
  HLA-A targeting gRNA
gacttgtgactgctgggatcagg

SEQ ID NO: 953 - DNA, 23 bp, Artificial Sequence
  HLA-A targeting gRNA
tcccagcagtcacaagtcacagg

SEQ ID NO: 954 - DNA, 23 bp, Artificial Sequence
  HLA-A targeting gRNA
ggttccatcccctgcaggcctgg

SEQ ID NO: 955 - DNA, 23 bp, Artificial Sequence
  HLA-A targeting gRNA
ctcccaaacacaatatcccaagg

SEQ ID NO: 956 - DNA, 23 bp, Artificial Sequence
  HLA-A targeting gRNA
ggtccttgggatattgtgtttgg

SEQ ID NO: 957 - DNA, 23 bp, Artificial Sequence
  HLA-A targeting gRNA
gtccttgggatattgtgtttggg

SEQ ID NO: 958 - DNA, 23 bp, Artificial Sequence
  HLA-A targeting gRNA
tccgtgtcccggcccggccgcgg

SEQ ID NO: 959 - DNA, 23 bp, Artificial Sequence
  HLA-A targeting gRNA
cccgcggccgggccgggacacgg

SEQ ID NO: 960 - DNA, 23 bp, Artificial Sequence
  HLA-A targeting gRNA
ccgtgtcccggcccggccgcggg

SEQ ID NO: 961 - DNA, 23 bp, Artificial Sequence
  HLA-A targeting gRNA
acaggatctggaaacccaggagg

SEQ ID NO: 962 - DNA, 23 bp, Artificial Sequence
  HLA-A targeting gRNA
ggtacaggatctggaaacccagg

SEQ ID NO: 963 - DNA, 23 bp, Artificial Sequence
  HLA-A targeting gRNA
ttgggtgttgggcggaacagtgg

SEQ ID NO: 964 - DNA, 23 bp, Artificial Sequence
  HLA-A targeting gRNA
cgacgccgcgagccagaggatgg

SEQ ID NO: 965 - DNA, 23 bp, Artificial Sequence
  HLA-A targeting gRNA
cgagccagaggatggagccgcgg

SEQ ID NO: 966 - DNA, 23 bp, Artificial Sequence
  HLA-A targeting gRNA
gagccagaggatggagccgcggg

SEQ ID NO: 967 - DNA, 23 bp, Artificial Sequence
  HLA-A targeting gRNA
cctgggcctctcccggggcaagg

SEQ ID NO: 968 - DNA, 23 bp, Artificial Sequence
  HLA-A targeting gRNA
ccttgccccgggagaggcccagg

SEQ ID NO: 969 - DNA, 23 bp, Artificial Sequence
  HLA-A targeting gRNA
cgagacccttgccccgggagagg

SEQ ID NO: 970 - DNA, 23 bp, Artificial Sequence
  HLA-A targeting gRNA
ctctcccggggcaagggtctcgg

SEQ ID NO: 971 - DNA, 23 bp, Artificial Sequence
  HLA-A targeting gRNA
ctgggcctctcccggggcaaggg

SEQ ID NO: 972 - DNA, 23 bp, Artificial Sequence
  HLA-A targeting gRNA
cccaacacccaacacacatcagg

SEQ ID NO: 973 - DNA, 23 bp, Artificial Sequence
  HLA-A targeting gRNA
cctgatgtgtgttgggtgttggg

SEQ ID NO: 974 - DNA, 23 bp, Artificial Sequence
  HLA-A targeting gRNA
gcctgatgtgtgttgggtgttgg

SEQ ID NO: 975 - DNA, 23 bp, Artificial Sequence
  HLA-A targeting gRNA
tggagggcctgatgtgtgttggg

SEQ ID NO: 976 - DNA, 23 bp, Artificial Sequence
  HLA-A targeting gRNA
ctcccggggcaagggtctcgggg

SEQ ID NO: 977 - DNA, 23 bp, Artificial Sequence
  HLA-A targeting gRNA
gaccccgagacccttgccccggg

SEQ ID NO: 978 - DNA, 23 bp, Artificial Sequence
  HLA-A targeting gRNA
gcaagggtctcggggtcccgcgg

SEQ ID NO: 979 - DNA, 23 bp, Artificial Sequence
  HLA-A targeting gRNA
ggaccccgagacccttgccccgg

SEQ ID NO: 980 - DNA, 23 bp, Artificial Sequence
  HLA-A targeting gRNA
tctcccggggcaagggtctcggg

SEQ ID NO: 981 - DNA, 23 bp, Artificial Sequence
  HLA-A targeting gRNA
aggcgcctgggcctctcccgggg

SEQ ID NO: 982 - DNA, 23 bp, Artificial Sequence
  HLA-A targeting gRNA
ctccctccttttctatctgtggg

SEQ ID NO: 983 - DNA, 23 bp, Artificial Sequence
  HLA-A targeting gRNA
cttcccacagatagaaaaggagg

SEQ ID NO: 984 - DNA, 23 bp, Artificial Sequence
  HLA-A targeting gRNA
ttcccacagatagaaaaggaggg

SEQ ID NO: 985 - DNA, 23 bp, Artificial Sequence
  HLA-A targeting gRNA
tttcttcccacagatagaaaagg

SEQ ID NO: 986 - DNA, 23 bp, Artificial Sequence
  HLA-A targeting gRNA
aaccactcatcagtattcgaggg

SEQ ID NO: 987 - DNA, 23 bp, Artificial Sequence
  HLA-A targeting gRNA
atccctcgaatactgatgagtgg

SEQ ID NO: 988 - DNA, 23 bp, Artificial Sequence
  HLA-A targeting gRNA
gaaccactcatcagtattcgagg

SEQ ID NO: 989 - DNA, 23 bp, Artificial Sequence
  HLA-A targeting gRNA
gaggaaaagtcacgggcccaagg

SEQ ID NO: 990 - DNA, 23 bp, Artificial Sequence
  HLA-A targeting gRNA
ggcccgtgacttttcctctcagg

SEQ ID NO: 991 - DNA, 23 bp, Artificial Sequence
  HLA-A targeting gRNA
ggcctgagaggaaaagtcacggg

SEQ ID NO: 992 - DNA, 23 bp, Artificial Sequence
  HLA-A targeting gRNA
aaacatgaagaaagcaggtgtgg

SEQ ID NO: 993 - DNA, 23 bp, Artificial Sequence
  HLA-A targeting gRNA
aacatgaagaaagcaggtgtggg

SEQ ID NO: 994 - DNA, 23 bp, Artificial Sequence
  HLA-A targeting gRNA
aagaaagcaggtgtgggtcctgg

SEQ ID NO: 995 - DNA, 23 bp, Artificial Sequence
  HLA-A targeting gRNA
gtcacaggggaaggtccctgagg

SEQ ID NO: 996 - DNA, 23 bp, Artificial Sequence
  HLA-A targeting gRNA
tcaggaaacatgaagaaagcagg

SEQ ID NO: 997 - DNA, 23 bp, Artificial Sequence
  HLA-A targeting gRNA
aaaggcgcctgggcctctcccgg

SEQ ID NO: 998 - DNA, 23 bp, Artificial Sequence
  HLA-A targeting gRNA
tggaggaggaagagctcaggtgg

SEQ ID NO: 999 - DNA, 23 bp, Artificial Sequence
  HLA-A targeting gRNA
ttaagggataaaatctctgaagg

SEQ ID NO: 1000 - DNA, 23 bp, Artificial Sequence
  HLA-A targeting gRNA
cacgatggggatggtgggctggg

SEQ ID NO: 1001 - DNA, 23 bp, Artificial Sequence
  HLA-A targeting gRNA
ccacgatggggatggtgggctgg

SEQ ID NO: 1002 - DNA, 23 bp, Artificial Sequence
  HLA-A targeting gRNA
gtgagacagctgccttgtgtggg

SEQ ID NO: 1003 - DNA, 23 bp, Artificial Sequence
  HLA-A targeting gRNA
tgtgagacagctgccttgtgtgg

SEQ ID NO: 1004 - DNA, 23 bp, Artificial Sequence
  HLA-A targeting gRNA
aatctgtccttcattttaacagg

SEQ ID NO: 1005 - DNA, 23 bp, Artificial Sequence
  HLA-A targeting gRNA
taaagcacctgttaaaatgaagg

SEQ ID NO: 1006 - DNA, 23 bp, Artificial Sequence
  HLA-A targeting gRNA
ctgaaaatgaaaccgggtaaagg

SEQ ID NO: 1007 - DNA, 23 bp, Artificial Sequence
  HLA-A targeting gRNA
ctgccttgtgtgggactgagagg

SEQ ID NO: 1008 - DNA, 23 bp, Artificial Sequence
  HLA-A targeting gRNA
ttgcctctcagtcccacacaagg

SEQ ID NO: 1009 - DNA, 23 bp, Artificial Sequence
  HLA-A targeting gRNA
gaggcccaggcgcctttacccgg

SEQ ID NO: 1010 - DNA, 23 bp, Artificial Sequence
  HLA-A targeting gRNA
gaaaccgggtaaaggcgcctggg

SEQ ID NO: 1011 - DNA, 23 bp, Artificial Sequence
  HLA-A targeting gRNA
tgaaaccgggtaaaggcgcctgg

SEQ ID NO: 1012 - DNA, 23 bp, Artificial Sequence
  HLA-A targeting gRNA
gcgcccgcggctccatcctctgg

SEQ ID NO: 1013 - DNA, 23 bp, Artificial Sequence
  HLA-A targeting gRNA
acccgcccaggtctgggtcaggg

SEQ ID NO: 1014 - DNA, 23 bp, Artificial Sequence
  HLA-A targeting gRNA
cacccgcccaggtctgggtcagg

SEQ ID NO: 1015 - DNA, 23 bp, Artificial Sequence
  HLA-A targeting gRNA
cagacctgggcgggtgagtgcgg

SEQ ID NO: 1016 - DNA, 23 bp, Artificial Sequence
  HLA-A targeting gRNA
cgcactcacccgcccaggtctgg

SEQ ID NO: 1017 - DNA, 23 bp, Artificial Sequence
  HLA-A targeting gRNA
gaccccgcactcacccgcccagg

SEQ ID NO: 1018 - DNA, 23 bp, Artificial Sequence
  HLA-A targeting gRNA
gacctgggcgggtgagtgcgggg

SEQ ID NO: 1019 - DNA, 23 bp, Artificial Sequence
  HLA-A targeting gRNA
gcactcacccgcccaggtctggg

SEQ ID NO: 1020 - DNA, 23 bp, Artificial Sequence
  HLA-A targeting gRNA
gccctgacccagacctgggcggg

SEQ ID NO: 1021 - DNA, 23 bp, Artificial Sequence
  HLA-A targeting gRNA
agacctgggcgggtgagtgcggg

SEQ ID NO: 1022 - DNA, 23 bp, Artificial Sequence
  HLA-A targeting gRNA
atgtttcctgatcccgccctggg

SEQ ID NO: 1023 - DNA, 23 bp, Artificial Sequence
  HLA-A targeting gRNA
catgtttcctgatcccgccctgg

SEQ ID NO: 1024 - DNA, 23 bp, Artificial Sequence
  HLA-A targeting gRNA
gtgtgactgcagacccagggcgg

SEQ ID NO: 1025 - DNA, 23 bp, Artificial Sequence
  HLA-A targeting gRNA
tgcagacccagggcgggatcagg

SEQ ID NO: 1026 - DNA, 23 bp, Artificial Sequence
  HLA-A targeting gRNA
tgtgactgcagacccagggcggg

SEQ ID NO: 1027 - DNA, 23 bp, Artificial Sequence
  HLA-A targeting gRNA
cgtgggcatcattgctggcctgg

SEQ ID NO: 1028 - DNA, 23 bp, Artificial Sequence
  HLA-A targeting gRNA
agtagccgcgcagggtccccagg

SEQ ID NO: 1029 - DNA, 23 bp, Artificial Sequence
  HLA-A targeting gRNA
tcatcccccacggacgggccagg

SEQ ID NO: 1030 - DNA, 23 bp, Artificial Sequence
  HLA-A targeting gRNA
gcgatcagggaggcgccccgtgg

SEQ ID NO: 1031 - DNA, 23 bp, Artificial Sequence
  HLA-A targeting gRNA
tctggttgtagtagccgcgcagg

SEQ ID NO: 1032 - DNA, 23 bp, Artificial Sequence
  HLA-A targeting gRNA
gtgaccccggcccggggcgcagg

SEQ ID NO: 1033 - DNA, 23 bp, Artificial Sequence
  HLA-A targeting gRNA
caagtcacaaagggaagggcagg

SEQ ID NO: 1034 - DNA, 23 bp, Artificial Sequence
  HLA-A targeting gRNA
cggtgagtgaccccggcccgggg

SEQ ID NO: 1035 - DNA, 23 bp, Artificial Sequence
  HLA-A targeting gRNA
cgtgacctgcgccccgggccggg

SEQ ID NO: 1036 - DNA, 23 bp, Artificial Sequence
  HLA-A targeting gRNA
gtgacctgcgccccgggccgggg

SEQ ID NO: 1037 - DNA, 23 bp, Artificial Sequence
  HLA-A targeting gRNA
tcgtgacctgcgccccgggccgg

SEQ ID NO: 1038 - DNA, 23 bp, Artificial Sequence
  HLA-A targeting gRNA
gatgtgtgttgggtgttgggcgg

SEQ ID NO: 1039 - DNA, 23 bp, Artificial Sequence
  HLA-A targeting gRNA
tagaggaggaattgtggggtggg

SEQ ID NO: 1040 - DNA, 23 bp, Artificial Sequence
  HLA-A targeting gRNA
cgagctccgtgtcctgggtctgg

SEQ ID NO: 1041 - DNA, 23 bp, Artificial Sequence
  HLA-A targeting gRNA
ctccacgagctccgtgtcctggg

SEQ ID NO: 1042 - DNA, 23 bp, Artificial Sequence
  HLA-A targeting gRNA
tctccacgagctccgtgtcctgg

SEQ ID NO: 1043 - DNA, 23 bp, Artificial Sequence
  HLA-A targeting gRNA
gggaggcgccccgtggcccctgg

SEQ ID NO: 1044 - DNA, 23 bp, Artificial Sequence
  HLA-A targeting gRNA
ggagtggctccgcagatacctgg

SEQ ID NO: 1045 - DNA, 23 bp, Artificial Sequence
  HLA-A targeting gRNA
ctcgtggagaccaggcctgcagg

SEQ ID NO: 1046 - DNA, 23 bp, Artificial Sequence
  HLA-A targeting gRNA
agtggacacagctgtgctatggg

SEQ ID NO: 1047 - DNA, 23 bp, Artificial Sequence
  HLA-A targeting gRNA
cagtggacacagctgtgctatgg

SEQ ID NO: 1048 - DNA, 23 bp, Artificial Sequence
  HLA-A targeting gRNA
ggtagaacaaaaacagaacctgg

SEQ ID NO: 1049 - DNA, 23 bp, Artificial Sequence
  HLA-A targeting gRNA
gtggacacagctgtgctatgggg

SEQ ID NO: 1050 - DNA, 23 bp, Artificial Sequence
  HLA-A targeting gRNA
ttctgtttttgttctaccccagg

SEQ ID NO: 1051 - DNA, 23 bp, Artificial Sequence
  HLA-A targeting gRNA
atattgtgtttgggagcccatgg

SEQ ID NO: 1052 - DNA, 23 bp, Artificial Sequence
  HLA-A targeting gRNA
attgtgtttgggagcccatgggg

SEQ ID NO: 1053 - DNA, 23 bp, Artificial Sequence
  HLA-A targeting gRNA
tattgtgtttgggagcccatggg

SEQ ID NO: 1054 - DNA, 23 bp, Artificial Sequence
  HLA-A targeting gRNA
ttgtgtttgggagcccatggggg

SEQ ID NO: 1055 - DNA, 23 bp, Artificial Sequence
  HLA-A targeting gRNA
tcttcaagtcacaaagggaaggg

SEQ ID NO: 1056 - DNA, 23 bp, Artificial Sequence
  HLA-A targeting gRNA
ttcttcaagtcacaaagggaagg

SEQ ID NO: 1057 - DNA, 23 bp, Artificial Sequence
  HLA-A targeting gRNA
gtcactcaccggcctcgctctgg

SEQ ID NO: 1058 - DNA, 23 bp, Artificial Sequence
  HLA-A targeting gRNA
agccgcgccgggaggagggtcgg

SEQ ID NO: 1059 - DNA, 23 bp, Artificial Sequence
  HLA-A targeting gRNA
agggttcttcaagtcacaaaggg

SEQ ID NO: 1060 - DNA, 23 bp, Artificial Sequence
  HLA-A targeting gRNA
cagggttcttcaagtcacaaagg

SEQ ID NO: 1061 - DNA, 23 bp, Artificial Sequence
  HLA-A targeting gRNA
ggctctgggaaaagaggggaagg

SEQ ID NO: 1062 - DNA, 23 bp, Artificial Sequence
  HLA-A targeting gRNA
ggcgccatgacggccatcctcgg

SEQ ID NO: 1063 - DNA, 23 bp, Artificial Sequence
  HLA-A targeting gRNA
gctccctccttttctatctgtgg

SEQ ID NO: 1064 - DNA, 23 bp, Artificial Sequence
  HLA-A targeting gRNA
gggagaatctgagtcccggtggg

SEQ ID NO: 1065 - DNA, 23 bp, Artificial Sequence
  HLA-A targeting gRNA
cgggtgagtgcggggtcgggagg

SEQ ID NO: 1066 - DNA, 23 bp, Artificial Sequence
  HLA-A targeting gRNA
gggcgggtgagtgcggggtcggg

SEQ ID NO: 1067 - DNA, 23 bp, Artificial Sequence
  HLA-A targeting gRNA
gggtgagtgcggggtcgggaggg

SEQ ID NO: 1068 - DNA, 23 bp, Artificial Sequence
  HLA-A targeting gRNA
tgggcgggtgagtgcggggtcgg

SEQ ID NO: 1069 - DNA, 23 bp, Artificial Sequence
  HLA-A targeting gRNA
ggggagaatctgagtcccggtgg

SEQ ID NO: 1070 - DNA, 23 bp, Artificial Sequence
  HLA-A targeting gRNA
tctggggagaatctgagtcccgg

SEQ ID NO: 1071 - DNA, 23 bp, Artificial Sequence
  HLA-A targeting gRNA
tgagtcccggtgggtgcgtgcgg

SEQ ID NO: 1072 - DNA, 23 bp, Artificial Sequence
  HLA-A targeting gRNA
ccctgactttgtttctgcaaagg

SEQ ID NO: 1073 - DNA, 23 bp, Artificial Sequence
  HLA-A targeting gRNA
cctttgcagaaacaaagtcaggg

SEQ ID NO: 1074 - DNA, 23 bp, Artificial Sequence
  HLA-A targeting gRNA
gcctttgcagaaacaaagtcagg

SEQ ID NO: 1075 - DNA, 23 bp, Artificial Sequence
  HLA-A targeting gRNA
cgcctgtagatctcccgggctgg

SEQ ID NO: 1076 - DNA, 23 bp, Artificial Sequence
  HLA-A targeting gRNA
cgggagatctacaggcgatcagg

SEQ ID NO: 1077 - DNA, 23 bp, Artificial Sequence
  HLA-A targeting gRNA
ctgatcgcctgtagatctcccgg

SEQ ID NO: 1078 - DNA, 23 bp, Artificial Sequence
  HLA-A targeting gRNA
ggccagcccgggagatctacagg

SEQ ID NO: 1079 - DNA, 23 bp, Artificial Sequence
  HLA-A targeting gRNA
tgatcgcctgtagatctcccggg

SEQ ID NO: 1080 - DNA, 23 bp, Artificial Sequence
  HLA-A targeting gRNA
gccgcgccgggaggagggtcggg

SEQ ID NO: 1081 - DNA, 23 bp, Artificial Sequence
  HLA-A targeting gRNA
ccaggtcgcccacagtctccggg

SEQ ID NO: 1082 - DNA, 23 bp, Artificial Sequence
  HLA-A targeting gRNA
cccggagactgtgggcgacctgg

SEQ ID NO: 1083 - DNA, 23 bp, Artificial Sequence
  HLA-A targeting gRNA
gccaggtcgcccacagtctccgg

SEQ ID NO: 1084 - DNA, 23 bp, Artificial Sequence
  HLA-A targeting gRNA
tgagagacacatcagagccctgg

SEQ ID NO: 1085 - DNA, 23 bp, Artificial Sequence
  HLA-A targeting gRNA
gcgacctggcccgtccgtggggg

SEQ ID NO: 1086 - DNA, 23 bp, Artificial Sequence
  HLA-A targeting gRNA
ggcgacctggcccgtccgtgggg

SEQ ID NO: 1087 - DNA, 23 bp, Artificial Sequence
  HLA-A targeting gRNA
gggcgacctggcccgtccgtggg

SEQ ID NO: 1088 - DNA, 23 bp, Artificial Sequence
  HLA-A targeting gRNA
tgggcgacctggcccgtccgtgg

SEQ ID NO: 1089 - DNA, 23 bp, Artificial Sequence
  HLA-A targeting gRNA
gcgaggccggtgagtgaccccgg

SEQ ID NO: 1090 - DNA, 23 bp, Artificial Sequence
  HLA-A targeting gRNA
agatctacaggcgatcagggagg

SEQ ID NO: 1091 - DNA, 23 bp, Artificial Sequence
  HLA-A targeting gRNA
gcccgaccctcctcccggcgcgg

SEQ ID NO: 1092 - DNA, 23 bp, Artificial Sequence
  HLA-A targeting gRNA
gggagatctacaggcgatcaggg

SEQ ID NO: 1093 - DNA, 23 bp, Artificial Sequence
  HLA-A targeting gRNA
cgccctccctctggtcctgaggg

SEQ ID NO: 1094 - DNA, 23 bp, Artificial Sequence
  HLA-A targeting gRNA
ctagaatatcgccctccctctgg

SEQ ID NO: 1095 - DNA, 23 bp, Artificial Sequence
  HLA-A targeting gRNA
ggagggcgatattctagtgttgg

SEQ ID NO: 1096 - DNA, 23 bp, Artificial Sequence
  HLA-A targeting gRNA
tcgccctccctctggtcctgagg

SEQ ID NO: 1097 - DNA, 23 bp, Artificial Sequence
  HLA-A targeting gRNA
acggccatcctcggcgtctgggg

SEQ ID NO: 1098 - DNA, 23 bp, Artificial Sequence
  HLA-A targeting gRNA
gacggccatcctcggcgtctggg

SEQ ID NO: 1099 - DNA, 23 bp, Artificial Sequence
  HLA-A targeting gRNA
tgacggccatcctcggcgtctgg

SEQ ID NO: 1100 - DNA, 23 bp, Artificial Sequence
  HLA-A targeting gRNA
gacgccgaggatggccgtcatgg

SEQ ID NO: 1101 - DNA, 23 bp, Artificial Sequence
  HLA-A targeting gRNA
ttctccccagacgccgaggatgg

SEQ ID NO: 1102 - DNA, 23 bp, Artificial Sequence
  HLA-A targeting gRNA
cagattctccccagacgccgagg

SEQ ID NO: 1103 - DNA, 23 bp, Artificial Sequence
  HLA-A targeting gRNA
ctggaaacccgacacccaatggg

SEQ ID NO: 1104 - DNA, 23 bp, Artificial Sequence
  HLA-A targeting gRNA
tctggaaacccgacacccaatgg

SEQ ID NO: 1105 - DNA, 23 bp, Artificial Sequence
  HLA-A targeting gRNA
acacagggcccaggctgggtagg

SEQ ID NO: 1106 - DNA, 23 bp, Artificial Sequence
  HLA-A targeting gRNA
tctcactcccattgggtgtcggg

SEQ ID NO: 1107 - DNA, 23 bp, Artificial Sequence
  HLA-A targeting gRNA
ttctcactcccattgggtgtcgg

SEQ ID NO: 1108 - DNA, 23 bp, Artificial Sequence
  HLA-A targeting gRNA
aaagtccgcacgcacccaccggg

SEQ ID NO: 1109 - DNA, 23 bp, Artificial Sequence
  HLA-A targeting gRNA
taaagtccgcacgcacccaccgg

SEQ ID NO: 1110 - DNA, 23 bp, Artificial Sequence
  HLA-A targeting gRNA
cacccaatgggagtgagaactgg

SEQ ID NO: 1111 - DNA, 23 bp, Artificial Sequence
  HLA-A targeting gRNA
acccaatgggagtgagaactggg

SEQ ID NO: 1112 - DNA, 23 bp, Artificial Sequence
  HLA-A targeting gRNA
gtaggcataatgtgaggaggtgg

SEQ ID NO: 1113 - DNA, 23 bp, Artificial Sequence
  HLA-A targeting gRNA
taggcataatgtgaggaggtggg

SEQ ID NO: 1114 - DNA, 23 bp, Artificial Sequence
  HLA-A targeting gRNA
gcgaccgcgacgacactgattgg

SEQ ID NO: 1115 - DNA, 23 bp, Artificial Sequence
  HLA-A targeting gRNA
acccagttctcactcccattggg

SEQ ID NO: 1116 - DNA, 23 bp, Artificial Sequence
  HLA-A targeting gRNA
gacccagttctcactcccattgg

SEQ ID NO: 1117 - DNA, 23 bp, Artificial Sequence
  HLA-A targeting gRNA
aggcataatgtgaggaggtgggg

SEQ ID NO: 1118 - DNA, 23 bp, Artificial Sequence
  HLA-A targeting gRNA
gaagccaatcagtgtcgtcgcgg

SEQ ID NO: 1119 - DNA, 23 bp, Artificial Sequence
  HLA-A targeting gRNA
agcttgtaaaggtgagagcctgg

SEQ ID NO: 1120 - DNA, 23 bp, Artificial Sequence
  HLA-A targeting gRNA
atggacaggacacctgggatggg

SEQ ID NO: 1121 - DNA, 23 bp, Artificial Sequence
  HLA-A targeting gRNA
caacacacatcaggccctccagg

SEQ ID NO: 1122 - DNA, 23 bp, Artificial Sequence
  HLA-A targeting gRNA
ctggagggcctgatgtgtgttgg

SEQ ID NO: 1123 - DNA, 23 bp, Artificial Sequence
  HLA-A targeting gRNA
tggacaggacacctgggatgggg

SEQ ID NO: 1124 - DNA, 23 bp, Artificial Sequence
  HLA-A targeting gRNA
tgtaaaggtgagagcctggaggg

SEQ ID NO: 1125 - DNA, 23 bp, Artificial Sequence
  HLA-A targeting gRNA
ttgtaaaggtgagagcctggagg

SEQ ID NO: 1126 - DNA, 23 bp, Artificial Sequence
  HLA-A targeting gRNA
acgacactgattggcttctctgg

SEQ ID NO: 1127 - DNA, 23 bp, Artificial Sequence
  HLA-A targeting gRNA
gtgcggggtcgggagggaaacgg

SEQ ID NO: 1128 - DNA, 23 bp, Artificial Sequence
  HLA-A targeting gRNA
tctccgcagggtagaagctcagg

SEQ ID NO: 1129 - DNA, 23 bp, Artificial Sequence
  HLA-A targeting gRNA
gggatggtgggctgggaagacgg

SEQ ID NO: 1130 - DNA, 23 bp, Artificial Sequence
  HLA-A targeting gRNA
gtgggctgggaagacggctctgg

SEQ ID NO: 1131 - DNA, 23 bp, Artificial Sequence
  HLA-A targeting gRNA
tgggctgggaagacggctctggg

SEQ ID NO: 1132 - DNA, 23 bp, Artificial Sequence
  HLA-A targeting gRNA
aaaatctctgaaggaatgacggg

SEQ ID NO: 1133 - DNA, 23 bp, Artificial Sequence
  HLA-A targeting gRNA
aattcgtatctgtcacagtgagg

SEQ ID NO: 1134 - DNA, 23 bp, Artificial Sequence
  HLA-A targeting gRNA
aagtcgctgttccctcttcaggg

SEQ ID NO: 1135 - DNA, 23 bp, Artificial Sequence
  HLA-A targeting gRNA
aatggacaggacacctgggatgg

SEQ ID NO: 1136 - DNA, 23 bp, Artificial Sequence
  HLA-A targeting gRNA
acactcctccagcacacatgtgg

SEQ ID NO: 1137 - DNA, 23 bp, Artificial Sequence
  HLA-A targeting gRNA
acatgtggctatcttgagaatgg

SEQ ID NO: 1138 - DNA, 23 bp, Artificial Sequence
  HLA-A targeting gRNA
acggaataggagattatcccagg

SEQ ID NO: 1139 - DNA, 23 bp, Artificial Sequence
  HLA-A targeting gRNA
agcctctctgacctttagcaggg

SEQ ID NO: 1140 - DNA, 23 bp, Artificial Sequence
  HLA-A targeting gRNA
agctcagggcccagcacctcagg

SEQ ID NO: 1141 - DNA, 23 bp, Artificial Sequence
  HLA-A targeting gRNA
aggacacctgggatggggaaggg

SEQ ID NO: 1142 - DNA, 23 bp, Artificial Sequence
  HLA-A targeting gRNA
aggaccttcaggagggcggttgg

SEQ ID NO: 1143 - DNA, 23 bp, Artificial Sequence
  HLA-A targeting gRNA
aggcagggcacacttctacctgg

SEQ ID NO: 1144 - DNA, 23 bp, Artificial Sequence
  HLA-A targeting gRNA
agtgtgccctgcctcgttactgg

SEQ ID NO: 1145 - DNA, 23 bp, Artificial Sequence
  HLA-A targeting gRNA
caagacttggaggttcctctagg

SEQ ID NO: 1146 - DNA, 23 bp, Artificial Sequence
  HLA-A targeting gRNA
caagatagccacatgtgtgctgg

SEQ ID NO: 1147 - DNA, 23 bp, Artificial Sequence
  HLA-A targeting gRNA
cactgagggttccaagacccagg

SEQ ID NO: 1148 - DNA, 23 bp, Artificial Sequence
  HLA-A targeting gRNA
caggacacctgggatggggaagg

SEQ ID NO: 1149 - DNA, 23 bp, Artificial Sequence
  HLA-A targeting gRNA
ccgccctcctgaaggtcctcagg

SEQ ID NO: 1150 - DNA, 23 bp, Artificial Sequence
  HLA-A targeting gRNA
cctgaggaccttcaggagggcgg

SEQ ID NO: 1151 - DNA, 23 bp, Artificial Sequence
  HLA-A targeting gRNA
cgccctcctgaaggtcctcaggg

SEQ ID NO: 1152 - DNA, 23 bp, Artificial Sequence
  HLA-A targeting gRNA
ctagaggaacctccaagtcttgg

SEQ ID NO: 1153 - DNA, 23 bp, Artificial Sequence
  HLA-A targeting gRNA
ctctgacctttagcagggtcagg

SEQ ID NO: 1154 - DNA, 23 bp, Artificial Sequence
  HLA-A targeting gRNA
ctctgaggtccaagacttggagg

SEQ ID NO: 1155 - DNA, 23 bp, Artificial Sequence
  HLA-A targeting gRNA
cttctctgaggtccaagacttgg

SEQ ID NO: 1156 - DNA, 23 bp, Artificial Sequence
  HLA-A targeting gRNA
gaagagggaacagcgacttctgg

SEQ ID NO: 1157 - DNA, 23 bp, Artificial Sequence
  HLA-A targeting gRNA
gaaggtccctgaggaccttcagg

SEQ ID NO: 1158 - DNA, 23 bp, Artificial Sequence
  HLA-A targeting gRNA
gaagtcgctgttccctcttcagg

SEQ ID NO: 1159 - DNA, 23 bp, Artificial Sequence
  HLA-A targeting gRNA
gaccctgctaaaggtcagagagg

SEQ ID NO: 1160 - DNA, 23 bp, Artificial Sequence
  HLA-A targeting gRNA
gagcctctctgacctttagcagg

SEQ ID NO: 1161 - DNA, 23 bp, Artificial Sequence
  HLA-A targeting gRNA
gaggaggaagagctcaggtgggg

SEQ ID NO: 1162 - DNA, 23 bp, Artificial Sequence
  HLA-A targeting gRNA
gatagccacatgtgtgctggagg

SEQ ID NO: 1163 - DNA, 23 bp, Artificial Sequence
  HLA-A targeting gRNA
gcacacttctacctgggtcttgg

SEQ ID NO: 1164 - DNA, 23 bp, Artificial Sequence
  HLA-A targeting gRNA
ggaggaggaagagctcaggtggg

SEQ ID NO: 1165 - DNA, 23 bp, Artificial Sequence
  HLA-A targeting gRNA
ggcagggcacacttctacctggg

SEQ ID NO: 1166 - DNA, 23 bp, Artificial Sequence
  HLA-A targeting gRNA
ggtccctgaggaccttcaggagg

SEQ ID NO: 1167 - DNA, 23 bp, Artificial Sequence
  HLA-A targeting gRNA
gtccctgaggaccttcaggaggg

SEQ ID NO: 1168 - DNA, 23 bp, Artificial Sequence
  HLA-A targeting gRNA
gtgcttcccagtaacgaggcagg

SEQ ID NO: 1169 - DNA, 23 bp, Artificial Sequence
  HLA-A targeting gRNA
gtgtgccctgcctcgttactggg

SEQ ID NO: 1170 - DNA, 23 bp, Artificial Sequence
  HLA-A targeting gRNA
tctgacctttagcagggtcaggg

SEQ ID NO: 1171 - DNA, 23 bp, Artificial Sequence
  HLA-A targeting gRNA
tgcttcccagtaacgaggcaggg

SEQ ID NO: 1172 - DNA, 23 bp, Artificial Sequence
  HLA-A targeting gRNA
tggaccaaccgccctcctgaagg

SEQ ID NO: 1173 - DNA, 23 bp, Artificial Sequence
  HLA-A targeting gRNA
tggctatcttgagaatggacagg

SEQ ID NO: 1174 - DNA, 23 bp, Artificial Sequence
  HLA-A targeting gRNA
tgggataatctcctattccgtgg

SEQ ID NO: 1175 - DNA, 23 bp, Artificial Sequence
  HLA-A targeting gRNA
tgtgctcccttccccatcccagg

SEQ ID NO: 1176 - DNA, 23 bp, Artificial Sequence
  HLA-A targeting gRNA
tgtggtggtgccttctggacagg

SEQ ID NO: 1177 - DNA, 23 bp, Artificial Sequence
  HLA-A targeting gRNA
ttcaggagggcggttggtccagg

SEQ ID NO: 1178 - DNA, 23 bp, Artificial Sequence
  HLA-A targeting gRNA
ttgagaatggacaggacacctgg

SEQ ID NO: 1179 - DNA, 23 bp, Artificial Sequence
  HLA-A targeting gRNA
tgagaatggacaggacacctggg

SEQ ID NO: 1180 - DNA, 23 bp, Artificial Sequence
  HLA-A targeting gRNA
aagacggctctgggaaaagaggg

SEQ ID NO: 1181 - DNA, 23 bp, Artificial Sequence
  HLA-A targeting gRNA
agacggctctgggaaaagagggg

SEQ ID NO: 1182 - DNA, 23 bp, Artificial Sequence
  HLA-A targeting gRNA
gaagacggctctgggaaaagagg

SEQ ID NO: 1183 - DNA, 23 bp, Artificial Sequence
  HLA-A targeting gRNA
catttctggaaacttctctgagg

SEQ ID NO: 1184 - DNA, 23 bp, Artificial Sequence
  HLA-A targeting gRNA
taaaatctctgaaggaatgacgg

SEQ ID NO: 1185 - DNA, 23 bp, Artificial Sequence
  HLA-A targeting gRNA
aaaattctagtccctgaagaggg

SEQ ID NO: 1186 - DNA, 23 bp, Artificial Sequence
  HLA-A targeting gRNA
actagaattttccacggaatagg

SEQ ID NO: 1187 - DNA, 23 bp, Artificial Sequence
  HLA-A targeting gRNA
gaaaattctagtccctgaagagg

SEQ ID NO: 1188 - DNA, 23 bp, Artificial Sequence
  HLA-A targeting gRNA
tcagggactagaattttccacgg

SEQ ID NO: 1189 - DNA, 23 bp, Artificial Sequence
  HLA-A targeting gRNA
aaccctcgtcctgctactctcgg

SEQ ID NO: 1190 - DNA, 23 bp, Artificial Sequence
  HLA-A targeting gRNA
accctcgtcctgctactctcggg

SEQ ID NO: 1191 - DNA, 23 bp, Artificial Sequence
  HLA-A targeting gRNA
agagtagcaggacgagggttcgg

SEQ ID NO: 1192 - DNA, 23 bp, Artificial Sequence
  HLA-A targeting gRNA
cccccgagagtagcaggacgagg

SEQ ID NO: 1193 - DNA, 23 bp, Artificial Sequence
  HLA-A targeting gRNA
gagtagcaggacgagggttcggg

SEQ ID NO: 1194 - DNA, 23 bp, Artificial Sequence
  HLA-A targeting gRNA
gccggtgagtgaccccggcccgg

SEQ ID NO: 1195 - DNA, 23 bp, Artificial Sequence
  HLA-A targeting gRNA
cccgggccggggtcactcaccgg

SEQ ID NO: 1196 - DNA, 23 bp, Artificial Sequence
  HLA-A targeting gRNA
ccggtgagtgaccccggcccggg

SEQ ID NO: 1197 - DNA, 23 bp, Artificial Sequence
  HLA-A targeting gRNA
ggggtgggtgagctcccccatgg

SEQ ID NO: 1198 - DNA, 23 bp, Artificial Sequence
  HLA-A targeting gRNA
gggtgggtgagctcccccatggg

SEQ ID NO: 1199 - DNA, 23 bp, Artificial Sequence
  HLA-A targeting gRNA
ggtccgcgtcgtgagtatccagg

SEQ ID NO: 1200 - DNA, 23 bp, Artificial Sequence
  HLA-A targeting gRNA
tcatgtcttttagggaaagcagg

SEQ ID NO: 1201 - DNA, 23 bp, Artificial Sequence
  HLA-A targeting gRNA
actccacgcacgtgccctccagg

SEQ ID NO: 1202 - DNA, 23 bp, Artificial Sequence
  HLA-A targeting gRNA
ccaccacagccgcccacttctgg

SEQ ID NO: 1203 - DNA, 23 bp, Artificial Sequence
  HLA-A targeting gRNA
cttccagaagtgggcggctgtgg

SEQ ID NO: 1204 - DNA, 23 bp, Artificial Sequence
  HLA-A targeting gRNA
gcggctgtggtggtgccttctgg

SEQ ID NO: 1205 - DNA, 23 bp, Artificial Sequence
  HLA-A targeting gRNA
agaaaagaaactgcggagttggg

SEQ ID NO: 1206 - DNA, 23 bp, Artificial Sequence
  HLA-A targeting gRNA
gaaaagaaactgcggagttgggg

SEQ ID NO: 1207 - DNA, 23 bp, Artificial Sequence
  HLA-A targeting gRNA
gagaaaagaaactgcggagttgg

SEQ ID NO: 1208 - DNA, 23 bp, Artificial Sequence
  HLA-A targeting gRNA
ggtcatggtggacatgggggtgg

SEQ ID NO: 1209 - DNA, 23 bp, Artificial Sequence
  HLA-A targeting gRNA
gtcatggtggacatgggggtggg

SEQ ID NO: 1210 - DNA, 23 bp, Artificial Sequence
  HLA-A targeting gRNA
tcatggtggacatgggggtgggg

SEQ ID NO: 1211 - DNA, 23 bp, Artificial Sequence
  HLA-A targeting gRNA
gcggagttggggaatccccaagg

SEQ ID NO: 1212 - DNA, 23 bp, Artificial Sequence
  HLA-A targeting gRNA
gcgccgggaggagggtcgggcgg

SEQ ID NO: 1213 - DNA, 23 bp, Artificial Sequence
  HLA-A targeting gRNA
ggtcggggcggggcggggctcgg

SEQ ID NO: 1214 - DNA, 23 bp, Artificial Sequence
  HLA-A targeting gRNA
gtcggggcggggcggggctcggg

SEQ ID NO: 1215 - DNA, 23 bp, Artificial Sequence
  HLA-A targeting gRNA
tcggggcggggcggggctcgggg

SEQ ID NO: 1216 - DNA, 23 bp, Artificial Sequence
  HLA-A targeting gRNA
cggggcggggcggggctcggggg

SEQ ID NO: 1217 - DNA, 23 bp, Artificial Sequence
  HLA-A targeting gRNA
aattatgggcctacccagcctgg

SEQ ID NO: 1218 - DNA, 23 bp, Artificial Sequence
  HLA-A targeting gRNA
attatgggcctacccagcctggg

SEQ ID NO: 1219 - DNA, 23 bp, Artificial Sequence
  HLA-A targeting gRNA
gctgggtaggcccataattgtgg

SEQ ID NO: 1220 - DNA, 23 bp, Artificial Sequence
  HLA-A targeting gRNA
ggagcagttgagagcctacctgg

SEQ ID NO: 1221 - DNA, 23 bp, Artificial Sequence
  HLA-A targeting gRNA
gagagccacgcctggggccctgg

SEQ ID NO: 1222 - DNA, 23 bp, Artificial Sequence
  HLA-A targeting gRNA
agttggggaatccccaaggctgg

SEQ ID NO: 1223 - DNA, 23 bp, Artificial Sequence
  HLA-A targeting gRNA
gttggggaatccccaaggctggg

SEQ ID NO: 1224 - DNA, 23 bp, Artificial Sequence
  HLA-A targeting gRNA
attggggagtcccagccttgggg

SEQ ID NO: 1225 - DNA, 23 bp, Artificial Sequence
  HLA-A targeting gRNA
gattggggagtcccagccttggg

SEQ ID NO: 1226 - DNA, 23 bp, Artificial Sequence
  HLA-A targeting gRNA
tggtggacatgggggtggggtgg

SEQ ID NO: 1227 - DNA, 23 bp, Artificial Sequence
  HLA-A targeting gRNA
ggattggggagtcccagccttgg

SEQ ID NO: 1228 - DNA, 23 bp, Artificial Sequence
  HLA-A targeting gRNA
aagtcccagggccccaggcgtgg

SEQ ID NO: 1229 - DNA, 23 bp, Artificial Sequence
  HLA-A targeting gRNA
agagccacgcctggggccctggg

SEQ ID NO: 1230 - DNA, 23 bp, Artificial Sequence
  HLA-A targeting gRNA
aagagcgcaggtcctctttcagg

SEQ ID NO: 1231 - DNA, 23 bp, Artificial Sequence
  HLA-A targeting gRNA
agagcgcaggtcctctttcaggg

SEQ ID NO: 1232 - DNA, 23 bp, Artificial Sequence
  HLA-A targeting gRNA
gagagggagaaaagaaactgcgg

SEQ ID NO: 1233 - DNA, 23 bp, Artificial Sequence
  HLA-A targeting gRNA
tgaaagaggacctgcgctcttgg

SEQ ID NO: 1234 - DNA, 23 bp, Artificial Sequence
  HLA-A targeting gRNA
gggcgaagtcccagggccccagg

SEQ ID NO: 1235 - DNA, 23 bp, Artificial Sequence
  HLA-A targeting gRNA
caatccatacaccgccttcgggg

SEQ ID NO: 1236 - DNA, 23 bp, Artificial Sequence
  HLA-A targeting gRNA
caggccccgaaggcggtgtatgg

SEQ ID NO: 1237 - DNA, 23 bp, Artificial Sequence
  HLA-A targeting gRNA
ccaatccatacaccgccttcggg

SEQ ID NO: 1238 - DNA, 23 bp, Artificial Sequence
  HLA-A targeting gRNA
cccaatccatacaccgccttcgg

SEQ ID NO: 1239 - DNA, 23 bp, Artificial Sequence
  HLA-A targeting gRNA
cccgaaggcggtgtatggattgg

SEQ ID NO: 1240 - DNA, 23 bp, Artificial Sequence
  HLA-A targeting gRNA
ccgaaggcggtgtatggattggg

SEQ ID NO: 1241 - DNA, 23 bp, Artificial Sequence
  HLA-A targeting gRNA
cgaaggcggtgtatggattgggg

SEQ ID NO: 1242 - DNA, 23 bp, Artificial Sequence
  HLA-A targeting gRNA
aggggtcagggcgaagtcccagg

SEQ ID NO: 1243 - DNA, 23 bp, Artificial Sequence
  HLA-A targeting gRNA
ggggtcagggcgaagtcccaggg

SEQ ID NO: 1244 - DNA, 23 bp, Artificial Sequence
  HLA-A targeting gRNA
agaccctgagagccacgcctggg

SEQ ID NO: 1245 - DNA, 23 bp, Artificial Sequence
  HLA-A targeting gRNA
agggtctcaggccccgaaggcgg

SEQ ID NO: 1246 - DNA, 23 bp, Artificial Sequence
  HLA-A targeting gRNA
ctcagggtctcaggccccgaagg

SEQ ID NO: 1247 - DNA, 23 bp, Artificial Sequence
  HLA-A targeting gRNA
gaccctgagagccacgcctgggg

SEQ ID NO: 1248 - DNA, 23 bp, Artificial Sequence
  HLA-A targeting gRNA
gagaccctgagagccacgcctgg

SEQ ID NO: 1249 - DNA, 23 bp, Artificial Sequence
  HLA-A targeting gRNA
ggccccaggcgtggctctcaggg

SEQ ID NO: 1250 - DNA, 23 bp, Artificial Sequence
  HLA-A targeting gRNA
ggcgtggctctcagggtctcagg

SEQ ID NO: 1251 - DNA, 23 bp, Artificial Sequence
  HLA-A targeting gRNA
gggccccaggcgtggctctcagg

SEQ ID NO: 1252 - DNA, 23 bp, Artificial Sequence
  HLA-A targeting gRNA
gacccgcccgaccctcctcccgg

SEQ ID NO: 1253 - DNA, 23 bp, Artificial Sequence
  HLA-A targeting gRNA
cgccgggaggagggtcgggcggg

SEQ ID NO: 1254 - DNA, 23 bp, Artificial Sequence
  HLA-A targeting gRNA
acgggggtgtcatgtcttttagg

SEQ ID NO: 1255 - DNA, 23 bp, Artificial Sequence
  HLA-A targeting gRNA
agatggggtaaggagggagacgg

SEQ ID NO: 1256 - DNA, 23 bp, Artificial Sequence
  HLA-A targeting gRNA
aggaagagctcaggtggggaagg

SEQ ID NO: 1257 - DNA, 23 bp, Artificial Sequence
  HLA-A targeting gRNA
atggggtaaggagggagacgggg

SEQ ID NO: 1258 - DNA, 23 bp, Artificial Sequence
  HLA-A targeting gRNA
cgggggtgtcatgtcttttaggg

SEQ ID NO: 1259 - DNA, 23 bp, Artificial Sequence
  HLA-A targeting gRNA
gatggggtaaggagggagacggg

SEQ ID NO: 1260 - DNA, 23 bp, Artificial Sequence
  HLA-A targeting gRNA
ggaagagctcaggtggggaaggg

SEQ ID NO: 1261 - DNA, 23 bp, Artificial Sequence
  HLA-A targeting gRNA
tggggtaaggagggagacggggg

SEQ ID NO: 1262 - DNA, 23 bp, Artificial Sequence
  HLA-A targeting gRNA
cggggcggggctcgggggaccgg

SEQ ID NO: 1263 - DNA, 23 bp, Artificial Sequence
  HLA-A targeting gRNA
cgggagggaaacggcctctgtgg

SEQ ID NO: 1264 - DNA, 23 bp, Artificial Sequence
  HLA-A targeting gRNA
ggagggaaacggcctctgtgggg

SEQ ID NO: 1265 - DNA, 23 bp, Artificial Sequence
  HLA-A targeting gRNA
gggagggaaacggcctctgtggg

SEQ ID NO: 1266 - DNA, 23 bp, Artificial Sequence
  HLA-A targeting gRNA
ggggcggggctcgggggaccggg

SEQ ID NO: 1267 - DNA, 23 bp, Artificial Sequence
  HLA-A targeting gRNA
ggggtcccgcggcttcggggcgg

SEQ ID NO: 1268 - DNA, 23 bp, Artificial Sequence
  HLA-A targeting gRNA
cgagatccgccccgaagccgcgg

SEQ ID NO: 1269 - DNA, 23 bp, Artificial Sequence
  HLA-A targeting gRNA
cgcggcttcggggcggatctcgg

SEQ ID NO: 1270 - DNA, 23 bp, Artificial Sequence
  HLA-A targeting gRNA
gagatccgccccgaagccgcggg

SEQ ID NO: 1271 - DNA, 23 bp, Artificial Sequence
  HLA-A targeting gRNA
ttcggggcggatctcggacccgg

SEQ ID NO: 1272 - DNA, 23 bp, Artificial Sequence
  HLA-A targeting gRNA
attgctggcctggttctctttgg

SEQ ID NO: 1273 - DNA, 23 bp, Artificial Sequence
  HLA-A targeting gRNA
gcgtgggaagagggtcatggtgg

SEQ ID NO: 1274 - DNA, 23 bp, Artificial Sequence
  HLA-A targeting gRNA
tcagcgtgggaagagggtcatgg

SEQ ID NO: 1275 - DNA, 23 bp, Artificial Sequence
  HLA-A targeting gRNA
cacaggtcagcgtgggaagaggg

SEQ ID NO: 1276 - DNA, 23 bp, Artificial Sequence
  HLA-A targeting gRNA
gcacaggtcagcgtgggaagagg

SEQ ID NO: 1277 - DNA, 23 bp, Artificial Sequence
  HLA-A targeting gRNA
ccttgccgtcgtaggcgtactgg

SEQ ID NO: 1278 - DNA, 23 bp, Artificial Sequence
  HLA-A targeting gRNA
aatcagtgtcgtcgcggtcgcgg

SEQ ID NO: 1279 - DNA, 23 bp, Artificial Sequence
  HLA-A targeting gRNA
caggaagaaggaccctacatagg

SEQ ID NO: 1280 - DNA, 23 bp, Artificial Sequence
  HLA-A targeting gRNA
ctatgtagggtccttcttcctgg

SEQ ID NO: 1281 - DNA, 23 bp, Artificial Sequence
  HLA-A targeting gRNA
cttcctggatactcacgacgcgg

SEQ ID NO: 1282 - DNA, 23 bp, Artificial Sequence
  HLA-A targeting gRNA
gtcgtgagtatccaggaagaagg

SEQ ID NO: 1283 - DNA, 23 bp, Artificial Sequence
  HLA-A targeting gRNA
aagagggtcatggtggacatggg

SEQ ID NO: 1284 - DNA, 23 bp, Artificial Sequence
  HLA-A targeting gRNA
agagggtcatggtggacatgggg

SEQ ID NO: 1285 - DNA, 23 bp, Artificial Sequence
  HLA-A targeting gRNA
gagggtcatggtggacatggggg

SEQ ID NO: 1286 - DNA, 23 bp, Artificial Sequence
  HLA-A targeting gRNA
acccgggaagccgcgccgggagg

SEQ ID NO: 1287 - DNA, 23 bp, Artificial Sequence
  HLA-A targeting gRNA
cgggaagccgcgccgggaggagg

SEQ ID NO: 1288 - DNA, 23 bp, Artificial Sequence
  HLA-A targeting gRNA
ctcctcccggcgcggcttcccgg

SEQ ID NO: 1289 - DNA, 23 bp, Artificial Sequence
  HLA-A targeting gRNA
gggaagccgcgccgggaggaggg

SEQ ID NO: 1290 - DNA, 23 bp, Artificial Sequence
  HLA-A targeting gRNA
tcctcccggcgcggcttcccggg

SEQ ID NO: 1291 - DNA, 23 bp, Artificial Sequence
  HLA-A targeting gRNA
acacgaacacagacacatgcagg

SEQ ID NO: 1292 - DNA, 23 bp, Artificial Sequence
  HLA-A targeting gRNA
gcatgtgtctgtgttcgtgtagg

SEQ ID NO: 1293 - DNA, 23 bp, Artificial Sequence
  HLA-A targeting gRNA
aagaaggaccctacataggttgg

SEQ ID NO: 1294 - DNA, 23 bp, Artificial Sequence
  HLA-A targeting gRNA
acctctcatcccccacggacggg

SEQ ID NO: 1295 - DNA, 23 bp, Artificial Sequence
  HLA-A targeting gRNA
gacctctcatcccccacggacgg

SEQ ID NO: 1296 - DNA, 23 bp, Artificial Sequence
  HLA-A targeting gRNA
gcccgtccgtgggggatgagagg

SEQ ID NO: 1297 - DNA, 23 bp, Artificial Sequence
  HLA-A targeting gRNA
tcacgacctctcatcccccacgg

SEQ ID NO: 1298 - DNA, 23 bp, Artificial Sequence
  HLA-A targeting gRNA
agaggtcgtgacctgcgccccgg

SEQ ID NO: 1299 - DNA, 23 bp, Artificial Sequence
  HLA-A targeting gRNA
gaggtcgtgacctgcgccccggg

SEQ ID NO: 1300 - DNA, 23 bp, Artificial Sequence
  HLA-A targeting gRNA
ttcacatccgtgtcccggcccgg

SEQ ID NO: 1301 - DNA, 23 bp, Artificial Sequence
  HLA-A targeting gRNA
ctcagccactcctcgtccccagg

SEQ ID NO: 1302 - DNA, 23 bp, Artificial Sequence
  HLA-A targeting gRNA
cgtgtaggcataatgtgaggagg

SEQ ID NO: 1303 - DNA, 23 bp, Artificial Sequence
  HLA-A targeting gRNA
gttcgtgtaggcataatgtgagg

SEQ ID NO: 1304 - DNA, 23 bp, Artificial Sequence
  HLA-A targeting gRNA
gaagagggtcatggtggacatgg

SEQ ID NO: 1305 - DNA, 23 bp, Artificial Sequence
  HLA-A targeting gRNA
gagggagcacaggtcagcgtggg

SEQ ID NO: 1306 - DNA, 23 bp, Artificial Sequence
  HLA-A targeting gRNA
attcgtatctgtcacagtgaggg

SEQ ID NO: 1307 - DNA, 23 bp, Artificial Sequence
  HLA-A targeting gRNA
cgcatgctcaatacatccaatgg

SEQ ID NO: 1308 - DNA, 23 bp, Artificial Sequence
  HLA-A targeting gRNA
gctatggggtttctttccattgg

SEQ ID NO: 1309 - DNA, 23 bp, Artificial Sequence
  HLA-A targeting gRNA
ttcgtatctgtcacagtgagggg

SEQ ID NO: 1310 - DNA, 23 bp, Artificial Sequence
  HLA-A targeting gRNA
acacacacaggcagcagccttgg

SEQ ID NO: 1311 - DNA, 23 bp, Artificial Sequence
  HLA-A targeting gRNA
accttgattacagcggtgatggg

SEQ ID NO: 1312 - DNA, 23 bp, Artificial Sequence
  HLA-A targeting gRNA
agaaaggagtcagggccttaagg

SEQ ID NO: 1313 - DNA, 23 bp, Artificial Sequence
  HLA-A targeting gRNA
agcacctcagggtggcttcatgg

SEQ ID NO: 1314 - DNA, 23 bp, Artificial Sequence
  HLA-A targeting gRNA
atgaagccaccctgaggtgctgg

SEQ ID NO: 1315 - DNA, 23 bp, Artificial Sequence
  HLA-A targeting gRNA
atttatcaccttgattacagcgg

SEQ ID NO: 1316 - DNA, 23 bp, Artificial Sequence
  HLA-A targeting gRNA
cacacacaggcagcagccttggg

SEQ ID NO: 1317 - DNA, 23 bp, Artificial Sequence
  HLA-A targeting gRNA
caccttgattacagcggtgatgg

SEQ ID NO: 1318 - DNA, 23 bp, Artificial Sequence
  HLA-A targeting gRNA
caggaagagtcagatcattcagg

SEQ ID NO: 1319 - DNA, 23 bp, Artificial Sequence
  HLA-A targeting gRNA
ctcaggtggggaaggggtgaagg

SEQ ID NO: 1320 - DNA, 23 bp, Artificial Sequence
  HLA-A targeting gRNA
ctctttggagctgtgatcactgg

SEQ ID NO: 1321 - DNA, 23 bp, Artificial Sequence
  HLA-A targeting gRNA
ctgctgcctgtgtgtgtcaaagg

SEQ ID NO: 1322 - DNA, 23 bp, Artificial Sequence
  HLA-A targeting gRNA
ctgggtaggcccataattgtggg

SEQ ID NO: 1323 - DNA, 23 bp, Artificial Sequence
  HLA-A targeting gRNA
gaagagctcaggtggggaagggg

SEQ ID NO: 1324 - DNA, 23 bp, Artificial Sequence
  HLA-A targeting gRNA
gaagcaccacccacaattatggg

SEQ ID NO: 1325 - DNA, 23 bp, Artificial Sequence
  HLA-A targeting gRNA
ggaagcaccacccacaattatgg

SEQ ID NO: 1326 - DNA, 23 bp, Artificial Sequence
  HLA-A targeting gRNA
ggtaggcccataattgtgggtgg

SEQ ID NO: 1327 - DNA, 23 bp, Artificial Sequence
  HLA-A targeting gRNA
ggtggggaaggggtgaagggtgg

SEQ ID NO: 1328 - DNA, 23 bp, Artificial Sequence
  HLA-A targeting gRNA
ggtggtgcttcccagtaacgagg

SEQ ID NO: 1329 - DNA, 23 bp, Artificial Sequence
  HLA-A targeting gRNA
gtggggaaggggtgaagggtggg

SEQ ID NO: 1330 - DNA, 23 bp, Artificial Sequence
  HLA-A targeting gRNA
tcagggccttaaggtcctagagg

SEQ ID NO: 1331 - DNA, 23 bp, Artificial Sequence
  HLA-A targeting gRNA
tcaggtggggaaggggtgaaggg

SEQ ID NO: 1332 - DNA, 23 bp, Artificial Sequence
  HLA-A targeting gRNA
tcccatcaccgctgtaatcaagg

SEQ ID NO: 1333 - DNA, 23 bp, Artificial Sequence
  HLA-A targeting gRNA
tgctgcctgtgtgtgtcaaaggg

SEQ ID NO: 1334 - DNA, 23 bp, Artificial Sequence
  HLA-A targeting gRNA
tggttccctttgacacacacagg

SEQ ID NO: 1335 - DNA, 23 bp, Artificial Sequence
  HLA-A targeting gRNA
ttaaggccctgactcctttctgg

SEQ ID NO: 1336 - DNA, 23 bp, Artificial Sequence
  HLA-A targeting gRNA
cgtcgcagccatacatcctctgg

SEQ ID NO: 1337 - DNA, 23 bp, Artificial Sequence
  HLA-A targeting gRNA
aggatgtatggctgcgacgtggg

SEQ ID NO: 1338 - DNA, 23 bp, Artificial Sequence
  HLA-A targeting gRNA
gcgttttgggggcgtctgtcagg

SEQ ID NO: 1339 - DNA, 23 bp, Artificial Sequence
  HLA-A targeting gRNA
actcctttctggtatctcacagg

SEQ ID NO: 1340 - DNA, 23 bp, Artificial Sequence
  HLA-A targeting gRNA
gagataccagaaaggagtcaggg

SEQ ID NO: 1341 - DNA, 23 bp, Artificial Sequence
  HLA-A targeting gRNA
tgagataccagaaaggagtcagg

SEQ ID NO: 1342 - DNA, 23 bp, Artificial Sequence
  HLA-A targeting gRNA
tggtgagtcatatgcgttttggg

SEQ ID NO: 1343 - DNA, 23 bp, Artificial Sequence
  HLA-A targeting gRNA
gtggtgagtcatatgcgttttgg

SEQ ID NO: 1344 - DNA, 23 bp, Artificial Sequence
  HLA-A targeting gRNA
ggccgcctcccacttgtgcttgg

SEQ ID NO: 1345 - DNA, 23 bp, Artificial Sequence
  HLA-A targeting gRNA
accctacataggttgggagaggg

SEQ ID NO: 1346 - DNA, 23 bp, Artificial Sequence
  HLA-A targeting gRNA
agaaggaccctacataggttggg

SEQ ID NO: 1347 - DNA, 23 bp, Artificial Sequence
  HLA-A targeting gRNA
ctccctctcccaacctatgtagg

SEQ ID NO: 1348 - DNA, 23 bp, Artificial Sequence
  HLA-A targeting gRNA
gaccctacataggttgggagagg

SEQ ID NO: 1349 - DNA, 23 bp, Artificial Sequence
  HLA-A targeting gRNA
tccctctcccaacctatgtaggg

SEQ ID NO: 1350 - DNA, 23 bp, Artificial Sequence
  HLA-A targeting gRNA
cgcctcccacttgtgcttggtgg

SEQ ID NO: 1351 - DNA, 23 bp, Artificial Sequence
  HLA-A targeting gRNA
ggagggagcacaggtcagcgtgg

SEQ ID NO: 1352 - DNA, 23 bp, Artificial Sequence
  HLA-A targeting gRNA
aacaggaaagatgattggggagg

SEQ ID NO: 1353 - DNA, 23 bp, Artificial Sequence
  HLA-A targeting gRNA
acaggaaagatgattggggaggg

SEQ ID NO: 1354 - DNA, 23 bp, Artificial Sequence
  HLA-A targeting gRNA
gatgattggggagggagcacagg

SEQ ID NO: 1355 - DNA, 23 bp, Artificial Sequence
  HLA-A targeting gRNA
gtctccccgtcccaatactccgg

SEQ ID NO: 1356 - DNA, 23 bp, Artificial Sequence
  HLA-A targeting gRNA
cgggggaccgggctgaccgcggg

SEQ ID NO: 1357 - DNA, 23 bp, Artificial Sequence
  HLA-A targeting gRNA
gggggaccgggctgaccgcgggg

SEQ ID NO: 1358 - DNA, 23 bp, Artificial Sequence
  HLA-A targeting gRNA
tcgggggaccgggctgaccgcgg

SEQ ID NO: 1359 - DNA, 23 bp, Artificial Sequence
  HLA-A targeting gRNA
aggacccgggaagccgcgccggg

SEQ ID NO: 1360 - DNA, 23 bp, Artificial Sequence
  HLA-A targeting gRNA
caggacccgggaagccgcgccgg

SEQ ID NO: 1361 - DNA, 23 bp, Artificial Sequence
  HLA-A targeting gRNA
agcaggagggtccggagtattgg

SEQ ID NO: 1362 - DNA, 23 bp, Artificial Sequence
  HLA-A targeting gRNA
gcaggagggtccggagtattggg

SEQ ID NO: 1363 - DNA, 23 bp, Artificial Sequence
  HLA-A targeting gRNA
gggtccggagtattgggacgggg

SEQ ID NO: 1364 - DNA, 23 bp, Artificial Sequence
  HLA-A targeting gRNA
aaaaatccccccaggttggtcgg

SEQ ID NO: 1365 - DNA, 23 bp, Artificial Sequence
  HLA-A targeting gRNA
aaaatccccccaggttggtcggg

SEQ ID NO: 1366 - DNA, 23 bp, Artificial Sequence
  HLA-A targeting gRNA
aaatccccccaggttggtcgggg

SEQ ID NO: 1367 - DNA, 23 bp, Artificial Sequence
  HLA-A targeting gRNA
accgggctgaccgcggggtccgg

SEQ ID NO: 1368 - DNA, 23 bp, Artificial Sequence
  HLA-A targeting gRNA
aggttggtcggggcggggcgggg

SEQ ID NO: 1369 - DNA, 23 bp, Artificial Sequence
  HLA-A targeting gRNA
caggttggtcggggcggggcggg

SEQ ID NO: 1370 - DNA, 23 bp, Artificial Sequence
  HLA-A targeting gRNA
ccaggttggtcggggcggggcgg

SEQ ID NO: 1371 - DNA, 23 bp, Artificial Sequence
  HLA-A targeting gRNA
cccccaggttggtcggggcgggg

SEQ ID NO: 1372 - DNA, 23 bp, Artificial Sequence
  HLA-A targeting gRNA
ccccccaggttggtcggggcggg

SEQ ID NO: 1373 - DNA, 23 bp, Artificial Sequence
  HLA-A targeting gRNA
ccccgccccgaccaacctggggg

SEQ ID NO: 1374 - DNA, 23 bp, Artificial Sequence
  HLA-A targeting gRNA
cccgccccgaccaacctgggggg

SEQ ID NO: 1375 - DNA, 23 bp, Artificial Sequence
  HLA-A targeting gRNA
cccggaccccgcggtcagcccgg

SEQ ID NO: 1376 - DNA, 23 bp, Artificial Sequence
  HLA-A targeting gRNA
ccgccccgccccgaccaacctgg

SEQ ID NO: 1377 - DNA, 23 bp, Artificial Sequence
  HLA-A targeting gRNA
ccgggctgaccgcggggtccggg

SEQ ID NO: 1378 - DNA, 23 bp, Artificial Sequence
  HLA-A targeting gRNA
cgccccgccccgaccaacctggg

SEQ ID NO: 1379 - DNA, 23 bp, Artificial Sequence
  HLA-A targeting gRNA
gaccaacctggggggatttttgg

SEQ ID NO: 1380 - DNA, 23 bp, Artificial Sequence
  HLA-A targeting gRNA
gccccgccccgaccaacctgggg

SEQ ID NO: 1381 - DNA, 23 bp, Artificial Sequence
  HLA-A targeting gRNA
ggccaaaaatccccccaggttgg

SEQ ID NO: 1382 - DNA, 23 bp, Artificial Sequence
  HLA-A targeting gRNA
tccccccaggttggtcggggcgg

SEQ ID NO: 1383 - DNA, 23 bp, Artificial Sequence
  HLA-A targeting gRNA
tttaggccaaaaatccccccagg

SEQ ID NO: 1384 - DNA, 23 bp, Artificial Sequence
  HLA-A targeting gRNA
acagactcaccgagtggacctgg

SEQ ID NO: 1385 - DNA, 23 bp, Artificial Sequence
  HLA-A targeting gRNA
ctgaccgcggggtccgggccagg

SEQ ID NO: 1386 - DNA, 23 bp, Artificial Sequence
  HLA-A targeting gRNA
gctgcgacgtggggtcggactgg

SEQ ID NO: 1387 - DNA, 23 bp, Artificial Sequence
  HLA-A targeting gRNA
agaacctggcccggaccccgcgg

SEQ ID NO: 1388 - DNA, 23 bp, Artificial Sequence
  HLA-A targeting gRNA
ctgacctgagtggaggctgaagg

SEQ ID NO: 1389 - DNA, 23 bp, Artificial Sequence
  HLA-A targeting gRNA
gagtccttcagcctccactcagg

SEQ ID NO: 1390 - DNA, 23 bp, Artificial Sequence
  HLA-A targeting gRNA
gctgaaggactcagaagtgctgg

SEQ ID NO: 1391 - DNA, 23 bp, Artificial Sequence
  HLA-A targeting gRNA
cttcagcctccactcaggtcagg

SEQ ID NO: 1392 - DNA, 23 bp, Artificial Sequence
  HLA-A targeting gRNA
acacctcagccccacctctctgg

SEQ ID NO: 1393 - DNA, 23 bp, Artificial Sequence
  HLA-A targeting gRNA
cagccccacctctctggaacagg

SEQ ID NO: 1394 - DNA, 23 bp, Artificial Sequence
  HLA-A targeting gRNA
ctttcctgttccagagaggtggg

SEQ ID NO: 1395 - DNA, 23 bp, Artificial Sequence
  HLA-A targeting gRNA
gttccagagaggtggggctgagg

SEQ ID NO: 1396 - DNA, 23 bp, Artificial Sequence
  HLA-A targeting gRNA
tcatctttcctgttccagagagg

SEQ ID NO: 1397 - DNA, 23 bp, Artificial Sequence
  HLA-A targeting gRNA
tctggaacaggaaagatgattgg

SEQ ID NO: 1398 - DNA, 23 bp, Artificial Sequence
  HLA-A targeting gRNA
tctttcctgttccagagaggtgg

SEQ ID NO: 1399 - DNA, 23 bp, Artificial Sequence
  HLA-A targeting gRNA
tttcctgttccagagaggtgggg

SEQ ID NO: 1400 - DNA, 23 bp, Artificial Sequence
  HLA-A targeting gRNA
caggttctcacaccgtccagagg

SEQ ID NO: 1401 - DNA, 23 bp, Artificial Sequence
  HLA-A targeting gRNA
ctctggacggtgtgagaacctgg

SEQ ID NO: 1402 - DNA, 23 bp, Artificial Sequence
  HLA-A targeting gRNA
cggactggcgcttcctccgcggg

SEQ ID NO: 1403 - DNA, 23 bp, Artificial Sequence
  HLA-A targeting gRNA
cacaccgtccagaggatgtatgg

SEQ ID NO: 1404 - DNA, 23 bp, Artificial Sequence
  HLA-A targeting gRNA
gacggtgtgagaacctggcccgg

SEQ ID NO: 1405 - DNA, 23 bp, Artificial Sequence
  HLA-A targeting gRNA
ccatctctgtctcaacttcatgg

SEQ ID NO: 1406 - DNA, 23 bp, Artificial Sequence
  HLA-A targeting gRNA
ccatgaagttgagacagagatgg

SEQ ID NO: 1407 - DNA, 23 bp, Artificial Sequence
  HLA-A targeting gRNA
ctctcaactgctccgccacatgg

SEQ ID NO: 1408 - DNA, 23 bp, Artificial Sequence
  HLA-A targeting gRNA
ctggaacaggaaagatgattggg

SEQ ID NO: 1409 - DNA, 23 bp, Artificial Sequence
  HLA-A targeting gRNA
tggaacaggaaagatgattgggg

SEQ ID NO: 1410 - DNA, 23 bp, Artificial Sequence
  HLA-A targeting gRNA
gagagcctggggacgaggagtgg

SEQ ID NO: 1411 - DNA, 23 bp, Artificial Sequence
  HLA-A targeting gRNA
ggagtgagagcctggggacgagg

SEQ ID NO: 1412 - DNA, 23 bp, Artificial Sequence
  HLA-A targeting gRNA
acctcatggagtgagagcctggg

SEQ ID NO: 1413 - DNA, 23 bp, Artificial Sequence
  HLA-A targeting gRNA
ccagagcccccgagagtagcagg

SEQ ID NO: 1414 - DNA, 23 bp, Artificial Sequence
  HLA-A targeting gRNA
ccccaggctctcactccatgagg

SEQ ID NO: 1415 - DNA, 23 bp, Artificial Sequence
  HLA-A targeting gRNA
cctcatggagtgagagcctgggg

SEQ ID NO: 1416 - DNA, 23 bp, Artificial Sequence
  HLA-A targeting gRNA
cctgctactctcgggggctctgg

SEQ ID NO: 1417 - DNA, 23 bp, Artificial Sequence
  HLA-A targeting gRNA
ctctggccctgacccagacctgg

SEQ ID NO: 1418 - DNA, 23 bp, Artificial Sequence
  HLA-A targeting gRNA
tacctcatggagtgagagcctgg

SEQ ID NO: 1419 - DNA, 23 bp, Artificial Sequence
  HLA-A targeting gRNA
aagcaacgggcccgcctggcggg

SEQ ID NO: 1420 - DNA, 23 bp, Artificial Sequence
  HLA-A targeting gRNA
agcaacgggcccgcctggcgggg

SEQ ID NO: 1421 - DNA, 23 bp, Artificial Sequence
  HLA-A targeting gRNA
cccgttgcttctccccacagagg

SEQ ID NO: 1422 - DNA, 23 bp, Artificial Sequence
  HLA-A targeting gRNA
ccgggtcctgcgcccccgccagg

SEQ ID NO: 1423 - DNA, 23 bp, Artificial Sequence
  HLA-A targeting gRNA
cctctgtggggagaagcaacggg

SEQ ID NO: 1424 - DNA, 23 bp, Artificial Sequence
  HLA-A targeting gRNA
cctggcgggggcgcaggacccgg

SEQ ID NO: 1425 - DNA, 23 bp, Artificial Sequence
  HLA-A targeting gRNA
ctggcgggggcgcaggacccggg

SEQ ID NO: 1426 - DNA, 23 bp, Artificial Sequence
  HLA-A targeting gRNA
gaagcaacgggcccgcctggcgg

SEQ ID NO: 1427 - DNA, 23 bp, Artificial Sequence
  HLA-A targeting gRNA
gcaacgggcccgcctggcggggg

SEQ ID NO: 1428 - DNA, 23 bp, Artificial Sequence
  HLA-A targeting gRNA
gcctctgtggggagaagcaacgg

SEQ ID NO: 1429 - DNA, 23 bp, Artificial Sequence
  HLA-A targeting gRNA
ggagaagcaacgggcccgcctgg

SEQ ID NO: 1430 - DNA, 23 bp, Artificial Sequence
  HLA-A targeting gRNA
ggcccgcctggcgggggcgcagg

SEQ ID NO: 1431 - DNA, 23 bp, Artificial Sequence
  HLA-A targeting gRNA
ggtcctgcgcccccgccaggcgg

SEQ ID NO: 1432 - DNA, 23 bp, Artificial Sequence
  HLA-A targeting gRNA
gtcctgcgcccccgccaggcggg

SEQ ID NO: 1433 - DNA, 23 bp, Artificial Sequence
  HLA-A targeting gRNA
ccccttgcttctccccgcagagg

SEQ ID NO: 1434 - DNA, 23 bp, Artificial Sequence
  HLA-A targeting gRNA
cctctgcggggagaagcaagggg

SEQ ID NO: 1435 - DNA, 23 bp, Artificial Sequence
  HLA-A targeting gRNA
gcctctgcggggagaagcaaggg

SEQ ID NO: 1436 - DNA, 23 bp, Artificial Sequence
  HLA-A targeting gRNA
actagaattctccacggaatagg

SEQ ID NO: 1437 - DNA, 23 bp, Artificial Sequence
  HLA-A targeting gRNA
agaacctagcccggaccccgcgg

SEQ ID NO: 1438 - DNA, 23 bp, Artificial Sequence
  HLA-A targeting gRNA
agaattctagtccctgaagaggg

SEQ ID NO: 1439 - DNA, 23 bp, Artificial Sequence
  HLA-A targeting gRNA
cacaatatccaaaggacctcagg

SEQ ID NO: 1440 - DNA, 23 bp, Artificial Sequence
  HLA-A targeting gRNA
ctcccaaacacaatatccaaagg

SEQ ID NO: 1441 - DNA, 23 bp, Artificial Sequence
  HLA-A targeting gRNA
ctgaccgcggggtccgggctagg

SEQ ID NO: 1442 - DNA, 23 bp, Artificial Sequence
  HLA-A targeting gRNA
gacggtgtgagaacctagcccgg

SEQ ID NO: 1443 - DNA, 23 bp, Artificial Sequence
  HLA-A targeting gRNA
gagaattctagtccctgaagagg

SEQ ID NO: 1444 - DNA, 23 bp, Artificial Sequence
  HLA-A targeting gRNA
ggctgatgcctgaggtcctttgg

SEQ ID NO: 1445 - DNA, 23 bp, Artificial Sequence
  HLA-A targeting gRNA
ggtcctttggatattgtgtttgg

SEQ ID NO: 1446 - DNA, 23 bp, Artificial Sequence
  HLA-A targeting gRNA
gtcctttggatattgtgtttggg

SEQ ID NO: 1447 - DNA, 23 bp, Artificial Sequence
  HLA-A targeting gRNA
taggttctcacaccgtccagagg

SEQ ID NO: 1448 - DNA, 23 bp, Artificial Sequence
  HLA-A targeting gRNA
tcagggactagaattctccacgg

SEQ ID NO: 1449 - DNA, 23 bp, Artificial Sequence
  HLA-A targeting gRNA
acccagttctcactcccatcggg

SEQ ID NO: 1450 - DNA, 23 bp, Artificial Sequence
  HLA-A targeting gRNA
acccgatgggagtgagaactggg

SEQ ID NO: 1451 - DNA, 23 bp, Artificial Sequence
  HLA-A targeting gRNA
cacccgatgggagtgagaactgg

SEQ ID NO: 1452 - DNA, 23 bp, Artificial Sequence
  HLA-A targeting gRNA
cgggagggaaacggcctctgcgg

SEQ ID NO: 1453 - DNA, 23 bp, Artificial Sequence
  HLA-A targeting gRNA
ggagggaaacggcctctgcgggg

SEQ ID NO: 1454 - DNA, 23 bp, Artificial Sequence
  HLA-A targeting gRNA
ggcctctgcggggagaagcaagg

SEQ ID NO: 1455 - DNA, 23 bp, Artificial Sequence
  HLA-A targeting gRNA
gggagggaaacggcctctgcggg

SEQ ID NO: 1456 - DNA, 23 bp, Artificial Sequence
  HLA-A targeting gRNA
aagacccgggaagccgcgccggg

SEQ ID NO: 1457 - DNA, 23 bp, Artificial Sequence
  HLA-A targeting gRNA
aagcaaggggcccgcctggcggg

SEQ ID NO: 1458 - DNA, 23 bp, Artificial Sequence
  HLA-A targeting gRNA
agcaaggggcccgcctggcgggg

SEQ ID NO: 1459 - DNA, 23 bp, Artificial Sequence
  HLA-A targeting gRNA
caagacccgggaagccgcgccgg

SEQ ID NO: 1460 - DNA, 23 bp, Artificial Sequence
  HLA-A targeting gRNA
ccgggtcttgcgcccccgccagg

SEQ ID NO: 1461 - DNA, 23 bp, Artificial Sequence
  HLA-A targeting gRNA
cctggcgggggcgcaagacccgg

SEQ ID NO: 1462 - DNA, 23 bp, Artificial Sequence
  HLA-A targeting gRNA
ctggcgggggcgcaagacccggg

SEQ ID NO: 1463 - DNA, 23 bp, Artificial Sequence
  HLA-A targeting gRNA
gaagcaaggggcccgcctggcgg

SEQ ID NO: 1464 - DNA, 23 bp, Artificial Sequence
  HLA-A targeting gRNA
gcaaggggcccgcctggcggggg

SEQ ID NO: 1465 - DNA, 23 bp, Artificial Sequence
  HLA-A targeting gRNA
ggagaagcaaggggcccgcctgg

SEQ ID NO: 1466 - DNA, 23 bp, Artificial Sequence
  HLA-A targeting gRNA
ggtcttgcgcccccgccaggcgg

SEQ ID NO: 1467 - DNA, 23 bp, Artificial Sequence
  HLA-A targeting gRNA
gtcttgcgcccccgccaggcggg

SEQ ID NO: 1468 - DNA, 23 bp, Artificial Sequence
  HLA-A targeting gRNA
ctggaaacccgacacccgatggg

SEQ ID NO: 1469 - DNA, 23 bp, Artificial Sequence
  HLA-A targeting gRNA
gacccagttctcactcccatcgg

SEQ ID NO: 1470 - DNA, 23 bp, Artificial Sequence
  HLA-A targeting gRNA
tctcactcccatcgggtgtcggg

SEQ ID NO: 1471 - DNA, 23 bp, Artificial Sequence
  HLA-A targeting gRNA
tctggaaacccgacacccgatgg

SEQ ID NO: 1472 - DNA, 23 bp, Artificial Sequence
  HLA-A targeting gRNA
ttctcactcccatcgggtgtcgg

SEQ ID NO: 1473 - DNA, 23 bp, Artificial Sequence
  HLA-A targeting gRNA
agtacccgcgcagggtccccagg

SEQ ID NO: 1474 - DNA, 23 bp, Artificial Sequence
  HLA-A targeting gRNA
atttctttacatccgtgtcccgg

SEQ ID NO: 1475 - DNA, 23 bp, Artificial Sequence
  HLA-A targeting gRNA
cgggtactacaaccagagcgagg

SEQ ID NO: 1476 - DNA, 23 bp, Artificial Sequence
  HLA-A targeting gRNA
ctggttgtagtacccgcgcaggg

SEQ ID NO: 1477 - DNA, 23 bp, Artificial Sequence
  HLA-A targeting gRNA
ggatgtaaagaaatacctcatgg

SEQ ID NO: 1478 - DNA, 23 bp, Artificial Sequence
  HLA-A targeting gRNA
tctggttgtagtacccgcgcagg

SEQ ID NO: 1479 - DNA, 23 bp, Artificial Sequence
  HLA-A targeting gRNA
tggacctggggaccctgcgcggg

SEQ ID NO: 1480 - DNA, 23 bp, Artificial Sequence
  HLA-A targeting gRNA
tttacatccgtgtcccggcccgg

SEQ ID NO: 1481 - DNA, 23 bp, Artificial Sequence
  HLA-A targeting gRNA
aaaatctctgaaggaatgaccgg

SEQ ID NO: 1482 - DNA, 23 bp, Artificial Sequence
  HLA-A targeting gRNA
aaaggcacctgggcctctcccgg

SEQ ID NO: 1483 - DNA, 23 bp, Artificial Sequence
  HLA-A targeting gRNA
atatcggacccggagactgtggg

SEQ ID NO: 1484 - DNA, 23 bp, Artificial Sequence
  HLA-A targeting gRNA
cgatatccgccccgaagccgcgg

SEQ ID NO: 1485 - DNA, 23 bp, Artificial Sequence
  HLA-A targeting gRNA
cgcggcttcggggcggatatcgg

SEQ ID NO: 1486 - DNA, 23 bp, Artificial Sequence
  HLA-A targeting gRNA
aagagcgcaggtcgtctttcagg

SEQ ID NO: 1487 - DNA, 23 bp, Artificial Sequence
  HLA-A targeting gRNA
gatatccgccccgaagccgcggg

SEQ ID NO: 1488 - DNA, 23 bp, Artificial Sequence
  HLA-A targeting gRNA
gatatcggacccggagactgtgg

SEQ ID NO: 1489 - DNA, 23 bp, Artificial Sequence
  HLA-A targeting gRNA
aagcggggctcctcgcggccggg

SEQ ID NO: 1490 - DNA, 23 bp, Artificial Sequence
  HLA-A targeting gRNA
aaggcacctgggcctctcccggg

SEQ ID NO: 1491 - DNA, 23 bp, Artificial Sequence
  HLA-A targeting gRNA
ttcggggcggatatcggacccgg

SEQ ID NO: 1492 - DNA, 23 bp, Artificial Sequence
  HLA-A targeting gRNA
acaccacgcacgtgccctccagg

SEQ ID NO: 1493 - DNA, 23 bp, Artificial Sequence
  HLA-A targeting gRNA
acacggacctggcagcgggatgg

SEQ ID NO: 1494 - DNA, 23 bp, Artificial Sequence
  HLA-A targeting gRNA
caggttctcacaccctccagagg

SEQ ID NO: 1495 - DNA, 23 bp, Artificial Sequence
  HLA-A targeting gRNA
cggactggcgcttcctgcgcggg

SEQ ID NO: 1496 - DNA, 23 bp, Artificial Sequence
  HLA-A targeting gRNA
cgtactggtggtacccgcgcagg

SEQ ID NO: 1497 - DNA, 23 bp, Artificial Sequence
  HLA-A targeting gRNA
ctctggagggtgtgagaacctgg

SEQ ID NO: 1498 - DNA, 23 bp, Artificial Sequence
  HLA-A targeting gRNA
gagggtgtgagaacctggcccgg

SEQ ID NO: 1499 - DNA, 23 bp, Artificial Sequence
  HLA-A targeting gRNA
tcggactggcgcttcctgcgcgg

SEQ ID NO: 1500 - DNA, 23 bp, Artificial Sequence
  HLA-A targeting gRNA
acagcgacgccgcgagccggagg

SEQ ID NO: 1501 - DNA, 23 bp, Artificial Sequence
  HLA-A targeting gRNA
cgacgccgcgagccggaggatgg

SEQ ID NO: 1502 - DNA, 23 bp, Artificial Sequence
  HLA-A targeting gRNA
cgagccggaggatggagccgcgg

SEQ ID NO: 1503 - DNA, 23 bp, Artificial Sequence
  HLA-A targeting gRNA
cggctccatcctccggctcgcgg

SEQ ID NO: 1504 - DNA, 23 bp, Artificial Sequence
  HLA-A targeting gRNA
gagccggaggatggagccgcggg

SEQ ID NO: 1505 - DNA, 23 bp, Artificial Sequence
  HLA-A targeting gRNA
gcgcccgcggctccatcctccgg

SEQ ID NO: 1506 - DNA, 23 bp, Artificial Sequence
  HLA-A targeting gRNA
tcgacagcgacgccgcgagccgg

SEQ ID NO: 1507 - DNA, 23 bp, Artificial Sequence
  HLA-A targeting gRNA
cactcggtcagtctgtgagtggg

SEQ ID NO: 1508 - DNA, 23 bp, Artificial Sequence
  HLA-A targeting gRNA
ccactcacagactgaccgagtgg

SEQ ID NO: 1509 - DNA, 23 bp, Artificial Sequence
  HLA-A targeting gRNA
ccactcggtcagtctgtgagtgg

SEQ ID NO: 1510 - DNA, 23 bp, Artificial Sequence
  HLA-A targeting gRNA
acggacctggcagcgggatgggg

SEQ ID NO: 1511 - DNA, 23 bp, Artificial Sequence
  HLA-A targeting gRNA
acggctctgggaaaaggggaagg

SEQ ID NO: 1512 - DNA, 23 bp, Artificial Sequence
  HLA-A targeting gRNA
actagccgcgcagggtccccagg

SEQ ID NO: 1513 - DNA, 23 bp, Artificial Sequence
  HLA-A targeting gRNA
actcctttctgggatctcacagg

SEQ ID NO: 1514 - DNA, 23 bp, Artificial Sequence
  HLA-A targeting gRNA
agaccaggcctgccaggggatgg

SEQ ID NO: 1515 - DNA, 23 bp, Artificial Sequence
  HLA-A targeting gRNA
agaccctggcccggaccccgcgg

SEQ ID NO: 1516 - DNA, 23 bp, Artificial Sequence
  HLA-A targeting gRNA
acatagctccaaagagaactagg

SEQ ID NO: 1517 - DNA, 23 bp, Artificial Sequence
  HLA-A targeting gRNA
agctatgttcgctggagctgtgg

SEQ ID NO: 1518 - DNA, 23 bp, Artificial Sequence
  HLA-A targeting gRNA
cctcctccgcgggtaccagcagg

SEQ ID NO: 1519 - DNA, 23 bp, Artificial Sequence
  HLA-A targeting gRNA
cctgctggtacccgcggaggagg

SEQ ID NO: 1520 - DNA, 23 bp, Artificial Sequence
  HLA-A targeting gRNA
ctctttggagctatgttcgctgg

SEQ ID NO: 1521 - DNA, 23 bp, Artificial Sequence
  HLA-A targeting gRNA
tcatgtcttttacggaaagcagg

SEQ ID NO: 1522 - DNA, 23 bp, Artificial Sequence
  HLA-A targeting gRNA
tgggggtgtcatgtcttttacgg

SEQ ID NO: 1523 - DNA, 23 bp, Artificial Sequence
  HLA-A targeting gRNA
agagcgcaggtcgtctttcaggg

SEQ ID NO: 1524 - DNA, 23 bp, Artificial Sequence
  HLA-A targeting gRNA
agatcacacggacctggcagcgg

SEQ ID NO: 1525 - DNA, 23 bp, Artificial Sequence
  HLA-A targeting gRNA
agattctcccccagacgccgagg

SEQ ID NO: 1526 - DNA, 23 bp, Artificial Sequence
  HLA-A targeting gRNA
aggatgtgtggctgcgacgtggg

SEQ ID NO: 1527 - DNA, 23 bp, Artificial Sequence
  HLA-A targeting gRNA
aggatgtttggctgcgacgtggg

SEQ ID NO: 1528 - DNA, 23 bp, Artificial Sequence
  HLA-A targeting gRNA
aggcacctgggcctctcccgggg

SEQ ID NO: 1529 - DNA, 23 bp, Artificial Sequence
  HLA-A targeting gRNA
aggcataatgtgaggagggtggg

SEQ ID NO: 1530 - DNA, 23 bp, Artificial Sequence
  HLA-A targeting gRNA
aggcgaactggtggtacccgcgg

SEQ ID NO: 1531 - DNA, 23 bp, Artificial Sequence
  HLA-A targeting gRNA
aggcgtagtggtggtacccgcgg

SEQ ID NO: 1532 - DNA, 23 bp, Artificial Sequence
  HLA-A targeting gRNA
aggtccgtgtgatctccgcaggg

SEQ ID NO: 1533 - DNA, 23 bp, Artificial Sequence
  HLA-A targeting gRNA
atttctacacatccgtgtcccgg

SEQ ID NO: 1534 - DNA, 23 bp, Artificial Sequence
  HLA-A targeting gRNA
cacaccctccagatgatgtatgg

SEQ ID NO: 1535 - DNA, 23 bp, Artificial Sequence
  HLA-A targeting gRNA
caagtgggagacggcccatgagg

SEQ ID NO: 1536 - DNA, 23 bp, Artificial Sequence
  HLA-A targeting gRNA
cacaccgtccagaggatgtgtgg

SEQ ID NO: 1537 - DNA, 23 bp, Artificial Sequence
  HLA-A targeting gRNA
cacaccgtccagaggatgtttgg

SEQ ID NO: 1538 - DNA, 23 bp, Artificial Sequence
  HLA-A targeting gRNA
cacagcctcccacttctggaagg

SEQ ID NO: 1539 - DNA, 23 bp, Artificial Sequence
  HLA-A targeting gRNA
gtgggagacggcccatgaggcgg

SEQ ID NO: 1540 - DNA, 23 bp, Artificial Sequence
  HLA-A targeting gRNA
caccaagcacaagtgggagacgg

SEQ ID NO: 1541 - DNA, 23 bp, Artificial Sequence
  HLA-A targeting gRNA
aggtggggtgaagggatgaaggg

SEQ ID NO: 1542 - DNA, 23 bp, Artificial Sequence
  HLA-A targeting gRNA
caggtggggtgaagggatgaagg

SEQ ID NO: 1543 - DNA, 23 bp, Artificial Sequence
  HLA-A targeting gRNA
ggggtgaagggatgaagggtggg

SEQ ID NO: 1544 - DNA, 23 bp, Artificial Sequence
  HLA-A targeting gRNA
tggggtgaagggatgaagggtgg

SEQ ID NO: 1545 - DNA, 23 bp, Artificial Sequence
  HLA-A targeting gRNA
aggcgtcctgctggtacccgcgg

SEQ ID NO: 1546 - DNA, 23 bp, Artificial Sequence
  HLA-A targeting gRNA
cacggacctggcagcgggatggg

SEQ ID NO: 1547 - DNA, 23 bp, Artificial Sequence
  HLA-A targeting gRNA
taccagcaggacgcctacgacgg

SEQ ID NO: 1548 - DNA, 23 bp, Artificial Sequence
  HLA-A targeting gRNA
tgccgtcgtaggcgtcctgctgg

SEQ ID NO: 1549 - DNA, 23 bp, Artificial Sequence
  HLA-A targeting gRNA
agtattgggacgaggagacaggg

SEQ ID NO: 1550 - DNA, 23 bp, Artificial Sequence
  HLA-A targeting gRNA
cgaggagacagggaaagtgaagg

SEQ ID NO: 1551 - DNA, 23 bp, Artificial Sequence
  HLA-A targeting gRNA
cagggtctcacaccgtccagagg

SEQ ID NO: 1552 - DNA, 23 bp, Artificial Sequence
  HLA-A targeting gRNA
gagtattgggacgaggagacagg

SEQ ID NO: 1553 - DNA, 23 bp, Artificial Sequence
  HLA-A targeting gRNA
caggtccgtgtgatctccgcagg

SEQ ID NO: 1554 - DNA, 23 bp, Artificial Sequence
  HLA-A targeting gRNA
ggggccggagtattgggacgagg

SEQ ID NO: 1555 - DNA, 23 bp, Artificial Sequence
  HLA-A targeting gRNA
cggcccatgtggcggagcagtgg

SEQ ID NO: 1556 - DNA, 23 bp, Artificial Sequence
  HLA-A targeting gRNA
ctctccactgctccgccacatgg

SEQ ID NO: 1557 - DNA, 23 bp, Artificial Sequence
  HLA-A targeting gRNA
tctccactgctccgccacatggg

SEQ ID NO: 1558 - DNA, 23 bp, Artificial Sequence
  HLA-A targeting gRNA
cagttgaaagcctacctggaggg

SEQ ID NO: 1559 - DNA, 23 bp, Artificial Sequence
  HLA-A targeting gRNA
catgtttcctgatcccgcctggg

SEQ ID NO: 1560 - DNA, 23 bp, Artificial Sequence
  HLA-A targeting gRNA
ccaccacagcctcccacttctgg

SEQ ID NO: 1561 - DNA, 23 bp, Artificial Sequence
  HLA-A targeting gRNA
ccactacgcctacgacggcaagg

SEQ ID NO: 1562 - DNA, 23 bp, Artificial Sequence
  HLA-A targeting gRNA
ccagaagtgggaggctgtggtgg

SEQ ID NO: 1563 - DNA, 23 bp, Artificial Sequence
  HLA-A targeting gRNA
atctggagggtgtgagaacctgg

SEQ ID NO: 1564 - DNA, 23 bp, Artificial Sequence
  HLA-A targeting gRNA
ccagtcccccgagccccgcccgg

SEQ ID NO: 1565 - DNA, 23 bp, Artificial Sequence
  HLA-A targeting gRNA
ccgcccggccccgaccaacccgg

SEQ ID NO: 1566 - DNA, 23 bp, Artificial Sequence
  HLA-A targeting gRNA
ccgggcggggctcgggggactgg

SEQ ID NO: 1567 - DNA, 23 bp, Artificial Sequence
  HLA-A targeting gRNA
ccgggttggtcggggccgggcgg

SEQ ID NO: 1568 - DNA, 23 bp, Artificial Sequence
  HLA-A targeting gRNA
cgcccggccccgaccaacccggg

SEQ ID NO: 1569 - DNA, 23 bp, Artificial Sequence
  HLA-A targeting gRNA
cgggcggggctcgggggactggg

SEQ ID NO: 1570 - DNA, 23 bp, Artificial Sequence
  HLA-A targeting gRNA
cggggccgggcggggctcggggg

SEQ ID NO: 1571 - DNA, 23 bp, Artificial Sequence
  HLA-A targeting gRNA
cgggttggtcggggccgggcggg

SEQ ID NO: 1572 - DNA, 23 bp, Artificial Sequence
  HLA-A targeting gRNA
gggttggtcggggccgggcgggg

SEQ ID NO: 1573 - DNA, 23 bp, Artificial Sequence
  HLA-A targeting gRNA
ggtcggggccgggcggggctcgg

SEQ ID NO: 1574 - DNA, 23 bp, Artificial Sequence
  HLA-A targeting gRNA
gtcggggccgggcggggctcggg

SEQ ID NO: 1575 - DNA, 23 bp, Artificial Sequence
  HLA-A targeting gRNA
gtttggctgcgacgtggggtcgg

SEQ ID NO: 1576 - DNA, 23 bp, Artificial Sequence
  HLA-A targeting gRNA
tcggggccgggcggggctcgggg

SEQ ID NO: 1577 - DNA, 23 bp, Artificial Sequence
  HLA-A targeting gRNA
gtctcctcgtcccaatactccgg

SEQ ID NO: 1578 - DNA, 23 bp, Artificial Sequence
  HLA-A targeting gRNA
acaagaacacagacacatgcagg

SEQ ID NO: 1579 - DNA, 23 bp, Artificial Sequence
  HLA-A targeting gRNA
cttgtaggcataatgtgaggagg

SEQ ID NO: 1580 - DNA, 23 bp, Artificial Sequence
  HLA-A targeting gRNA
gcatgtgtctgtgttcttgtagg

SEQ ID NO: 1581 - DNA, 23 bp, Artificial Sequence
  HLA-A targeting gRNA
gttcttgtaggcataatgtgagg

SEQ ID NO: 1582 - DNA, 23 bp, Artificial Sequence
  HLA-A targeting gRNA
ccgccgcggtcaaagagcgcagg

SEQ ID NO: 1583 - DNA, 23 bp, Artificial Sequence
  HLA-A targeting gRNA
agagcgcaggtcctcgttcaagg

SEQ ID NO: 1584 - DNA, 23 bp, Artificial Sequence
  HLA-A targeting gRNA
aagagctcaggtggggtgaaggg

SEQ ID NO: 1585 - DNA, 23 bp, Artificial Sequence
  HLA-A targeting gRNA
aggtggaggaggaagagctcagg

SEQ ID NO: 1586 - DNA, 23 bp, Artificial Sequence
  HLA-A targeting gRNA
attgctggcctagttctctttgg

SEQ ID NO: 1587 - DNA, 23 bp, Artificial Sequence
  HLA-A targeting gRNA
ctgtggtcgctgctgtgaggtgg

SEQ ID NO: 1588 - DNA, 23 bp, Artificial Sequence
  HLA-A targeting gRNA
gaagagctcaggtggggtgaagg

SEQ ID NO: 1589 - DNA, 23 bp, Artificial Sequence
  HLA-A targeting gRNA
gaagcaccatccacaattatggg

SEQ ID NO: 1590 - DNA, 23 bp, Artificial Sequence
  HLA-A targeting gRNA
gagctgtggtcgctgctgtgagg

SEQ ID NO: 1591 - DNA, 23 bp, Artificial Sequence
  HLA-A targeting gRNA
ggaagcaccatccacaattatgg

SEQ ID NO: 1592 - DNA, 23 bp, Artificial Sequence
  HLA-A targeting gRNA
ggtaggcccataattgtggatgg

SEQ ID NO: 1593 - DNA, 23 bp, Artificial Sequence
  HLA-A targeting gRNA
tcgctgctgtgaggtggaggagg

SEQ ID NO: 1594 - DNA, 23 bp, Artificial Sequence
  HLA-A targeting gRNA
tggtcgctgctgtgaggtggagg

SEQ ID NO: 1595 - DNA, 23 bp, Artificial Sequence
  HLA-A targeting gRNA
ggattacatcgccttgaacgagg

SEQ ID NO: 1596 - DNA, 23 bp, Artificial Sequence
  HLA-A targeting gRNA
cctgcgctctttgaccgcggcgg

SEQ ID NO: 1597 - DNA, 23 bp, Artificial Sequence
  HLA-A targeting gRNA
actgggctgaccgtggggtcggg

SEQ ID NO: 1598 - DNA, 23 bp, Artificial Sequence
  HLA-A targeting gRNA
agaacctggccccgaccccacgg

SEQ ID NO: 1599 - DNA, 23 bp, Artificial Sequence
  HLA-A targeting gRNA
ccagtcccccgagccccgtccgg

SEQ ID NO: 1600 - DNA, 23 bp, Artificial Sequence
  HLA-A targeting gRNA
ccggacggggctcgggggactgg

SEQ ID NO: 1601 - DNA, 23 bp, Artificial Sequence
  HLA-A targeting gRNA
ccgggttggtcggggccggacgg

SEQ ID NO: 1602 - DNA, 23 bp, Artificial Sequence
  HLA-A targeting gRNA
ccgtccggccccgaccaacccgg

SEQ ID NO: 1603 - DNA, 23 bp, Artificial Sequence
  HLA-A targeting gRNA
cggacggggctcgggggactggg

SEQ ID NO: 1604 - DNA, 23 bp, Artificial Sequence
  HLA-A targeting gRNA
cggggccggacggggctcggggg

SEQ ID NO: 1605 - DNA, 23 bp, Artificial Sequence
  HLA-A targeting gRNA
cgggggactgggctgaccgtggg

SEQ ID NO: 1606 - DNA, 23 bp, Artificial Sequence
  HLA-A targeting gRNA
cgggttggtcggggccggacggg

SEQ ID NO: 1607 - DNA, 23 bp, Artificial Sequence
  HLA-A targeting gRNA
cgtccggccccgaccaacccggg

SEQ ID NO: 1608 - DNA, 23 bp, Artificial Sequence
  HLA-A targeting gRNA
ctgaccgtggggtcggggccagg

SEQ ID NO: 1609 - DNA, 23 bp, Artificial Sequence
  HLA-A targeting gRNA
ctgggctgaccgtggggtcgggg

SEQ ID NO: 1610 - DNA, 23 bp, Artificial Sequence
  HLA-A targeting gRNA
gactgggctgaccgtggggtcgg

SEQ ID NO: 1611 - DNA, 23 bp, Artificial Sequence
  HLA-A targeting gRNA
gggggactgggctgaccgtgggg

SEQ ID NO: 1612 - DNA, 23 bp, Artificial Sequence
  HLA-A targeting gRNA
gggttggtcggggccggacgggg

SEQ ID NO: 1613 - DNA, 23 bp, Artificial Sequence
  HLA-A targeting gRNA
ggtcggggccggacggggctcgg

SEQ ID NO: 1614 - DNA, 23 bp, Artificial Sequence
  HLA-A targeting gRNA
gtccggccccgaccaacccgggg

SEQ ID NO: 1615 - DNA, 23 bp, Artificial Sequence
  HLA-A targeting gRNA
gtcggggccggacggggctcggg

SEQ ID NO: 1616 - DNA, 23 bp, Artificial Sequence
  HLA-A targeting gRNA
tccggccccgaccaacccggggg

SEQ ID NO: 1617 - DNA, 23 bp, Artificial Sequence
  HLA-A targeting gRNA
tcggggccggacggggctcgggg

SEQ ID NO: 1618 - DNA, 23 bp, Artificial Sequence
  HLA-A targeting gRNA
tcgggggactgggctgaccgtgg

SEQ ID NO: 1619 - DNA, 23 bp, Artificial Sequence
  HLA-A targeting gRNA
gcgtcttgggggcgtctgtcagg

SEQ ID NO: 1620 - DNA, 23 bp, Artificial Sequence
  HLA-A targeting gRNA
ctctcggtcagtctgtgagtggg

SEQ ID NO: 1621 - DNA, 23 bp, Artificial Sequence
  HLA-A targeting gRNA
ccttgccgtcgtaggcgtagtgg

SEQ ID NO: 1622 - DNA, 23 bp, Artificial Sequence
  HLA-A targeting gRNA
tctctcggtcagtctgtgagtgg

SEQ ID NO: 1623 - DNA, 23 bp, Artificial Sequence
  HLA-A targeting gRNA
cgaactggtggtacccgcggagg

SEQ ID NO: 1624 - DNA, 23 bp, Artificial Sequence
  HLA-A targeting gRNA
cgacctgcgctcttggaccgcgg

SEQ ID NO: 1625 - DNA, 23 bp, Artificial Sequence
  HLA-A targeting gRNA
ctctcaactgctccgccacacgg

SEQ ID NO: 1626 - DNA, 23 bp, Artificial Sequence
  HLA-A targeting gRNA
tctcaactgctccgccacacggg

SEQ ID NO: 1627 - DNA, 23 bp, Artificial Sequence
  HLA-A targeting gRNA
cgatgaagcggggctcctcgcgg

SEQ ID NO: 1628 - DNA, 23 bp, Artificial Sequence
  HLA-A targeting gRNA
cgcagccatacatcatctggagg

SEQ ID NO: 1629 - DNA, 23 bp, Artificial Sequence
  HLA-A targeting gRNA
cgtcctgctggtacccgcggagg

SEQ ID NO: 1630 - DNA, 23 bp, Artificial Sequence
  HLA-A targeting gRNA
cggccatcctcggcgtctggggg

SEQ ID NO: 1631 - DNA, 23 bp, Artificial Sequence
  HLA-A targeting gRNA
cggcccatgaggcggagcagtgg

SEQ ID NO: 1632 - DNA, 23 bp, Artificial Sequence
  HLA-A targeting gRNA
cggctactgcaaccagagcgagg

SEQ ID NO: 1633 - DNA, 23 bp, Artificial Sequence
  HLA-A targeting gRNA
cggctagtacaaccagagcgagg

SEQ ID NO: 1634 - DNA, 23 bp, Artificial Sequence
  HLA-A targeting gRNA
cccccgggttggtcggggccggg

SEQ ID NO: 1635 - DNA, 23 bp, Artificial Sequence
  HLA-A targeting gRNA
cccggccccgaccaacccggggg

SEQ ID NO: 1636 - DNA, 23 bp, Artificial Sequence
  HLA-A targeting gRNA
gcccggccccgaccaacccgggg

SEQ ID NO: 1637 - DNA, 23 bp, Artificial Sequence
  HLA-A targeting gRNA
atgatgtatggctgcgacgtggg

SEQ ID NO: 1638 - DNA, 23 bp, Artificial Sequence
  HLA-A targeting gRNA
cgtcgcagccatacatcatctgg

SEQ ID NO: 1639 - DNA, 23 bp, Artificial Sequence
  HLA-A targeting gRNA
gatgatgtatggctgcgacgtgg

SEQ ID NO: 1640 - DNA, 23 bp, Artificial Sequence
  HLA-A targeting gRNA
caagctccgtgtcctgggtctgg

SEQ ID NO: 1641 - DNA, 23 bp, Artificial Sequence
  HLA-A targeting gRNA
acacggagcttgtggagaccagg

SEQ ID NO: 1642 - DNA, 23 bp, Artificial Sequence
  HLA-A targeting gRNA
cttgtggagaccaggcctgcagg

SEQ ID NO: 1643 - DNA, 23 bp, Artificial Sequence
  HLA-A targeting gRNA
tgtggagaccaggcctgcagggg

SEQ ID NO: 1644 - DNA, 23 bp, Artificial Sequence
  HLA-A targeting gRNA
ttgtggagaccaggcctgcaggg

SEQ ID NO: 1645 - DNA, 23 bp, Artificial Sequence
  HLA-A targeting gRNA
cgtagtggtggtacccgcggagg

SEQ ID NO: 1646 - DNA, 23 bp, Artificial Sequence
  HLA-A targeting gRNA
cgtcgcagccaaacatcctctgg

SEQ ID NO: 1647 - DNA, 23 bp, Artificial Sequence
  HLA-A targeting gRNA
cgtcgcagccacacatcctctgg

SEQ ID NO: 1648 - DNA, 23 bp, Artificial Sequence
  HLA-A targeting gRNA
cgtctcccacttgtgcttggtgg

SEQ ID NO: 1649 - DNA, 23 bp, Artificial Sequence
  HLA-A targeting gRNA
cgtggagaccaggcctgccaggg

SEQ ID NO: 1650 - DNA, 23 bp, Artificial Sequence
  HLA-A targeting gRNA
cgtgtcccggcccggccgcgagg

SEQ ID NO: 1651 - DNA, 23 bp, Artificial Sequence
  HLA-A targeting gRNA
ctaagctgccatgtccgccgcgg

SEQ ID NO: 1652 - DNA, 23 bp, Artificial Sequence
  HLA-A targeting gRNA
ctccacaagctccgtgtcctggg

SEQ ID NO: 1653 - DNA, 23 bp, Artificial Sequence
  HLA-A targeting gRNA
gacccaggacacggagcttgtgg

SEQ ID NO: 1654 - DNA, 23 bp, Artificial Sequence
  HLA-A targeting gRNA
tctccacaagctccgtgtcctgg

SEQ ID NO: 1655 - DNA, 23 bp, Artificial Sequence
  HLA-A targeting gRNA
ctcagccactcctggtccccagg

SEQ ID NO: 1656 - DNA, 23 bp, Artificial Sequence
  HLA-A targeting gRNA
ggtgagtcatatgcgtcttgggg

SEQ ID NO: 1657 - DNA, 23 bp, Artificial Sequence
  HLA-A targeting gRNA
gtgagtcatatgcgtcttggggg

SEQ ID NO: 1658 - DNA, 23 bp, Artificial Sequence
  HLA-A targeting gRNA
ctcagggtggcttcatggtcagg

SEQ ID NO: 1659 - DNA, 23 bp, Artificial Sequence
  HLA-A targeting gRNA
gtggtgagtcatatgcgtcttgg

SEQ ID NO: 1660 - DNA, 23 bp, Artificial Sequence
  HLA-A targeting gRNA
tggtgagtcatatgcgtcttggg

SEQ ID NO: 1661 - DNA, 23 bp, Artificial Sequence
  HLA-A targeting gRNA
cacaccatccagatgatgtatgg

SEQ ID NO: 1662 - DNA, 23 bp, Artificial Sequence
  HLA-A targeting gRNA
gcagccatacatcatctggatgg

SEQ ID NO: 1663 - DNA, 23 bp, Artificial Sequence
  HLA-A targeting gRNA
ctcgcggccgggccgggacacgg

SEQ ID NO: 1664 - DNA, 23 bp, Artificial Sequence
  HLA-A targeting gRNA
tgatgtatggctgcgacgtgggg

SEQ ID NO: 1665 - DNA, 23 bp, Artificial Sequence
  HLA-A targeting gRNA
ctctccactgctccgcctcatgg

SEQ ID NO: 1666 - DNA, 23 bp, Artificial Sequence
  HLA-A targeting gRNA
acacacaccggcagcagccttgg

SEQ ID NO: 1667 - DNA, 23 bp, Artificial Sequence
  HLA-A targeting gRNA
agtggacgcagctgtgctatggg

SEQ ID NO: 1668 - DNA, 23 bp, Artificial Sequence
  HLA-A targeting gRNA
atattgtgtttgggagcccgtgg

SEQ ID NO: 1669 - DNA, 23 bp, Artificial Sequence
  HLA-A targeting gRNA
atgtctctcacagcttgtaaagg

SEQ ID NO: 1670 - DNA, 23 bp, Artificial Sequence
  HLA-A targeting gRNA
attgtgtttgggagcccgtgggg

SEQ ID NO: 1671 - DNA, 23 bp, Artificial Sequence
  HLA-A targeting gRNA
cacacaccggcagcagccttggg

SEQ ID NO: 1672 - DNA, 23 bp, Artificial Sequence
  HLA-A targeting gRNA
cacagacgcccacttctggaagg

SEQ ID NO: 1673 - DNA, 23 bp, Artificial Sequence
  HLA-A targeting gRNA
caggaagagtcagaacattcagg

SEQ ID NO: 1674 - DNA, 23 bp, Artificial Sequence
  HLA-A targeting gRNA
cagtggacgcagctgtgctatgg

SEQ ID NO: 1675 - DNA, 23 bp, Artificial Sequence
  HLA-A targeting gRNA
ctctggacggtgtgagaccctgg

SEQ ID NO: 1676 - DNA, 23 bp, Artificial Sequence
  HLA-A targeting gRNA
ccaccacagacgcccacttctgg

SEQ ID NO: 1677 - DNA, 23 bp, Artificial Sequence
  HLA-A targeting gRNA
ccacgctgtctctgaccatgagg

SEQ ID NO: 1678 - DNA, 23 bp, Artificial Sequence
  HLA-A targeting gRNA
ccagaagtgggcgtctgtggtgg

SEQ ID NO: 1679 - DNA, 23 bp, Artificial Sequence
  HLA-A targeting gRNA
cctcatggtcagagacagcgtgg

SEQ ID NO: 1680 - DNA, 23 bp, Artificial Sequence
  HLA-A targeting gRNA
ctcttggaccgcggcggacacgg

SEQ ID NO: 1681 - DNA, 23 bp, Artificial Sequence
  HLA-A targeting gRNA
ctgctgccggtgtgtgtcaaagg

SEQ ID NO: 1682 - DNA, 23 bp, Artificial Sequence
  HLA-A targeting gRNA
ctctttgaccgcggcggacatgg

SEQ ID NO: 1683 - DNA, 23 bp, Artificial Sequence
  HLA-A targeting gRNA
cttccagaagtgggcgtctgtgg

SEQ ID NO: 1684 - DNA, 23 bp, Artificial Sequence
  HLA-A targeting gRNA
gagagacatatcagagccctggg

SEQ ID NO: 1685 - DNA, 23 bp, Artificial Sequence
  HLA-A targeting gRNA
gatggtgcttcccagtaacgagg

SEQ ID NO: 1686 - DNA, 23 bp, Artificial Sequence
  HLA-A targeting gRNA
gcactgtcactgcctggggtagg

SEQ ID NO: 1687 - DNA, 23 bp, Artificial Sequence
  HLA-A targeting gRNA
gcgtctgtggtggtgccttctgg

SEQ ID NO: 1688 - DNA, 23 bp, Artificial Sequence
  HLA-A targeting gRNA
ggggtgggtgagctcccccacgg

SEQ ID NO: 1689 - DNA, 23 bp, Artificial Sequence
  HLA-A targeting gRNA
gggtgggtgagctcccccacggg

SEQ ID NO: 1690 - DNA, 23 bp, Artificial Sequence
  HLA-A targeting gRNA
ggtaggacaaaaacagaacctgg

SEQ ID NO: 1691 - DNA, 23 bp, Artificial Sequence
  HLA-A targeting gRNA
gtggacgcagctgtgctatgggg

SEQ ID NO: 1692 - DNA, 23 bp, Artificial Sequence
  HLA-A targeting gRNA
tattgtgtttgggagcccgtggg

SEQ ID NO: 1693 - DNA, 23 bp, Artificial Sequence
  HLA-A targeting gRNA
tgagagacatatcagagccctgg

SEQ ID NO: 1694 - DNA, 23 bp, Artificial Sequence
  HLA-A targeting gRNA
tgctgccggtgtgtgtcaaaggg

SEQ ID NO: 1695 - DNA, 23 bp, Artificial Sequence
  HLA-A targeting gRNA
ttctgtttttgtcctaccccagg

SEQ ID NO: 1696 - DNA, 23 bp, Artificial Sequence
  HLA-A targeting gRNA
ttgtgtttgggagcccgtggggg

SEQ ID NO: 1697 - DNA, 23 bp, Artificial Sequence
  HLA-A targeting gRNA
ctgagctgccgtgtccgccgcgg

SEQ ID NO: 1698 - DNA, 23 bp, Artificial Sequence
  HLA-A targeting gRNA
tggttccctttgacacacaccgg

SEQ ID NO: 1699 - DNA, 23 bp, Artificial Sequence
  HLA-A targeting gRNA
ctgcagacccaggcgggatcagg

SEQ ID NO: 1700 - DNA, 23 bp, Artificial Sequence
  HLA-A targeting gRNA
ctgcggagatcacacggacctgg

SEQ ID NO: 1701 - DNA, 23 bp, Artificial Sequence
  HLA-A targeting gRNA
ccgcggaggaagcgcccgtccgg

SEQ ID NO: 1702 - DNA, 23 bp, Artificial Sequence
  HLA-A targeting gRNA
ccggacgggcgcttcctccgcgg

SEQ ID NO: 1703 - DNA, 23 bp, Artificial Sequence
  HLA-A targeting gRNA
ctgggaaaaggggaaggtgaggg

SEQ ID NO: 1704 - DNA, 23 bp, Artificial Sequence
  HLA-A targeting gRNA
ctggttgcagtagccgcgcaggg

SEQ ID NO: 1705 - DNA, 23 bp, Artificial Sequence
  HLA-A targeting gRNA
ctggttgtactagccgcgcaggg

SEQ ID NO: 1706 - DNA, 23 bp, Artificial Sequence
  HLA-A targeting gRNA
cttagaccaccaagcacaagtgg

SEQ ID NO: 1707 - DNA, 23 bp, Artificial Sequence
  HLA-A targeting gRNA
cttcatggtcagagacagcttgg

SEQ ID NO: 1708 - DNA, 23 bp, Artificial Sequence
  HLA-A targeting gRNA
cttcatggtcagggacagcgtgg

SEQ ID NO: 1709 - DNA, 23 bp, Artificial Sequence
  HLA-A targeting gRNA
cttccagaagtgggaggctgtgg

SEQ ID NO: 1710 - DNA, 23 bp, Artificial Sequence
  HLA-A targeting gRNA
ctttcaactgctccgccacatgg

SEQ ID NO: 1711 - DNA, 23 bp, Artificial Sequence
  HLA-A targeting gRNA
gaaaccgggtaaaggcacctggg

SEQ ID NO: 1712 - DNA, 23 bp, Artificial Sequence
  HLA-A targeting gRNA
gaagacggctctgggaaaagggg

SEQ ID NO: 1713 - DNA, 23 bp, Artificial Sequence
  HLA-A targeting gRNA
gaagcggggctcctcgcggccgg

SEQ ID NO: 1714 - DNA, 23 bp, Artificial Sequence
  HLA-A targeting gRNA
acagactgaccgagtggacctgg

SEQ ID NO: 1715 - DNA, 23 bp, Artificial Sequence
  HLA-A targeting gRNA
cagactgaccgagtggacctggg

SEQ ID NO: 1716 - DNA, 23 bp, Artificial Sequence
  HLA-A targeting gRNA
gacggtgtgagaccctggcccgg

SEQ ID NO: 1717 - DNA, 23 bp, Artificial Sequence
  HLA-A targeting gRNA
agactgaccgagtggacctgggg

SEQ ID NO: 1718 - DNA, 23 bp, Artificial Sequence
  HLA-A targeting gRNA
gagagcctggggaccaggagtgg

SEQ ID NO: 1719 - DNA, 23 bp, Artificial Sequence
  HLA-A targeting gRNA
cacaccctccagaggatgtatgg

SEQ ID NO: 1720 - DNA, 23 bp, Artificial Sequence
  HLA-A targeting gRNA
gcagccatacatcctctggaggg

SEQ ID NO: 1721 - DNA, 23 bp, Artificial Sequence
  HLA-A targeting gRNA
gagatcccagaaaggagtcaggg

SEQ ID NO: 1722 - DNA, 23 bp, Artificial Sequence
  HLA-A targeting gRNA
taccggcaggacgcctacgacgg

SEQ ID NO: 1723 - DNA, 23 bp, Artificial Sequence
  HLA-A targeting gRNA
tgccgtcgtaggcgtcctgccgg

SEQ ID NO: 1724 - DNA, 23 bp, Artificial Sequence
  HLA-A targeting gRNA
gaggatgtgtggctgcgacgtgg

SEQ ID NO: 1725 - DNA, 23 bp, Artificial Sequence
  HLA-A targeting gRNA
gaggatgtttggctgcgacgtgg

SEQ ID NO: 1726 - DNA, 23 bp, Artificial Sequence
  HLA-A targeting gRNA
gaggcccaggtgcctttacccgg

SEQ ID NO: 1727 - DNA, 23 bp, Artificial Sequence
  HLA-A targeting gRNA
gaggctgtggtggtgccttctgg

SEQ ID NO: 1728 - DNA, 23 bp, Artificial Sequence
  HLA-A targeting gRNA
aggcgtcctgccggtacccgcgg

SEQ ID NO: 1729 - DNA, 23 bp, Artificial Sequence
  HLA-A targeting gRNA
cgcagccatacatcctctggagg

SEQ ID NO: 1730 - DNA, 23 bp, Artificial Sequence
  HLA-A targeting gRNA
cgtcctgccggtacccgcggagg

SEQ ID NO: 1731 - DNA, 23 bp, Artificial Sequence
  HLA-A targeting gRNA
ccccccgggttggtcggggccgg

SEQ ID NO: 1732 - DNA, 23 bp, Artificial Sequence
  HLA-A targeting gRNA
ccggccccgaccaacccgggggg

SEQ ID NO: 1733 - DNA, 23 bp, Artificial Sequence
  HLA-A targeting gRNA
cttcctccgcgggtaccggcagg

SEQ ID NO: 1734 - DNA, 23 bp, Artificial Sequence
  HLA-A targeting gRNA
gatcacacggacctggcagcggg

SEQ ID NO: 1735 - DNA, 23 bp, Artificial Sequence
  HLA-A targeting gRNA
ggcgcttcctccgcgggtaccgg

SEQ ID NO: 1736 - DNA, 23 bp, Artificial Sequence
  HLA-A targeting gRNA
actgggctgaccgcggggtcggg

SEQ ID NO: 1737 - DNA, 23 bp, Artificial Sequence
  HLA-A targeting gRNA
gactgggctgaccgcggggtcgg

SEQ ID NO: 1738 - DNA, 23 bp, Artificial Sequence
  HLA-A targeting gRNA
ctgggctgaccgcggggtcgggg

SEQ ID NO: 1739 - DNA, 23 bp, Artificial Sequence
  HLA-A targeting gRNA
gcagccaaacatcctctggacgg

SEQ ID NO: 1740 - DNA, 23 bp, Artificial Sequence
  HLA-A targeting gRNA
gcagccacacatcctctggacgg

SEQ ID NO: 1741 - DNA, 23 bp, Artificial Sequence
  HLA-A targeting gRNA
gcagccatacatcatctggaggg

SEQ ID NO: 1742 - DNA, 23 bp, Artificial Sequence
  HLA-A targeting gRNA
gcagttgaaagcctacctggagg

SEQ ID NO: 1743 - DNA, 23 bp, Artificial Sequence
  HLA-A targeting gRNA
agaacctggccccgaccccgcgg

SEQ ID NO: 1744 - DNA, 23 bp, Artificial Sequence
  HLA-A targeting gRNA
ctgaccgcggggtcggggccagg

SEQ ID NO: 1745 - DNA, 23 bp, Artificial Sequence
  HLA-A targeting gRNA
gcgcgatccgcaggctctctcgg

SEQ ID NO: 1746 - DNA, 23 bp, Artificial Sequence
  HLA-A targeting gRNA
accttgattacggcggtgatggg

SEQ ID NO: 1747 - DNA, 23 bp, Artificial Sequence
  HLA-A targeting gRNA
atttatcaccttgattacggcgg

SEQ ID NO: 1748 - DNA, 23 bp, Artificial Sequence
  HLA-A targeting gRNA
caccttgattacggcggtgatgg

SEQ ID NO: 1749 - DNA, 23 bp, Artificial Sequence
  HLA-A targeting gRNA
tcccatcaccgccgtaatcaagg

SEQ ID NO: 1750 - DNA, 23 bp, Artificial Sequence
  HLA-A targeting gRNA
agtagcggagcgcgatccgcagg

SEQ ID NO: 1751 - DNA, 23 bp, Artificial Sequence
  HLA-A targeting gRNA
agactgaccgagagagcctgcgg

SEQ ID NO: 1752 - DNA, 23 bp, Artificial Sequence
  HLA-A targeting gRNA
cagatttatcaccttgattacgg

SEQ ID NO: 1753 - DNA, 23 bp, Artificial Sequence
  HLA-A targeting gRNA
gcaggacgcctacgacggcaagg

SEQ ID NO: 1754 - DNA, 23 bp, Artificial Sequence
  HLA-A targeting gRNA
gctgcgacgtggggtcggacggg

SEQ ID NO: 1755 - DNA, 23 bp, Artificial Sequence
  HLA-A targeting gRNA
ggctgcgacgtggggtcggacgg

SEQ ID NO: 1756 - DNA, 23 bp, Artificial Sequence
  HLA-A targeting gRNA
ggaagacggctctgggaaaaggg

SEQ ID NO: 1757 - DNA, 23 bp, Artificial Sequence
  HLA-A targeting gRNA
tcggacgggcgcttcctccgcgg

SEQ ID NO: 1758 - DNA, 23 bp, Artificial Sequence
  HLA-A targeting gRNA
ggaaggttccatcccctggcagg

SEQ ID NO: 1759 - DNA, 23 bp, Artificial Sequence
  HLA-A targeting gRNA
ggacctgcgctctttgaccgcgg

SEQ ID NO: 1760 - DNA, 23 bp, Artificial Sequence
  HLA-A targeting gRNA
atttctacacctccgtgtcccgg

SEQ ID NO: 1761 - DNA, 23 bp, Artificial Sequence
  HLA-A targeting gRNA
tacacctccgtgtcccggcccgg

SEQ ID NO: 1762 - DNA, 23 bp, Artificial Sequence
  HLA-A targeting gRNA
ggagcagttgaaagcctacctgg

SEQ ID NO: 1763 - DNA, 23 bp, Artificial Sequence
  HLA-A targeting gRNA
ttggaccgcggcggacatggcgg

SEQ ID NO: 1764 - DNA, 23 bp, Artificial Sequence
  HLA-A targeting gRNA
ggggtcccgcggcttcggggtgg

SEQ ID NO: 1765 - DNA, 23 bp, Artificial Sequence
  HLA-A targeting gRNA
ctgagccgccatgtccgccgcgg

SEQ ID NO: 1766 - DNA, 23 bp, Artificial Sequence
  HLA-A targeting gRNA
atctggatggtgtgagaacctgg

SEQ ID NO: 1767 - DNA, 23 bp, Artificial Sequence
  HLA-A targeting gRNA
cacgggcccaaggctgctgccgg

SEQ ID NO: 1768 - DNA, 23 bp, Artificial Sequence
  HLA-A targeting gRNA
ggagtgagagcctggggaccagg

SEQ ID NO: 1769 - DNA, 23 bp, Artificial Sequence
  HLA-A targeting gRNA
tgaacgaggacctgcgctcttgg

SEQ ID NO: 1770 - DNA, 23 bp, Artificial Sequence
  HLA-A targeting gRNA
ggaggtgtagaaatacctcatgg

SEQ ID NO: 1771 - DNA, 23 bp, Artificial Sequence
  HLA-A targeting gRNA
ggatgtgtagaaatacctcatgg

SEQ ID NO: 1772 - DNA, 23 bp, Artificial Sequence
  HLA-A targeting gRNA
ggatgtgtggctgcgacgtgggg

SEQ ID NO: 1773 - DNA, 23 bp, Artificial Sequence
  HLA-A targeting gRNA
ggatgtttggctgcgacgtgggg

SEQ ID NO: 1774 - DNA, 23 bp, Artificial Sequence
  HLA-A targeting gRNA
ggcataatgtgaggagggtgggg

SEQ ID NO: 1775 - DNA, 23 bp, Artificial Sequence
  HLA-A targeting gRNA
agatggggtaaggagggagatgg

SEQ ID NO: 1776 - DNA, 23 bp, Artificial Sequence
  HLA-A targeting gRNA
atggggtaaggagggagatgggg

SEQ ID NO: 1777 - DNA, 23 bp, Artificial Sequence
  HLA-A targeting gRNA
gatggggtaaggagggagatggg

SEQ ID NO: 1778 - DNA, 23 bp, Artificial Sequence
  HLA-A targeting gRNA
tggggtaaggagggagatggggg

SEQ ID NO: 1779 - DNA, 23 bp, Artificial Sequence
  HLA-A targeting gRNA
ggccgtctcccacttgtgcttgg

SEQ ID NO: 1780 - DNA, 23 bp, Artificial Sequence
  HLA-A targeting gRNA
gggaagacggctctgggaaaagg

SEQ ID NO: 1781 - DNA, 23 bp, Artificial Sequence
  HLA-A targeting gRNA
cgagatccaccccgaagccgcgg

SEQ ID NO: 1782 - DNA, 23 bp, Artificial Sequence
  HLA-A targeting gRNA
cgcggcttcggggtggatctcgg

SEQ ID NO: 1783 - DNA, 23 bp, Artificial Sequence
  HLA-A targeting gRNA
gagatccaccccgaagccgcggg

SEQ ID NO: 1784 - DNA, 23 bp, Artificial Sequence
  HLA-A targeting gRNA
ttcggggtggatctcggacccgg

SEQ ID NO: 1785 - DNA, 23 bp, Artificial Sequence
  HLA-A targeting gRNA
gggcgggtctcagccactcctgg

SEQ ID NO: 1786 - DNA, 23 bp, Artificial Sequence
  HLA-A targeting gRNA
gggctcctcgcggccgggccggg

SEQ ID NO: 1787 - DNA, 23 bp, Artificial Sequence
  HLA-A targeting gRNA
gctatggggtttctttgcattgg

SEQ ID NO: 1788 - DNA, 23 bp, Artificial Sequence
  HLA-A targeting gRNA
ggggctcctcgcggccgggccgg

SEQ ID NO: 1789 - DNA, 23 bp, Artificial Sequence
  HLA-A targeting gRNA
gcagaccctcatgctgcacatgg

SEQ ID NO: 1790 - DNA, 23 bp, Artificial Sequence
  HLA-A targeting gRNA
gtatggctgcgacgtggggccgg

SEQ ID NO: 1791 - DNA, 23 bp, Artificial Sequence
  HLA-A targeting gRNA
gagtccctcagcctccactcagg

SEQ ID NO: 1792 - DNA, 23 bp, Artificial Sequence
  HLA-A targeting gRNA
gctgagggactcagaagtgctgg

SEQ ID NO: 1793 - DNA, 23 bp, Artificial Sequence
  HLA-A targeting gRNA
gggtgaagggatgaagggtgggg

SEQ ID NO: 1794 - DNA, 23 bp, Artificial Sequence
  HLA-A targeting gRNA
cctcagcctccactcaggtcagg

SEQ ID NO: 1795 - DNA, 23 bp, Artificial Sequence
  HLA-A targeting gRNA
cctgacctgagtggaggctgagg

SEQ ID NO: 1796 - DNA, 23 bp, Artificial Sequence
  HLA-A targeting gRNA
ctgacctgagtggaggctgaggg

SEQ ID NO: 1797 - DNA, 23 bp, Artificial Sequence
  HLA-A targeting gRNA
ccagttcgcctacgacggcaagg

SEQ ID NO: 1798 - DNA, 23 bp, Artificial Sequence
  HLA-A targeting gRNA
ccttgccgtcgtaggcgaactgg

SEQ ID NO: 1799 - DNA, 23 bp, Artificial Sequence
  HLA-A targeting gRNA
gagataccagaaaggagccaggg

SEQ ID NO: 1800 - DNA, 23 bp, Artificial Sequence
  HLA-A targeting gRNA
gctcctttctggtatctcacagg

SEQ ID NO: 1801 - DNA, 23 bp, Artificial Sequence
  HLA-A targeting gRNA
tgagataccagaaaggagccagg

SEQ ID NO: 1802 - DNA, 23 bp, Artificial Sequence
  HLA-A targeting gRNA
agaaaggagccagggccttaagg

SEQ ID NO: 1803 - DNA, 23 bp, Artificial Sequence
  HLA-A targeting gRNA
ccagggccttaaggtcctagagg

SEQ ID NO: 1804 - DNA, 23 bp, Artificial Sequence
  HLA-A targeting gRNA
cctctaggaccttaaggccctgg

SEQ ID NO: 1805 - DNA, 23 bp, Artificial Sequence
  HLA-A targeting gRNA
ttaaggccctggctcctttctgg

SEQ ID NO: 1806 - DNA, 23 bp, Artificial Sequence
  HLA-A targeting gRNA
cagtggagagcctacctggaggg

SEQ ID NO: 1807 - DNA, 23 bp, Artificial Sequence
  HLA-A targeting gRNA
gcagtggagagcctacctggagg

SEQ ID NO: 1808 - DNA, 23 bp, Artificial Sequence
  HLA-A targeting gRNA
ggagcagtggagagcctacctgg

SEQ ID NO: 1809 - DNA, 23 bp, Artificial Sequence
  HLA-A targeting gRNA
gcggccgggccgggacacggagg

SEQ ID NO: 1810 - DNA, 23 bp, Artificial Sequence
  HLA-A targeting gRNA
ggtgtggctccgcagatacctgg

SEQ ID NO: 1811 - DNA, 23 bp, Artificial Sequence
  HLA-A targeting gRNA
ggttagtcatatgcgttttgggg

SEQ ID NO: 1812 - DNA, 23 bp, Artificial Sequence
  HLA-A targeting gRNA
aaaaatccccccgggttggtcgg

SEQ ID NO: 1813 - DNA, 23 bp, Artificial Sequence
  HLA-A targeting gRNA
aaaatccccccgggttggtcggg

SEQ ID NO: 1814 - DNA, 23 bp, Artificial Sequence
  HLA-A targeting gRNA
gtattcgagggatcgtcttccgg

SEQ ID NO: 1815 - DNA, 23 bp, Artificial Sequence
  HLA-A targeting gRNA
aaatccccccgggttggtcgggg

SEQ ID NO: 1816 - DNA, 23 bp, Artificial Sequence
  HLA-A targeting gRNA
gaccaacccggggggatttttgg

SEQ ID NO: 1817 - DNA, 23 bp, Artificial Sequence
  HLA-A targeting gRNA
ggccaaaaatccccccgggttgg

SEQ ID NO: 1818 - DNA, 23 bp, Artificial Sequence
  HLA-A targeting gRNA
gtttaggccaaaaatccccccgg

SEQ ID NO: 1819 - DNA, 23 bp, Artificial Sequence
  HLA-A targeting gRNA
tttaggccaaaaatccccccggg

SEQ ID NO: 1820 - DNA, 23 bp, Artificial Sequence
  HLA-A targeting gRNA
cggacgggcgcttcctccgcggg

SEQ ID NO: 1821 - DNA, 23 bp, Artificial Sequence
  HLA-A targeting gRNA
cgggggactgggctgaccgcggg

SEQ ID NO: 1822 - DNA, 23 bp, Artificial Sequence
  HLA-A targeting gRNA
tcgggggactgggctgaccgcgg

SEQ ID NO: 1823 - DNA, 23 bp, Artificial Sequence
  HLA-A targeting gRNA
tggagggcctgtgcgtggagtgg

SEQ ID NO: 1824 - DNA, 23 bp, Artificial Sequence
  HLA-A targeting gRNA
tgcggagccactccacgcacagg

SEQ ID NO: 1825 - DNA, 23 bp, Artificial Sequence
  HLA-A targeting gRNA
ccgctactacaaccagagcgagg

SEQ ID NO: 1826 - DNA, 23 bp, Artificial Sequence
  HLA-A targeting gRNA
cctcgctctggttgtagtagcgg

SEQ ID NO: 1827 - DNA, 23 bp, Artificial Sequence
  HLA-A targeting gRNA
gtggagaccaggcctgccagggg

SEQ ID NO: 1828 - DNA, 23 bp, Artificial Sequence
  HLA-A targeting gRNA
gtggttagtcatatgcgttttgg

SEQ ID NO: 1829 - DNA, 23 bp, Artificial Sequence
  HLA-A targeting gRNA
gtgtaggcataatgtgaggaggg

SEQ ID NO: 1830 - DNA, 23 bp, Artificial Sequence
  HLA-A targeting gRNA
gtgtgactgcagacccaggcggg

SEQ ID NO: 1831 - DNA, 23 bp, Artificial Sequence
  HLA-A targeting gRNA
gtgtggctgcgacgtggggtcgg

SEQ ID NO: 1832 - DNA, 23 bp, Artificial Sequence
  HLA-A targeting gRNA
gttagtcatatgcgttttggggg

SEQ ID NO: 1833 - DNA, 23 bp, Artificial Sequence
  HLA-A targeting gRNA
gttccatcccctggcaggcctgg

SEQ ID NO: 1834 - DNA, 23 bp, Artificial Sequence
  HLA-A targeting gRNA
gggggactgggctgaccgcgggg

SEQ ID NO: 1835 - DNA, 23 bp, Artificial Sequence
  HLA-A targeting gRNA
taaggccctgactcctttctggg

SEQ ID NO: 1836 - DNA, 23 bp, Artificial Sequence
  HLA-A targeting gRNA
tacacatccgtgtcccggcccgg

SEQ ID NO: 1837 - DNA, 23 bp, Artificial Sequence
  HLA-A targeting gRNA
taccaccactacgcctacgacgg

SEQ ID NO: 1838 - DNA, 23 bp, Artificial Sequence
  HLA-A targeting gRNA
taccaccagttcgcctacgacgg

SEQ ID NO: 1839 - DNA, 23 bp, Artificial Sequence
  HLA-A targeting gRNA
tactgcaaccagagcgaggccgg

SEQ ID NO: 1840 - DNA, 23 bp, Artificial Sequence
  HLA-A targeting gRNA
taggcataatgtgaggagggtgg

SEQ ID NO: 1841 - DNA, 23 bp, Artificial Sequence
  HLA-A targeting gRNA
tagtacaaccagagcgaggccgg

SEQ ID NO: 1842 - DNA, 23 bp, Artificial Sequence
  HLA-A targeting gRNA
actccacgcacaggccctccagg

SEQ ID NO: 1843 - DNA, 23 bp, Artificial Sequence
  HLA-A targeting gRNA
tcagggtggcttcatggtcaggg

SEQ ID NO: 1844 - DNA, 23 bp, Artificial Sequence
  HLA-A targeting gRNA
cacgcacaggccctccaggtagg

SEQ ID NO: 1845 - DNA, 23 bp, Artificial Sequence
  HLA-A targeting gRNA
ctacctggagggcctgtgcgtgg

SEQ ID NO: 1846 - DNA, 23 bp, Artificial Sequence
  HLA-A targeting gRNA
tcatgtttcctgatcccgcctgg

SEQ ID NO: 1847 - DNA, 23 bp, Artificial Sequence
  HLA-A targeting gRNA
tcgtggagaccaggcctgccagg

SEQ ID NO: 1848 - DNA, 23 bp, Artificial Sequence
  HLA-A targeting gRNA
tctaccctgcggagatcacacgg

SEQ ID NO: 1849 - DNA, 23 bp, Artificial Sequence
  HLA-A targeting gRNA
tctccactgctccgcctcatggg

SEQ ID NO: 1850 - DNA, 23 bp, Artificial Sequence
  HLA-A targeting gRNA
tctcccccagacgccgaggatgg

SEQ ID NO: 1851 - DNA, 23 bp, Artificial Sequence
  HLA-A targeting gRNA
tctgggaaaaggggaaggtgagg

SEQ ID NO: 1852 - DNA, 23 bp, Artificial Sequence
  HLA-A targeting gRNA
tctggttgcagtagccgcgcagg

SEQ ID NO: 1853 - DNA, 23 bp, Artificial Sequence
  HLA-A targeting gRNA
tctggttgtactagccgcgcagg

SEQ ID NO: 1854 - DNA, 23 bp, Artificial Sequence
  HLA-A targeting gRNA
tgaaaccgggtaaaggcacctgg

SEQ ID NO: 1855 - DNA, 23 bp, Artificial Sequence
  HLA-A targeting gRNA
tgaaagacgacctgcgctcttgg

SEQ ID NO: 1856 - DNA, 23 bp, Artificial Sequence
  HLA-A targeting gRNA
tgaccgcggggtccgggccaggg

SEQ ID NO: 1857 - DNA, 23 bp, Artificial Sequence
  HLA-A targeting gRNA
tgagatcccagaaaggagtcagg

SEQ ID NO: 1858 - DNA, 23 bp, Artificial Sequence
  HLA-A targeting gRNA
gtgggaggcggcccgtgtggcgg

SEQ ID NO: 1859 - DNA, 23 bp, Artificial Sequence
  HLA-A targeting gRNA
cgccgtggatagagcaggagggg

SEQ ID NO: 1860 - DNA, 23 bp, Artificial Sequence
  HLA-A targeting gRNA
caagtgggaggcggcccgtgtgg

SEQ ID NO: 1861 - DNA, 23 bp, Artificial Sequence
  HLA-A targeting gRNA
ggcccctcctgctctatccacgg

SEQ ID NO: 1862 - DNA, 23 bp, Artificial Sequence
  HLA-A targeting gRNA
gtggatagagcaggaggggccgg

SEQ ID NO: 1863 - DNA, 23 bp, Artificial Sequence
  HLA-A targeting gRNA
tgccgtcgtaggcgaactggtgg

SEQ ID NO: 1864 - DNA, 23 bp, Artificial Sequence
  HLA-A targeting gRNA
tgccgtcgtaggcgtagtggtgg

SEQ ID NO: 1865 - DNA, 23 bp, Artificial Sequence
  HLA-A targeting gRNA
gctgcgacgtggggccggacggg

SEQ ID NO: 1866 - DNA, 23 bp, Artificial Sequence
  HLA-A targeting gRNA
ggctgcgacgtggggccggacgg

SEQ ID NO: 1867 - DNA, 23 bp, Artificial Sequence
  HLA-A targeting gRNA
tggaaccttccagaagtgggagg

SEQ ID NO: 1868 - DNA, 23 bp, Artificial Sequence
  HLA-A targeting gRNA
ccgcggaggaggcgcccgtccgg

SEQ ID NO: 1869 - DNA, 23 bp, Artificial Sequence
  HLA-A targeting gRNA
ccggacgggcgcctcctccgcgg

SEQ ID NO: 1870 - DNA, 23 bp, Artificial Sequence
  HLA-A targeting gRNA
cggacgggcgcctcctccgcggg

SEQ ID NO: 1871 - DNA, 23 bp, Artificial Sequence
  HLA-A targeting gRNA
tggagggcacgtgcgtggtgtgg

SEQ ID NO: 1872 - DNA, 23 bp, Artificial Sequence
  HLA-A targeting gRNA
tgggaaaaggggaaggtgagggg

SEQ ID NO: 1873 - DNA, 23 bp, Artificial Sequence
  HLA-A targeting gRNA
tggttagtcatatgcgttttggg

SEQ ID NO: 1874 - DNA, 23 bp, Artificial Sequence
  HLA-A targeting gRNA
cacccagcgcaagtgggaggcgg

SEQ ID NO: 1875 - DNA, 23 bp, Artificial Sequence
  HLA-A targeting gRNA
tgtcctgtgagatcccagaaagg

SEQ ID NO: 1876 - DNA, 23 bp, Artificial Sequence
  HLA-A targeting gRNA
gggccgcctcccacttgcgctgg

SEQ ID NO: 1877 - DNA, 23 bp, Artificial Sequence
  HLA-A targeting gRNA
ggccgcctcccacttgcgctggg

SEQ ID NO: 1878 - DNA, 23 bp, Artificial Sequence
  HLA-A targeting gRNA
gatcacccagcgcaagtgggagg

SEQ ID NO: 1879 - DNA, 23 bp, Artificial Sequence
  HLA-A targeting gRNA
ctcagatcacccagcgcaagtgg

SEQ ID NO: 1880 - DNA, 23 bp, Artificial Sequence
  HLA-A targeting gRNA
tcagatcacccagcgcaagtggg

SEQ ID NO: 1881 - DNA, 23 bp, Artificial Sequence
  HLA-A targeting gRNA
tgtgtgactgcagacccaggcgg

SEQ ID NO: 1882 - DNA, 23 bp, Artificial Sequence
  HLA-A targeting gRNA
ttagaccaccaagcacaagtggg

SEQ ID NO: 1883 - DNA, 23 bp, Artificial Sequence
  HLA-A targeting gRNA
agcacctcagggtggcctcatgg

SEQ ID NO: 1884 - DNA, 23 bp, Artificial Sequence
  HLA-A targeting gRNA
atgaggccaccctgaggtgctgg

SEQ ID NO: 1885 - DNA, 23 bp, Artificial Sequence
  HLA-A targeting gRNA
ctgaccatgaggccaccctgagg

SEQ ID NO: 1886 - DNA, 23 bp, Artificial Sequence
  HLA-A targeting gRNA
tgaggccaccctgaggtgctggg

SEQ ID NO: 1887 - DNA, 23 bp, Artificial Sequence
  HLA-A targeting gRNA
ttctggaaggttccatcccctgg

SEQ ID NO: 1888 - DNA, 23 bp, Artificial Sequence
  HLA-A targeting gRNA
agcaggaggggccggagtattgg

SEQ ID NO: 1889 - DNA, 23 bp, Artificial Sequence
  HLA-A targeting gRNA
gcaggaggggccggagtattggg

SEQ ID NO: 1890 - DNA, 23 bp, Artificial Sequence
  HLA-A targeting gRNA
ttggtgagtcatatgcgttttgg

SEQ ID NO: 1891 - DNA, 23 bp, Artificial Sequence
  HLA-A targeting gRNA
tttcaactgctccgccacatggg

SEQ ID NO: 1892 - DNA, 23 bp, Artificial Sequence
  HLA-A targeting gRNA
acggccattctcggcgtctgggg

SEQ ID NO: 1893 - DNA, 23 bp, Artificial Sequence
  HLA-A targeting gRNA
aaaaatccccccgggtgggtcgg

SEQ ID NO: 1894 - DNA, 23 bp, Artificial Sequence
  HLA-A targeting gRNA
gacgccgagaatggccgtcatgg

SEQ ID NO: 1895 - DNA, 23 bp, Artificial Sequence
  HLA-A targeting gRNA
aaaaatccccctggttggtcggg

SEQ ID NO: 1896 - DNA, 23 bp, Artificial Sequence
  HLA-A targeting gRNA
aaaaatctctgaaggaatgacgg

SEQ ID NO: 1897 - DNA, 23 bp, Artificial Sequence
  HLA-A targeting gRNA
gacggccattctcggcgtctggg

SEQ ID NO: 1898 - DNA, 23 bp, Artificial Sequence
  HLA-A targeting gRNA
gagcccctcagcctccactcagg

SEQ ID NO: 1899 - DNA, 23 bp, Artificial Sequence
  HLA-A targeting gRNA
gctgaggggctcagaagtgctgg

SEQ ID NO: 1900 - DNA, 23 bp, Artificial Sequence
  HLA-A targeting gRNA
aaaaggagggagttactctcagg

SEQ ID NO: 1901 - DNA, 23 bp, Artificial Sequence
  HLA-A targeting gRNA
ggcgccatgacggccattctcgg

SEQ ID NO: 1902 - DNA, 23 bp, Artificial Sequence
  HLA-A targeting gRNA
aaaatccccccgggtgggtcggg

SEQ ID NO: 1903 - DNA, 23 bp, Artificial Sequence
  HLA-A targeting gRNA
tgacctgagtggaggctgagggg

SEQ ID NO: 1904 - DNA, 23 bp, Artificial Sequence
  HLA-A targeting gRNA
aaaatccccctggttggtcgggg

SEQ ID NO: 1905 - DNA, 23 bp, Artificial Sequence
  HLA-A targeting gRNA
tgacggccattctcggcgtctgg

SEQ ID NO: 1906 - DNA, 23 bp, Artificial Sequence
  HLA-A targeting gRNA
ttctccccagacgccgagaatgg

SEQ ID NO: 1907 - DNA, 23 bp, Artificial Sequence
  HLA-A targeting gRNA
aaaccgggttaaaggcgcctggg

SEQ ID NO: 1908 - DNA, 23 bp, Artificial Sequence
  HLA-A targeting gRNA
aaatccccccgggtgggtcgggg

SEQ ID NO: 1909 - DNA, 23 bp, Artificial Sequence
  HLA-A targeting gRNA
acctctggtcctgacctgagtgg

SEQ ID NO: 1910 - DNA, 23 bp, Artificial Sequence
  HLA-A targeting gRNA
aaatgtgtgaatgcagacccagg

SEQ ID NO: 1911 - DNA, 23 bp, Artificial Sequence
  HLA-A targeting gRNA
aggcctcatcccccacggacggg

SEQ ID NO: 1912 - DNA, 23 bp, Artificial Sequence
  HLA-A targeting gRNA
aggtcgctgttccctcctcaggg

SEQ ID NO: 1913 - DNA, 23 bp, Artificial Sequence
  HLA-A targeting gRNA
atgaggcctgcgccccgggccgg

SEQ ID NO: 1914 - DNA, 23 bp, Artificial Sequence
  HLA-A targeting gRNA
cagcctggacacagacacctggg

SEQ ID NO: 1915 - DNA, 23 bp, Artificial Sequence
  HLA-A targeting gRNA
caggcctcatcccccacggacgg

SEQ ID NO: 1916 - DNA, 23 bp, Artificial Sequence
  HLA-A targeting gRNA
catcgggagaatctgagtcccgg

SEQ ID NO: 1917 - DNA, 23 bp, Artificial Sequence
  HLA-A targeting gRNA
cattactggaaacttctctgagg

SEQ ID NO: 1918 - DNA, 23 bp, Artificial Sequence
  HLA-A targeting gRNA
ccagcctggacacagacacctgg

SEQ ID NO: 1919 - DNA, 23 bp, Artificial Sequence
  HLA-A targeting gRNA
aagaagagctcaggtggagaagg

SEQ ID NO: 1920 - DNA, 23 bp, Artificial Sequence
  HLA-A targeting gRNA
ccaggtgtctgtgtccaggctgg

SEQ ID NO: 1921 - DNA, 23 bp, Artificial Sequence
  HLA-A targeting gRNA
cgggactcagattctcccgatgg

SEQ ID NO: 1922 - DNA, 23 bp, Artificial Sequence
  HLA-A targeting gRNA
cgggagaatctgagtcccggtgg

SEQ ID NO: 1923 - DNA, 23 bp, Artificial Sequence
  HLA-A targeting gRNA
cggggcgccatgacggccatcgg

SEQ ID NO: 1924 - DNA, 23 bp, Artificial Sequence
  HLA-A targeting gRNA
ctcaggcagtgacagtgcccagg

SEQ ID NO: 1925 - DNA, 23 bp, Artificial Sequence
  HLA-A targeting gRNA
ctgggcactgtcactgcctgagg

SEQ ID NO: 1926 - DNA, 23 bp, Artificial Sequence
  HLA-A targeting gRNA
gaggagggaacagcgacctctgg

SEQ ID NO: 1927 - DNA, 23 bp, Artificial Sequence
  HLA-A targeting gRNA
gaggcctgcgccccgggccgggg

SEQ ID NO: 1928 - DNA, 23 bp, Artificial Sequence
  HLA-A targeting gRNA
gaggtcgctgttccctcctcagg

SEQ ID NO: 1929 - DNA, 23 bp, Artificial Sequence
  HLA-A targeting gRNA
aagcagggctccccgcggccggg

SEQ ID NO: 1930 - DNA, 23 bp, Artificial Sequence
  HLA-A targeting gRNA
gattctcccgatggccgtcatgg

SEQ ID NO: 1931 - DNA, 23 bp, Artificial Sequence
  HLA-A targeting gRNA
ggcgcaggcctcatcccccacgg

SEQ ID NO: 1932 - DNA, 23 bp, Artificial Sequence
  HLA-A targeting gRNA
gggacactccagcatgcatgtgg

SEQ ID NO: 1933 - DNA, 23 bp, Artificial Sequence
  HLA-A targeting gRNA
aagcggggttccccgcggccggg

SEQ ID NO: 1934 - DNA, 23 bp, Artificial Sequence
  HLA-A targeting gRNA
ggggatgaggcctgcgccccggg

SEQ ID NO: 1935 - DNA, 23 bp, Artificial Sequence
  HLA-A targeting gRNA
aagcgtcctgctggtacccgcgg

SEQ ID NO: 1936 - DNA, 23 bp, Artificial Sequence
  HLA-A targeting gRNA
aaggaaacgctgcagcgcacggg

SEQ ID NO: 1937 - DNA, 23 bp, Artificial Sequence
  HLA-A targeting gRNA
aaggagacgctgcagcgcacagg

SEQ ID NO: 1938 - DNA, 23 bp, Artificial Sequence
  HLA-A targeting gRNA
ggggcgccatgacggccatcggg

SEQ ID NO: 1939 - DNA, 23 bp, Artificial Sequence
  HLA-A targeting gRNA
aaggagacgctgcagcgcactgg

SEQ ID NO: 1940 - DNA, 23 bp, Artificial Sequence
  HLA-A targeting gRNA
gggggatgaggcctgcgccccgg

SEQ ID NO: 1941 - DNA, 23 bp, Artificial Sequence
  HLA-A targeting gRNA
aaggagatgctgcagcgcacggg

SEQ ID NO: 1942 - DNA, 23 bp, Artificial Sequence
  HLA-A targeting gRNA
aaggatgcccacgatggggatgg

SEQ ID NO: 1943 - DNA, 23 bp, Artificial Sequence
  HLA-A targeting gRNA
ggtctgcagtcacacattactgg

SEQ ID NO: 1944 - DNA, 23 bp, Artificial Sequence
  HLA-A targeting gRNA
ggtgagacccctcactgtgatgg

SEQ ID NO: 1945 - DNA, 23 bp, Artificial Sequence
  HLA-A targeting gRNA
taatgtgtgactgcagacccagg

SEQ ID NO: 1946 - DNA, 23 bp, Artificial Sequence
  HLA-A targeting gRNA
aagtcgctgttccctcgtcaggg

SEQ ID NO: 1947 - DNA, 23 bp, Artificial Sequence
  HLA-A targeting gRNA
aagtcgctgttccctctgcaggg

SEQ ID NO: 1948 - DNA, 23 bp, Artificial Sequence
  HLA-A targeting gRNA
tatcccaggtgtctgtgtccagg

SEQ ID NO: 1949 - DNA, 23 bp, Artificial Sequence
  HLA-A targeting gRNA
tcaggcagtgacagtgcccaggg

SEQ ID NO: 1950 - DNA, 23 bp, Artificial Sequence
  HLA-A targeting gRNA
aatcatgggcccacccagcctgg

SEQ ID NO: 1951 - DNA, 23 bp, Artificial Sequence
  HLA-A targeting gRNA
tccactcaggtcaggaccagagg

SEQ ID NO: 1952 - DNA, 23 bp, Artificial Sequence
  HLA-A targeting gRNA
tctgtgtccaggctggtgtctgg

SEQ ID NO: 1953 - DNA, 23 bp, Artificial Sequence
  HLA-A targeting gRNA
tgaggcctgcgccccgggccggg

SEQ ID NO: 1954 - DNA, 23 bp, Artificial Sequence
  HLA-A targeting gRNA
aatctgtccttcattgtaacagg

SEQ ID NO: 1955 - DNA, 23 bp, Artificial Sequence
  HLA-A targeting gRNA
ttctgtttttgttctacctcagg

SEQ ID NO: 1956 - DNA, 23 bp, Artificial Sequence
  HLA-A targeting gRNA
aatcttctattccctgacgaggg

SEQ ID NO: 1957 - DNA, 23 bp, Artificial Sequence
  HLA-A targeting gRNA
aatcttctattccctgcagaggg

SEQ ID NO: 1958 - DNA, 23 bp, Artificial Sequence
  HLA-A targeting gRNA
aatgatgcccacaatggggatgg

SEQ ID NO: 1959 - DNA, 23 bp, Artificial Sequence
  HLA-A targeting gRNA
agaacctggcctcgaccccgcgg

SEQ ID NO: 1960 - DNA, 23 bp, Artificial Sequence
  HLA-A targeting gRNA
aatgatgcccacgatgtggacgg

SEQ ID NO: 1961 - DNA, 23 bp, Artificial Sequence
  HLA-A targeting gRNA
ctgaccgcggggtcgaggccagg

SEQ ID NO: 1962 - DNA, 23 bp, Artificial Sequence
  HLA-A targeting gRNA
aatggccacatgcgtgctggtgg

SEQ ID NO: 1963 - DNA, 23 bp, Artificial Sequence
  HLA-A targeting gRNA
ctgggctgaccgcggggtcgagg

SEQ ID NO: 1964 - DNA, 23 bp, Artificial Sequence
  HLA-A targeting gRNA
aatgtgccctgtctcattcctgg

SEQ ID NO: 1965 - DNA, 23 bp, Artificial Sequence
  HLA-A targeting gRNA
aatgtgtgaatgcagacccaggg

SEQ ID NO: 1966 - DNA, 23 bp, Artificial Sequence
  HLA-A targeting gRNA
aattcatatcactcacagtgagg

SEQ ID NO: 1967 - DNA, 23 bp, Artificial Sequence
  HLA-A targeting gRNA
aagcgtcctgccggtacccgcgg

SEQ ID NO: 1968 - DNA, 23 bp, Artificial Sequence
  HLA-A targeting gRNA
aattcatatctgtcacagtgagg

SEQ ID NO: 1969 - DNA, 23 bp, Artificial Sequence
  HLA-A targeting gRNA
taccggcaggacgcttacgacgg

SEQ ID NO: 1970 - DNA, 23 bp, Artificial Sequence
  HLA-A targeting gRNA
tgccgtcgtaagcgtcctgccgg

SEQ ID NO: 1971 - DNA, 23 bp, Artificial Sequence
  HLA-A targeting gRNA
aattgtgtcacagagcaggccgg

SEQ ID NO: 1972 - DNA, 23 bp, Artificial Sequence
  HLA-A targeting gRNA
cagcagagagcctacctggatgg

SEQ ID NO: 1973 - DNA, 23 bp, Artificial Sequence
  HLA-A targeting gRNA
aagccccgcttcatcgccgtggg

SEQ ID NO: 1974 - DNA, 23 bp, Artificial Sequence
  HLA-A targeting gRNA
aagcggggcttcccgcggccggg

SEQ ID NO: 1975 - DNA, 23 bp, Artificial Sequence
  HLA-A targeting gRNA
acaagggtctcggagccccgcgg

SEQ ID NO: 1976 - DNA, 23 bp, Artificial Sequence
  HLA-A targeting gRNA
acaagggtctcggagtcccgcgg

SEQ ID NO: 1977 - DNA, 23 bp, Artificial Sequence
  HLA-A targeting gRNA
cgatgaagcggggcttcccgcgg

SEQ ID NO: 1978 - DNA, 23 bp, Artificial Sequence
  HLA-A targeting gRNA
gaagccccgcttcatcgccgtgg

SEQ ID NO: 1979 - DNA, 23 bp, Artificial Sequence
  HLA-A targeting gRNA
gaagcggggcttcccgcggccgg

SEQ ID NO: 1980 - DNA, 23 bp, Artificial Sequence
  HLA-A targeting gRNA
acacacaccggcggcagccttgg

SEQ ID NO: 1981 - DNA, 23 bp, Artificial Sequence
  HLA-A targeting gRNA
acacactgaccgagtggacctgg

SEQ ID NO: 1982 - DNA, 23 bp, Artificial Sequence
  HLA-A targeting gRNA
gggcttcccgcggccgggccggg

SEQ ID NO: 1983 - DNA, 23 bp, Artificial Sequence
  HLA-A targeting gRNA
ggggcttcccgcggccgggccgg

SEQ ID NO: 1984 - DNA, 23 bp, Artificial Sequence
  HLA-A targeting gRNA
aattgagtcagagagcagggcgg

SEQ ID NO: 1985 - DNA, 23 bp, Artificial Sequence
  HLA-A targeting gRNA
ccccgggcggggtcactcaccgg

SEQ ID NO: 1986 - DNA, 23 bp, Artificial Sequence
  HLA-A targeting gRNA
acacagggcccaggctgggtggg

SEQ ID NO: 1987 - DNA, 23 bp, Artificial Sequence
  HLA-A targeting gRNA
acaccaacacagacacatgcagg

SEQ ID NO: 1988 - DNA, 23 bp, Artificial Sequence
  HLA-A targeting gRNA
ccggtgagtgaccccgcccgggg

SEQ ID NO: 1989 - DNA, 23 bp, Artificial Sequence
  HLA-A targeting gRNA
cctgctctctgactcaattaagg

SEQ ID NO: 1990 - DNA, 23 bp, Artificial Sequence
  HLA-A targeting gRNA
ccttaattgagtcagagagcagg

SEQ ID NO: 1991 - DNA, 23 bp, Artificial Sequence
  HLA-A targeting gRNA
acacggagctcgtggaggccagg

SEQ ID NO: 1992 - DNA, 23 bp, Artificial Sequence
  HLA-A targeting gRNA
cggtgagtgaccccgcccggggg

SEQ ID NO: 1993 - DNA, 23 bp, Artificial Sequence
  HLA-A targeting gRNA
cgtgacctgcgcccccgggcggg

SEQ ID NO: 1994 - DNA, 23 bp, Artificial Sequence
  HLA-A targeting gRNA
ctctcaactgctccgcccgacgg

SEQ ID NO: 1995 - DNA, 23 bp, Artificial Sequence
  HLA-A targeting gRNA
ctgctctctgactcaattaaggg

SEQ ID NO: 1996 - DNA, 23 bp, Artificial Sequence
  HLA-A targeting gRNA
acactgaccgagtggacctgggg

SEQ ID NO: 1997 - DNA, 23 bp, Artificial Sequence
  HLA-A targeting gRNA
acactgacctgacagcgggatgg

SEQ ID NO: 1998 - DNA, 23 bp, Artificial Sequence
  HLA-A targeting gRNA
cttaattgagtcagagagcaggg

SEQ ID NO: 1999 - DNA, 23 bp, Artificial Sequence
  HLA-A targeting gRNA
acagaacatgtggctagaggagg

SEQ ID NO: 2000 - DNA, 23 bp, Artificial Sequence
  HLA-A targeting gRNA
gccggtgagtgaccccgcccggg

SEQ ID NO: 2001 - DNA, 23 bp, Artificial Sequence
  HLA-A targeting gRNA
ggccggtgagtgaccccgcccgg

SEQ ID NO: 2002 - DNA, 23 bp, Artificial Sequence
  HLA-A targeting gRNA
acagaatctggaaacccaggagg

SEQ ID NO: 2003 - DNA, 23 bp, Artificial Sequence
  HLA-A targeting gRNA
acagacctcaggagggcgattgg

SEQ ID NO: 2004 - DNA, 23 bp, Artificial Sequence
  HLA-A targeting gRNA
acagacctcaggagggcggttgg

SEQ ID NO: 2005 - DNA, 23 bp, Artificial Sequence
  HLA-A targeting gRNA
gggtcgtgacctgcgcccccggg

SEQ ID NO: 2006 - DNA, 23 bp, Artificial Sequence
  HLA-A targeting gRNA
acagactaaccgagcgaacctgg

SEQ ID NO: 2007 - DNA, 23 bp, Artificial Sequence
  HLA-A targeting gRNA
gtgaccccgcccgggggcgcagg

SEQ ID NO: 2008 - DNA, 23 bp, Artificial Sequence
  HLA-A targeting gRNA
gtgacctgcgcccccgggcgggg

SEQ ID NO: 2009 - DNA, 23 bp, Artificial Sequence
  HLA-A targeting gRNA
tcgtgacctgcgcccccgggcgg

SEQ ID NO: 2010 - DNA, 23 bp, Artificial Sequence
  HLA-A targeting gRNA
tctcaactgctccgcccgacggg

SEQ ID NO: 2011 - DNA, 23 bp, Artificial Sequence
  HLA-A targeting gRNA
acagcgacgccgcgagccaaagg

SEQ ID NO: 2012 - DNA, 23 bp, Artificial Sequence
  HLA-A targeting gRNA
aagtaccagggccccaggcgtgg

SEQ ID NO: 2013 - DNA, 23 bp, Artificial Sequence
  HLA-A targeting gRNA
aggggtcagggcgaagtaccagg

SEQ ID NO: 2014 - DNA, 23 bp, Artificial Sequence
  HLA-A targeting gRNA
gggcgaagtaccagggccccagg

SEQ ID NO: 2015 - DNA, 23 bp, Artificial Sequence
  HLA-A targeting gRNA
ggggtcagggcgaagtaccaggg

SEQ ID NO: 2016 - DNA, 23 bp, Artificial Sequence
  HLA-A targeting gRNA
acagactgaccgagagaacctgg

SEQ ID NO: 2017 - DNA, 23 bp, Artificial Sequence
  HLA-A targeting gRNA
accttgattacggcagtgatggg

SEQ ID NO: 2018 - DNA, 23 bp, Artificial Sequence
  HLA-A targeting gRNA
agactgaccgagagaacctgggg

SEQ ID NO: 2019 - DNA, 23 bp, Artificial Sequence
  HLA-A targeting gRNA
caccttgattacggcagtgatgg

SEQ ID NO: 2020 - DNA, 23 bp, Artificial Sequence
  HLA-A targeting gRNA
cagactgaccgagagaacctggg

SEQ ID NO: 2021 - DNA, 23 bp, Artificial Sequence
  HLA-A targeting gRNA
acccaataggagtgagaactggg

SEQ ID NO: 2022 - DNA, 23 bp, Artificial Sequence
  HLA-A targeting gRNA
gagaacctggggaccctgcgcgg

SEQ ID NO: 2023 - DNA, 23 bp, Artificial Sequence
  HLA-A targeting gRNA
acccaattggagtgagaactggg

SEQ ID NO: 2024 - DNA, 23 bp, Artificial Sequence
  HLA-A targeting gRNA
acccagaccagcctggacacagg

SEQ ID NO: 2025 - DNA, 23 bp, Artificial Sequence
  HLA-A targeting gRNA
acccagcagtcacaagtcacagg

SEQ ID NO: 2026 - DNA, 23 bp, Artificial Sequence
  HLA-A targeting gRNA
acccagttctcactccaattggg

SEQ ID NO: 2027 - DNA, 23 bp, Artificial Sequence
  HLA-A targeting gRNA
gcagggtccccaggttctctcgg

SEQ ID NO: 2028 - DNA, 23 bp, Artificial Sequence
  HLA-A targeting gRNA
tcccatcactgccgtaatcaagg

SEQ ID NO: 2029 - DNA, 23 bp, Artificial Sequence
  HLA-A targeting gRNA
acccagttctcactcctattggg

SEQ ID NO: 2030 - DNA, 23 bp, Artificial Sequence
  HLA-A targeting gRNA
ttgggtgttgggcagaacagtgg

SEQ ID NO: 2031 - DNA, 23 bp, Artificial Sequence
  HLA-A targeting gRNA
acccctcatcccctacggacggg

SEQ ID NO: 2032 - DNA, 23 bp, Artificial Sequence
  HLA-A targeting gRNA
acccctcattccccacggacggg

SEQ ID NO: 2033 - DNA, 23 bp, Artificial Sequence
  HLA-A targeting gRNA
acccgccctggtctgggtcaggg

SEQ ID NO: 2034 - DNA, 23 bp, Artificial Sequence
  HLA-A targeting gRNA
attggggagtcacagccttgggg

SEQ ID NO: 2035 - DNA, 23 bp, Artificial Sequence
  HLA-A targeting gRNA
gattggggagtcacagccttggg

SEQ ID NO: 2036 - DNA, 23 bp, Artificial Sequence
  HLA-A targeting gRNA
ggattggggagtcacagccttgg

SEQ ID NO: 2037 - DNA, 23 bp, Artificial Sequence
  HLA-A targeting gRNA
aacaggaaagatgattggagagg

SEQ ID NO: 2038 - DNA, 23 bp, Artificial Sequence
  HLA-A targeting gRNA
acaggaaagatgattggagaggg

SEQ ID NO: 2039 - DNA, 23 bp, Artificial Sequence
  HLA-A targeting gRNA
atttctacacttccgtgtcccgg

SEQ ID NO: 2040 - DNA, 23 bp, Artificial Sequence
  HLA-A targeting gRNA
accctgagatgggataaggaggg

SEQ ID NO: 2041 - DNA, 23 bp, Artificial Sequence
  HLA-A targeting gRNA
ggaagtgtagaaatacctcatgg

SEQ ID NO: 2042 - DNA, 23 bp, Artificial Sequence
  HLA-A targeting gRNA
accctgagatgggttaaggaggg

SEQ ID NO: 2043 - DNA, 23 bp, Artificial Sequence
  HLA-A targeting gRNA
tacacttccgtgtcccggcccgg

SEQ ID NO: 2044 - DNA, 23 bp, Artificial Sequence
  HLA-A targeting gRNA
atttctacacctccatgtcccgg

SEQ ID NO: 2045 - DNA, 23 bp, Artificial Sequence
  HLA-A targeting gRNA
accgggctgaccgcggggtcggg

SEQ ID NO: 2046 - DNA, 23 bp, Artificial Sequence
  HLA-A targeting gRNA
gcggccgggccgggacatggagg

SEQ ID NO: 2047 - DNA, 23 bp, Artificial Sequence
  HLA-A targeting gRNA
tacacctccatgtcccggcccgg

SEQ ID NO: 2048 - DNA, 23 bp, Artificial Sequence
  HLA-A targeting gRNA
tccatgtcccggcccggccgcgg

SEQ ID NO: 2049 - DNA, 23 bp, Artificial Sequence
  HLA-A targeting gRNA
acctcatggagtaggagcctggg

SEQ ID NO: 2050 - DNA, 23 bp, Artificial Sequence
  HLA-A targeting gRNA
acccgaccctcctcccggcgcgg

SEQ ID NO: 2051 - DNA, 23 bp, Artificial Sequence
  HLA-A targeting gRNA
cgccgggaggagggtcgggtggg

SEQ ID NO: 2052 - DNA, 23 bp, Artificial Sequence
  HLA-A targeting gRNA
acctcatggattgggagcctggg

SEQ ID NO: 2053 - DNA, 23 bp, Artificial Sequence
  HLA-A targeting gRNA
gacccacccgaccctcctcccgg

SEQ ID NO: 2054 - DNA, 23 bp, Artificial Sequence
  HLA-A targeting gRNA
gcgccgggaggagggtcgggtgg

SEQ ID NO: 2055 - DNA, 23 bp, Artificial Sequence
  HLA-A targeting gRNA
acttcaagtcacaaagggaaggg

SEQ ID NO: 2056 - DNA, 23 bp, Artificial Sequence
  HLA-A targeting gRNA
agggtacttcaagtcacaaaggg

SEQ ID NO: 2057 - DNA, 23 bp, Artificial Sequence
  HLA-A targeting gRNA
cagggtacttcaagtcacaaagg

SEQ ID NO: 2058 - DNA, 23 bp, Artificial Sequence
  HLA-A targeting gRNA
tacttcaagtcacaaagggaagg

SEQ ID NO: 2059 - DNA, 23 bp, Artificial Sequence
  HLA-A targeting gRNA
aaaaattcccccgggttggtcgg

SEQ ID NO: 2060 - DNA, 23 bp, Artificial Sequence
  HLA-A targeting gRNA
aaaattcccccgggttggtcggg

SEQ ID NO: 2061 - DNA, 23 bp, Artificial Sequence
  HLA-A targeting gRNA
aaattcccccgggttggtcgggg

SEQ ID NO: 2062 - DNA, 23 bp, Artificial Sequence
  HLA-A targeting gRNA
aatcatgggcctacccagcctgg

SEQ ID NO: 2063 - DNA, 23 bp, Artificial Sequence
  HLA-A targeting gRNA
acagcacgcctacgacggcaagg

SEQ ID NO: 2064 - DNA, 23 bp, Artificial Sequence
  HLA-A targeting gRNA
aggcgtgctgttcatacccgcgg

SEQ ID NO: 2065 - DNA, 23 bp, Artificial Sequence
  HLA-A targeting gRNA
atcatgggcctacccagcctggg

SEQ ID NO: 2066 - DNA, 23 bp, Artificial Sequence
  HLA-A targeting gRNA
cctgggcctctcccgggtcaagg

SEQ ID NO: 2067 - DNA, 23 bp, Artificial Sequence
  HLA-A targeting gRNA
ccttgacccgggagaggcccagg

SEQ ID NO: 2068 - DNA, 23 bp, Artificial Sequence
  HLA-A targeting gRNA
actccacgaactcgccctccagg

SEQ ID NO: 2069 - DNA, 23 bp, Artificial Sequence
  HLA-A targeting gRNA
cgagacccttgacccgggagagg

SEQ ID NO: 2070 - DNA, 23 bp, Artificial Sequence
  HLA-A targeting gRNA
cgtgctgttcatacccgcggagg

SEQ ID NO: 2071 - DNA, 23 bp, Artificial Sequence
  HLA-A targeting gRNA
ctcccgggtcaagggtctcgggg

SEQ ID NO: 2072 - DNA, 23 bp, Artificial Sequence
  HLA-A targeting gRNA
ctctcccgggtcaagggtctcgg

SEQ ID NO: 2073 - DNA, 23 bp, Artificial Sequence
  HLA-A targeting gRNA
ctgggcctctcccgggtcaaggg

SEQ ID NO: 2074 - DNA, 23 bp, Artificial Sequence
  HLA-A targeting gRNA
gaccaacccgggggaatttttgg

SEQ ID NO: 2075 - DNA, 23 bp, Artificial Sequence
  HLA-A targeting gRNA
gaccccgagacccttgacccggg

SEQ ID NO: 2076 - DNA, 23 bp, Artificial Sequence
  HLA-A targeting gRNA
actctgaggtgctgggccctggg

SEQ ID NO: 2077 - DNA, 23 bp, Artificial Sequence
  HLA-A targeting gRNA
actgacctgacagcgggatgggg

SEQ ID NO: 2078 - DNA, 23 bp, Artificial Sequence
  HLA-A targeting gRNA
actgacctggcagcgggataggg

SEQ ID NO: 2079 - DNA, 23 bp, Artificial Sequence
  HLA-A targeting gRNA
gctgggtaggcccatgattgtgg

SEQ ID NO: 2080 - DNA, 23 bp, Artificial Sequence
  HLA-A targeting gRNA
ggaccccgagacccttgacccgg

SEQ ID NO: 2081 - DNA, 23 bp, Artificial Sequence
  HLA-A targeting gRNA
ggccaaaaattcccccgggttgg

SEQ ID NO: 2082 - DNA, 23 bp, Artificial Sequence
  HLA-A targeting gRNA
ggggtcgtgacctgcgcccccgg

SEQ ID NO: 2083 - DNA, 23 bp, Artificial Sequence
  HLA-A targeting gRNA
ggtaggcccatgattgtggatgg

SEQ ID NO: 2084 - DNA, 23 bp, Artificial Sequence
  HLA-A targeting gRNA
gtttaggccaaaaattcccccgg

SEQ ID NO: 2085 - DNA, 23 bp, Artificial Sequence
  HLA-A targeting gRNA
tatgaacagcacgcctacgacgg

SEQ ID NO: 2086 - DNA, 23 bp, Artificial Sequence
  HLA-A targeting gRNA
tcaagggtctcggggtcccgcgg

SEQ ID NO: 2087 - DNA, 23 bp, Artificial Sequence
  HLA-A targeting gRNA
tcccccgggttggtcggggctgg

SEQ ID NO: 2088 - DNA, 23 bp, Artificial Sequence
  HLA-A targeting gRNA
tctcccgggtcaagggtctcggg

SEQ ID NO: 2089 - DNA, 23 bp, Artificial Sequence
  HLA-A targeting gRNA
tttaggccaaaaattcccccggg

SEQ ID NO: 2090 - DNA, 23 bp, Artificial Sequence
  HLA-A targeting gRNA
aagagggtcatggtggacatcgg

SEQ ID NO: 2091 - DNA, 23 bp, Artificial Sequence
  HLA-A targeting gRNA
agagggtcatggtggacatcggg

SEQ ID NO: 2092 - DNA, 23 bp, Artificial Sequence
  HLA-A targeting gRNA
gagggtcatggtggacatcgggg

SEQ ID NO: 2093 - DNA, 23 bp, Artificial Sequence
  HLA-A targeting gRNA
caagtgggaggcggcccgtcggg

SEQ ID NO: 2094 - DNA, 23 bp, Artificial Sequence
  HLA-A targeting gRNA
gcaagtgggaggcggcccgtcgg

SEQ ID NO: 2095 - DNA, 23 bp, Artificial Sequence
  HLA-A targeting gRNA
agaagagctcaggtggagaaggg

SEQ ID NO: 2096 - DNA, 23 bp, Artificial Sequence
  HLA-A targeting gRNA
gtgggaggcggcccgtcgggcgg

SEQ ID NO: 2097 - DNA, 23 bp, Artificial Sequence
  HLA-A targeting gRNA
gatgattggagagggagcacagg

SEQ ID NO: 2098 - DNA, 23 bp, Artificial Sequence
  HLA-A targeting gRNA
agtattgggacctgcagacacgg

SEQ ID NO: 2099 - DNA, 23 bp, Artificial Sequence
  HLA-A targeting gRNA
cctgcagacacggaatgtgaagg

SEQ ID NO: 2100 - DNA, 23 bp, Artificial Sequence
  HLA-A targeting gRNA
agaccaggcctgcaggggatggg

SEQ ID NO: 2101 - DNA, 23 bp, Artificial Sequence
  HLA-A targeting gRNA
agaccagggcgggtgagtgcggg

SEQ ID NO: 2102 - DNA, 23 bp, Artificial Sequence
  HLA-A targeting gRNA
ccttcacattccgtgtctgcagg

SEQ ID NO: 2103 - DNA, 23 bp, Artificial Sequence
  HLA-A targeting gRNA
agactaaccgagcgaacctgggg

SEQ ID NO: 2104 - DNA, 23 bp, Artificial Sequence
  HLA-A targeting gRNA
agactgaccgagagaaactgcgg

SEQ ID NO: 2105 - DNA, 23 bp, Artificial Sequence
  HLA-A targeting gRNA
acgctgcagcgcacgggtaccgg

SEQ ID NO: 2106 - DNA, 23 bp, Artificial Sequence
  HLA-A targeting gRNA
caccgtggatagagcaggagggg

SEQ ID NO: 2107 - DNA, 23 bp, Artificial Sequence
  HLA-A targeting gRNA
cacgggtaccgggggccacgggg

SEQ ID NO: 2108 - DNA, 23 bp, Artificial Sequence
  HLA-A targeting gRNA
cccggcggggacgcaggacccgg

SEQ ID NO: 2109 - DNA, 23 bp, Artificial Sequence
  HLA-A targeting gRNA
cccgggtcctgcgtccccgccgg

SEQ ID NO: 2110 - DNA, 23 bp, Artificial Sequence
  HLA-A targeting gRNA
agagagtgactctgaggttccgg

SEQ ID NO: 2111 - DNA, 23 bp, Artificial Sequence
  HLA-A targeting gRNA
agagcagttgagagcctacctgg

SEQ ID NO: 2112 - DNA, 23 bp, Artificial Sequence
  HLA-A targeting gRNA
ccggcggggacgcaggacccggg

SEQ ID NO: 2113 - DNA, 23 bp, Artificial Sequence
  HLA-A targeting gRNA
ccgggtcctgcgtccccgccggg

SEQ ID NO: 2114 - DNA, 23 bp, Artificial Sequence
  HLA-A targeting gRNA
cgcacgggtaccgggggccacgg

SEQ ID NO: 2115 - DNA, 23 bp, Artificial Sequence
  HLA-A targeting gRNA
cgctcggtcagtctgtgactggg

SEQ ID NO: 2116 - DNA, 23 bp, Artificial Sequence
  HLA-A targeting gRNA
cgctgcagcgcacgggtaccggg

SEQ ID NO: 2117 - DNA, 23 bp, Artificial Sequence
  HLA-A targeting gRNA
ctgcagcgcacgggtaccggggg

SEQ ID NO: 2118 - DNA, 23 bp, Artificial Sequence
  HLA-A targeting gRNA
gcaccgtggatagagcaggaggg

SEQ ID NO: 2119 - DNA, 23 bp, Artificial Sequence
  HLA-A targeting gRNA
gcacgggtaccgggggccacggg

SEQ ID NO: 2120 - DNA, 23 bp, Artificial Sequence
  HLA-A targeting gRNA
gctgcagcgcacgggtaccgggg

SEQ ID NO: 2121 - DNA, 23 bp, Artificial Sequence
  HLA-A targeting gRNA
ggcaccgtggatagagcaggagg

SEQ ID NO: 2122 - DNA, 23 bp, Artificial Sequence
  HLA-A targeting gRNA
ggcccgcccggcggggacgcagg

SEQ ID NO: 2123 - DNA, 23 bp, Artificial Sequence
  HLA-A targeting gRNA
gggaggcgccccgtggcccccgg

SEQ ID NO: 2124 - DNA, 23 bp, Artificial Sequence
  HLA-A targeting gRNA
ggtcctgcgtccccgccgggcgg

SEQ ID NO: 2125 - DNA, 23 bp, Artificial Sequence
  HLA-A targeting gRNA
gtcctgcgtccccgccgggcggg

SEQ ID NO: 2126 - DNA, 23 bp, Artificial Sequence
  HLA-A targeting gRNA
agatcacactgacctgacagcgg

SEQ ID NO: 2127 - DNA, 23 bp, Artificial Sequence
  HLA-A targeting gRNA
tcgctcggtcagtctgtgactgg

SEQ ID NO: 2128 - DNA, 23 bp, Artificial Sequence
  HLA-A targeting gRNA
agatccaccccgaagccgcgggg

SEQ ID NO: 2129 - DNA, 23 bp, Artificial Sequence
  HLA-A targeting gRNA
aagcggggctctccactgccggg

SEQ ID NO: 2130 - DNA, 23 bp, Artificial Sequence
  HLA-A targeting gRNA
agagggagcacaggtcagcgtgg

SEQ ID NO: 2131 - DNA, 23 bp, Artificial Sequence
  HLA-A targeting gRNA
cgccgggaggagggtcggtcagg

SEQ ID NO: 2132 - DNA, 23 bp, Artificial Sequence
  HLA-A targeting gRNA
agatggagccgcgggcgccgtgg

SEQ ID NO: 2133 - DNA, 23 bp, Artificial Sequence
  HLA-A targeting gRNA
gaagcggggctctccactgccgg

SEQ ID NO: 2134 - DNA, 23 bp, Artificial Sequence
  HLA-A targeting gRNA
agatgggataaggagggagatgg

SEQ ID NO: 2135 - DNA, 23 bp, Artificial Sequence
  HLA-A targeting gRNA
gaccgaccctcctcccggcgcgg

SEQ ID NO: 2136 - DNA, 23 bp, Artificial Sequence
  HLA-A targeting gRNA
gacctgaccgaccctcctcccgg

SEQ ID NO: 2137 - DNA, 23 bp, Artificial Sequence
  HLA-A targeting gRNA
agatgggttaaggagggagatgg

SEQ ID NO: 2138 - DNA, 23 bp, Artificial Sequence
  HLA-A targeting gRNA
gggctctccactgccgggccggg

SEQ ID NO: 2139 - DNA, 23 bp, Artificial Sequence
  HLA-A targeting gRNA
ggggctctccactgccgggccgg

SEQ ID NO: 2140 - DNA, 23 bp, Artificial Sequence
  HLA-A targeting gRNA
tccactgccgggccgggacacgg

SEQ ID NO: 2141 - DNA, 23 bp, Artificial Sequence
  HLA-A targeting gRNA
tccgtgtcccggcccggcagtgg

SEQ ID NO: 2142 - DNA, 23 bp, Artificial Sequence
  HLA-A targeting gRNA
agactctgagagccacgcctggg

SEQ ID NO: 2143 - DNA, 23 bp, Artificial Sequence
  HLA-A targeting gRNA
agcacctcagagtggcctcatgg

SEQ ID NO: 2144 - DNA, 23 bp, Artificial Sequence
  HLA-A targeting gRNA
agagtctcaggccccgaaggcgg

SEQ ID NO: 2145 - DNA, 23 bp, Artificial Sequence
  HLA-A targeting gRNA
ctcagagtctcaggccccgaagg

SEQ ID NO: 2146 - DNA, 23 bp, Artificial Sequence
  HLA-A targeting gRNA
gactctgagagccacgcctgggg

SEQ ID NO: 2147 - DNA, 23 bp, Artificial Sequence
  HLA-A targeting gRNA
agcagagaacagggcctgagagg

SEQ ID NO: 2148 - DNA, 23 bp, Artificial Sequence
  HLA-A targeting gRNA
agcagagaacgaggcctgagagg

SEQ ID NO: 2149 - DNA, 23 bp, Artificial Sequence
  HLA-A targeting gRNA
gagactctgagagccacgcctgg

SEQ ID NO: 2150 - DNA, 23 bp, Artificial Sequence
  HLA-A targeting gRNA
agcaggaggagccggagtattgg

SEQ ID NO: 2151 - DNA, 23 bp, Artificial Sequence
  HLA-A targeting gRNA
agcaggaggagggttcggggcgg

SEQ ID NO: 2152 - DNA, 23 bp, Artificial Sequence
  HLA-A targeting gRNA
ggcgtggctctcagagtctcagg

SEQ ID NO: 2153 - DNA, 23 bp, Artificial Sequence
  HLA-A targeting gRNA
aagacactgattggcttctctgg

SEQ ID NO: 2154 - DNA, 23 bp, Artificial Sequence
  HLA-A targeting gRNA
gtctgcaggtcccaatactccgg

SEQ ID NO: 2155 - DNA, 23 bp, Artificial Sequence
  HLA-A targeting gRNA
ggtcatggtggacatcggggtgg

SEQ ID NO: 2156 - DNA, 23 bp, Artificial Sequence
  HLA-A targeting gRNA
agccattttgcatctgtcatggg

SEQ ID NO: 2157 - DNA, 23 bp, Artificial Sequence
  HLA-A targeting gRNA
gtcatggtggacatcggggtggg

SEQ ID NO: 2158 - DNA, 23 bp, Artificial Sequence
  HLA-A targeting gRNA
gcgggcaccgtggatagagcagg

SEQ ID NO: 2159 - DNA, 23 bp, Artificial Sequence
  HLA-A targeting gRNA
ggatggagccgcgggcaccgtgg

SEQ ID NO: 2160 - DNA, 23 bp, Artificial Sequence
  HLA-A targeting gRNA
gtgcccgcggctccatcctctgg

SEQ ID NO: 2161 - DNA, 23 bp, Artificial Sequence
  HLA-A targeting gRNA
tgctctatccacggtgcccgcgg

SEQ ID NO: 2162 - DNA, 23 bp, Artificial Sequence
  HLA-A targeting gRNA
agcgcccgtccgaccccacgtgg

SEQ ID NO: 2163 - DNA, 23 bp, Artificial Sequence
  HLA-A targeting gRNA
agcgcgatccgcagttctctcgg

SEQ ID NO: 2164 - DNA, 23 bp, Artificial Sequence
  HLA-A targeting gRNA
agatctacaggcgatcaggaagg

SEQ ID NO: 2165 - DNA, 23 bp, Artificial Sequence
  HLA-A targeting gRNA
gcgatcaggaaggcgccccgtgg

SEQ ID NO: 2166 - DNA, 23 bp, Artificial Sequence
  HLA-A targeting gRNA
gcgtcttgggggggtctgtcagg

SEQ ID NO: 2167 - DNA, 23 bp, Artificial Sequence
  HLA-A targeting gRNA
ggaaggcgccccgtggcccctgg

SEQ ID NO: 2168 - DNA, 23 bp, Artificial Sequence
  HLA-A targeting gRNA
gaagccaatcagtgtcttcgcgg

SEQ ID NO: 2169 - DNA, 23 bp, Artificial Sequence
  HLA-A targeting gRNA
gcgaccgcgaagacactgattgg

SEQ ID NO: 2170 - DNA, 23 bp, Artificial Sequence
  HLA-A targeting gRNA
caagtgggaggcggcccatgcgg

SEQ ID NO: 2171 - DNA, 23 bp, Artificial Sequence
  HLA-A targeting gRNA
ctctctgctgctccgccgcatgg

SEQ ID NO: 2172 - DNA, 23 bp, Artificial Sequence
  HLA-A targeting gRNA
gtgggaggcggcccatgcggcgg

SEQ ID NO: 2173 - DNA, 23 bp, Artificial Sequence
  HLA-A targeting gRNA
tctctgctgctccgccgcatggg

SEQ ID NO: 2174 - DNA, 23 bp, Artificial Sequence
  HLA-A targeting gRNA
gagtcatatgcgtcttggggggg

SEQ ID NO: 2175 - DNA, 23 bp, Artificial Sequence
  HLA-A targeting gRNA
tgagtcatatgcgtcttgggggg

SEQ ID NO: 2176 - DNA, 23 bp, Artificial Sequence
  HLA-A targeting gRNA
tcatggtggacatcggggtgggg

SEQ ID NO: 2177 - DNA, 23 bp, Artificial Sequence
  HLA-A targeting gRNA
tggtggacatcggggtggggtgg

SEQ ID NO: 2178 - DNA, 23 bp, Artificial Sequence
  HLA-A targeting gRNA
cagattctccccagaccccgagg

SEQ ID NO: 2179 - DNA, 23 bp, Artificial Sequence
  HLA-A targeting gRNA
cagccccacctctctgcaacagg

SEQ ID NO: 2180 - DNA, 23 bp, Artificial Sequence
  HLA-A targeting gRNA
ctttcctgttgcagagaggtggg

SEQ ID NO: 2181 - DNA, 23 bp, Artificial Sequence
  HLA-A targeting gRNA
aggacggtgaccccggcccgggg

SEQ ID NO: 2182 - DNA, 23 bp, Artificial Sequence
  HLA-A targeting gRNA
aggagcctgggggcgaggagtgg

SEQ ID NO: 2183 - DNA, 23 bp, Artificial Sequence
  HLA-A targeting gRNA
gttgcagagaggtggggctgagg

SEQ ID NO: 2184 - DNA, 23 bp, Artificial Sequence
  HLA-A targeting gRNA
tctttcctgttgcagagaggtgg

SEQ ID NO: 2185 - DNA, 23 bp, Artificial Sequence
  HLA-A targeting gRNA
ttctccccagaccccgaggatgg

SEQ ID NO: 2186 - DNA, 23 bp, Artificial Sequence
  HLA-A targeting gRNA
aggatggagccgcgagccagagg

SEQ ID NO: 2187 - DNA, 23 bp, Artificial Sequence
  HLA-A targeting gRNA
tttcctgttgcagagaggtgggg

SEQ ID NO: 2188 - DNA, 23 bp, Artificial Sequence
  HLA-A targeting gRNA
aggatgtatggttgcgacgtggg

SEQ ID NO: 2189 - DNA, 23 bp, Artificial Sequence
  HLA-A targeting gRNA
aattgtgtcacagagcagggcgg

SEQ ID NO: 2190 - DNA, 23 bp, Artificial Sequence
  HLA-A targeting gRNA
aggcataatgtgaggagataggg

SEQ ID NO: 2191 - DNA, 23 bp, Artificial Sequence
  HLA-A targeting gRNA
cttaattgtgtcacagagcaggg

SEQ ID NO: 2192 - DNA, 23 bp, Artificial Sequence
  HLA-A targeting gRNA
ctgcaacaggaaagatgattggg

SEQ ID NO: 2193 - DNA, 23 bp, Artificial Sequence
  HLA-A targeting gRNA
tcatctttcctgttgcagagagg

SEQ ID NO: 2194 - DNA, 23 bp, Artificial Sequence
  HLA-A targeting gRNA
aggccaaaaatccccccgggtgg

SEQ ID NO: 2195 - DNA, 23 bp, Artificial Sequence
  HLA-A targeting gRNA
aggccaaaaatccccctggttgg

SEQ ID NO: 2196 - DNA, 23 bp, Artificial Sequence
  HLA-A targeting gRNA
aggcccaggcgcctttaacccgg

SEQ ID NO: 2197 - DNA, 23 bp, Artificial Sequence
  HLA-A targeting gRNA
tctgcaacaggaaagatgattgg

SEQ ID NO: 2198 - DNA, 23 bp, Artificial Sequence
  HLA-A targeting gRNA
tgcaacaggaaagatgattgggg

SEQ ID NO: 2199 - DNA, 23 bp, Artificial Sequence
  HLA-A targeting gRNA
aggcgacctgccggtacccgcgg

SEQ ID NO: 2200 - DNA, 23 bp, Artificial Sequence
  HLA-A targeting gRNA
acggccatcctcggggtctgggg

SEQ ID NO: 2201 - DNA, 23 bp, Artificial Sequence
  HLA-A targeting gRNA
cgccatgacggccatcctcgggg

SEQ ID NO: 2202 - DNA, 23 bp, Artificial Sequence
  HLA-A targeting gRNA
gaccccgaggatggccgtcatgg

SEQ ID NO: 2203 - DNA, 23 bp, Artificial Sequence
  HLA-A targeting gRNA
gacggccatcctcggggtctggg

SEQ ID NO: 2204 - DNA, 23 bp, Artificial Sequence
  HLA-A targeting gRNA
aggcgtgctgccggtacccgcgg

SEQ ID NO: 2205 - DNA, 23 bp, Artificial Sequence
  HLA-A targeting gRNA
gcgccatgacggccatcctcggg

SEQ ID NO: 2206 - DNA, 23 bp, Artificial Sequence
  HLA-A targeting gRNA
tgacggccatcctcggggtctgg

SEQ ID NO: 2207 - DNA, 23 bp, Artificial Sequence
  HLA-A targeting gRNA
agagagcctacctggagggccgg

SEQ ID NO: 2208 - DNA, 23 bp, Artificial Sequence
  HLA-A targeting gRNA
aatcactgggatattgtgtttgg

SEQ ID NO: 2209 - DNA, 23 bp, Artificial Sequence
  HLA-A targeting gRNA
acaatatcccagtgatttcttgg

SEQ ID NO: 2210 - DNA, 23 bp, Artificial Sequence
  HLA-A targeting gRNA
agggctccccgcggccgggccgg

SEQ ID NO: 2211 - DNA, 23 bp, Artificial Sequence
  HLA-A targeting gRNA
acagattgaccgagtggacctgg

SEQ ID NO: 2212 - DNA, 23 bp, Artificial Sequence
  HLA-A targeting gRNA
agagctcaggtggggtgaagggg

SEQ ID NO: 2213 - DNA, 23 bp, Artificial Sequence
  HLA-A targeting gRNA
aggggccggagtattgggacggg

SEQ ID NO: 2214 - DNA, 23 bp, Artificial Sequence
  HLA-A targeting gRNA
aggggctctgaccctgataaagg

SEQ ID NO: 2215 - DNA, 23 bp, Artificial Sequence
  HLA-A targeting gRNA
aggggctctgaccctgctaaagg

SEQ ID NO: 2216 - DNA, 23 bp, Artificial Sequence
  HLA-A targeting gRNA
agattgaccgagtggacctgggg

SEQ ID NO: 2217 - DNA, 23 bp, Artificial Sequence
  HLA-A targeting gRNA
aggatgatccaagaaatcactgg

SEQ ID NO: 2218 - DNA, 23 bp, Artificial Sequence
  HLA-A targeting gRNA
aggcattttgcatctgtaatggg

SEQ ID NO: 2219 - DNA, 23 bp, Artificial Sequence
  HLA-A targeting gRNA
aggtggggtgaaggggtgaaggg

SEQ ID NO: 2220 - DNA, 23 bp, Artificial Sequence
  HLA-A targeting gRNA
atcactgggatattgtgtttggg

SEQ ID NO: 2221 - DNA, 23 bp, Artificial Sequence
  HLA-A targeting gRNA
atctcagggtgaggggcttgggg

SEQ ID NO: 2222 - DNA, 23 bp, Artificial Sequence
  HLA-A targeting gRNA
cactcggtcaatctgtgagtggg

SEQ ID NO: 2223 - DNA, 23 bp, Artificial Sequence
  HLA-A targeting gRNA
agggtttttcaagtcacaaaggg

SEQ ID NO: 2224 - DNA, 23 bp, Artificial Sequence
  HLA-A targeting gRNA
aggtcagtgtgatctccacaggg

SEQ ID NO: 2225 - DNA, 23 bp, Artificial Sequence
  HLA-A targeting gRNA
cagattgaccgagtggacctggg

SEQ ID NO: 2226 - DNA, 23 bp, Artificial Sequence
  HLA-A targeting gRNA
aggtcagtgtgatctctgcaggg

SEQ ID NO: 2227 - DNA, 23 bp, Artificial Sequence
  HLA-A targeting gRNA
caggcattttgcatctgtaatgg

SEQ ID NO: 2228 - DNA, 23 bp, Artificial Sequence
  HLA-A targeting gRNA
caggtggggtgaaggggtgaagg

SEQ ID NO: 2229 - DNA, 23 bp, Artificial Sequence
  HLA-A targeting gRNA
ccactcacagattgaccgagtgg

SEQ ID NO: 2230 - DNA, 23 bp, Artificial Sequence
  HLA-A targeting gRNA
ccactcggtcaatctgtgagtgg

SEQ ID NO: 2231 - DNA, 23 bp, Artificial Sequence
  HLA-A targeting gRNA
ccaggtcacccacagtctccggg

SEQ ID NO: 2232 - DNA, 23 bp, Artificial Sequence
  HLA-A targeting gRNA
aggtgggtgagctcccccatggg

SEQ ID NO: 2233 - DNA, 23 bp, Artificial Sequence
  HLA-A targeting gRNA
cccggagactgtgggtgacctgg

SEQ ID NO: 2234 - DNA, 23 bp, Artificial Sequence
  HLA-A targeting gRNA
cctgctctgtgacacaattaagg

SEQ ID NO: 2235 - DNA, 23 bp, Artificial Sequence
  HLA-A targeting gRNA
ccttaattgtgtcacagagcagg

SEQ ID NO: 2236 - DNA, 23 bp, Artificial Sequence
  HLA-A targeting gRNA
ctgctctgtgacacaattaaggg

SEQ ID NO: 2237 - DNA, 23 bp, Artificial Sequence
  HLA-A targeting gRNA
gccaggtcacccacagtctccgg

SEQ ID NO: 2238 - DNA, 23 bp, Artificial Sequence
  HLA-A targeting gRNA
ggagaccctcatgctgcacatgg

SEQ ID NO: 2239 - DNA, 23 bp, Artificial Sequence
  HLA-A targeting gRNA
agtagccgtgcagggtccccagg

SEQ ID NO: 2240 - DNA, 23 bp, Artificial Sequence
  HLA-A targeting gRNA
ggatgatccaagaaatcactggg

SEQ ID NO: 2241 - DNA, 23 bp, Artificial Sequence
  HLA-A targeting gRNA
ggggtgaaggggtgaagggtggg

SEQ ID NO: 2242 - DNA, 23 bp, Artificial Sequence
  HLA-A targeting gRNA
agtattgggaccaggagacgcgg

SEQ ID NO: 2243 - DNA, 23 bp, Artificial Sequence
  HLA-A targeting gRNA
gggtgacctggcccgtccgtggg

SEQ ID NO: 2244 - DNA, 23 bp, Artificial Sequence
  HLA-A targeting gRNA
ggtgacctggcccgtccgtgggg

SEQ ID NO: 2245 - DNA, 23 bp, Artificial Sequence
  HLA-A targeting gRNA
agtattgggacgaggagacacgg

SEQ ID NO: 2246 - DNA, 23 bp, Artificial Sequence
  HLA-A targeting gRNA
gtgacctggcccgtccgtggggg

SEQ ID NO: 2247 - DNA, 23 bp, Artificial Sequence
  HLA-A targeting gRNA
tggggtgaaggggtgaagggtgg

SEQ ID NO: 2248 - DNA, 23 bp, Artificial Sequence
  HLA-A targeting gRNA
agtcatatgcgtcttgggggggg

SEQ ID NO: 2249 - DNA, 23 bp, Artificial Sequence
  HLA-A targeting gRNA
tgggtgacctggcccgtccgtgg

SEQ ID NO: 2250 - DNA, 23 bp, Artificial Sequence
  HLA-A targeting gRNA
accctacataggttggcagaggg

SEQ ID NO: 2251 - DNA, 23 bp, Artificial Sequence
  HLA-A targeting gRNA
cagagggagaaaagaaactgcgg

SEQ ID NO: 2252 - DNA, 23 bp, Artificial Sequence
  HLA-A targeting gRNA
cgggttggtcggggccgggcagg

SEQ ID NO: 2253 - DNA, 23 bp, Artificial Sequence
  HLA-A targeting gRNA
agtgggagactccgcccatgagg

SEQ ID NO: 2254 - DNA, 23 bp, Artificial Sequence
  HLA-A targeting gRNA
agtgtgacccctcactgtgatgg

SEQ ID NO: 2255 - DNA, 23 bp, Artificial Sequence
  HLA-A targeting gRNA
ctccctctgccaacctatgtagg

SEQ ID NO: 2256 - DNA, 23 bp, Artificial Sequence
  HLA-A targeting gRNA
ctgcccggccccgaccaacccgg

SEQ ID NO: 2257 - DNA, 23 bp, Artificial Sequence
  HLA-A targeting gRNA
agttggggaatctccaaggctgg

SEQ ID NO: 2258 - DNA, 23 bp, Artificial Sequence
  HLA-A targeting gRNA
gaccctacataggttggcagagg

SEQ ID NO: 2259 - DNA, 23 bp, Artificial Sequence
  HLA-A targeting gRNA
gggttggtcggggccgggcaggg

SEQ ID NO: 2260 - DNA, 23 bp, Artificial Sequence
  HLA-A targeting gRNA
atattgtggttgggagcccatgg

SEQ ID NO: 2261 - DNA, 23 bp, Artificial Sequence
  HLA-A targeting gRNA
tccctctgccaacctatgtaggg

SEQ ID NO: 2262 - DNA, 23 bp, Artificial Sequence
  HLA-A targeting gRNA
tgcccggccccgaccaacccggg

SEQ ID NO: 2263 - DNA, 23 bp, Artificial Sequence
  HLA-A targeting gRNA
accagcagtcacaagtcacaggg

SEQ ID NO: 2264 - DNA, 23 bp, Artificial Sequence
  HLA-A targeting gRNA
atcatgggcccacccagcctggg

SEQ ID NO: 2265 - DNA, 23 bp, Artificial Sequence
  HLA-A targeting gRNA
gacttgtgactgctggtatcagg

SEQ ID NO: 2266 - DNA, 23 bp, Artificial Sequence
  HLA-A targeting gRNA
taccagcagtcacaagtcacagg

SEQ ID NO: 2267 - DNA, 23 bp, Artificial Sequence
  HLA-A targeting gRNA
gatccgcccgaccctcctcccgg

SEQ ID NO: 2268 - DNA, 23 bp, Artificial Sequence
  HLA-A targeting gRNA
ccaggtggcccacagtctccggg

SEQ ID NO: 2269 - DNA, 23 bp, Artificial Sequence
  HLA-A targeting gRNA
ccagtcccccaagccctgcccgg

SEQ ID NO: 2270 - DNA, 23 bp, Artificial Sequence
  HLA-A targeting gRNA
cccggagactgtgggccacctgg

SEQ ID NO: 2271 - DNA, 23 bp, Artificial Sequence
  HLA-A targeting gRNA
ccgggcagggcttgggggactgg

SEQ ID NO: 2272 - DNA, 23 bp, Artificial Sequence
  HLA-A targeting gRNA
cgggcagggcttgggggactggg

SEQ ID NO: 2273 - DNA, 23 bp, Artificial Sequence
  HLA-A targeting gRNA
cggggccgggcagggcttggggg

SEQ ID NO: 2274 - DNA, 23 bp, Artificial Sequence
  HLA-A targeting gRNA
gccacctggcccgtccgtggggg

SEQ ID NO: 2275 - DNA, 23 bp, Artificial Sequence
  HLA-A targeting gRNA
gccaggtggcccacagtctccgg

SEQ ID NO: 2276 - DNA, 23 bp, Artificial Sequence
  HLA-A targeting gRNA
ggccacctggcccgtccgtgggg

SEQ ID NO: 2277 - DNA, 23 bp, Artificial Sequence
  HLA-A targeting gRNA
gggccacctggcccgtccgtggg

SEQ ID NO: 2278 - DNA, 23 bp, Artificial Sequence
  HLA-A targeting gRNA
ggtcggggccgggcagggcttgg

SEQ ID NO: 2279 - DNA, 23 bp, Artificial Sequence
  HLA-A targeting gRNA
ggtggagaaggggtgaaaggtgg

SEQ ID NO: 2280 - DNA, 23 bp, Artificial Sequence
  HLA-A targeting gRNA
atgaggccactctgaggtgctgg

SEQ ID NO: 2281 - DNA, 23 bp, Artificial Sequence
  HLA-A targeting gRNA
gtcggggccgggcagggcttggg

SEQ ID NO: 2282 - DNA, 23 bp, Artificial Sequence
  HLA-A targeting gRNA
atgatgtatggctgccacgtggg

SEQ ID NO: 2283 - DNA, 23 bp, Artificial Sequence
  HLA-A targeting gRNA
gtggagaaggggtgaaaggtggg

SEQ ID NO: 2284 - DNA, 23 bp, Artificial Sequence
  HLA-A targeting gRNA
tcaggtggagaaggggtgaaagg

SEQ ID NO: 2285 - DNA, 23 bp, Artificial Sequence
  HLA-A targeting gRNA
atgcccacaatggggatggtggg

SEQ ID NO: 2286 - DNA, 23 bp, Artificial Sequence
  HLA-A targeting gRNA
tcccccacggacgggccaggtgg

SEQ ID NO: 2287 - DNA, 23 bp, Artificial Sequence
  HLA-A targeting gRNA
tcggggccgggcagggcttgggg

SEQ ID NO: 2288 - DNA, 23 bp, Artificial Sequence
  HLA-A targeting gRNA
atgcccacgatgtggacggtggg

SEQ ID NO: 2289 - DNA, 23 bp, Artificial Sequence
  HLA-A targeting gRNA
tggagaaggggtgaaaggtgggg

SEQ ID NO: 2290 - DNA, 23 bp, Artificial Sequence
  HLA-A targeting gRNA
tgggccacctggcccgtccgtgg

SEQ ID NO: 2291 - DNA, 23 bp, Artificial Sequence
  HLA-A targeting gRNA
atggccatcctcggcgtctgggg

SEQ ID NO: 2292 - DNA, 23 bp, Artificial Sequence
  HLA-A targeting gRNA
atgggataaggagggagatgggg

SEQ ID NO: 2293 - DNA, 23 bp, Artificial Sequence
  HLA-A targeting gRNA
tgggggactgggctgaccgcggg

SEQ ID NO: 2294 - DNA, 23 bp, Artificial Sequence
  HLA-A targeting gRNA
ttgggggactgggctgaccgcgg

SEQ ID NO: 2295 - DNA, 23 bp, Artificial Sequence
  HLA-A targeting gRNA
cacccagcgcaagtgggagacgg

SEQ ID NO: 2296 - DNA, 23 bp, Artificial Sequence
  HLA-A targeting gRNA
ggccgtctcccacttgcgctggg

SEQ ID NO: 2297 - DNA, 23 bp, Artificial Sequence
  HLA-A targeting gRNA
atgggttaaggagggagatgggg

SEQ ID NO: 2298 - DNA, 23 bp, Artificial Sequence
  HLA-A targeting gRNA
gggccgtctcccacttgcgctgg

SEQ ID NO: 2299 - DNA, 23 bp, Artificial Sequence
  HLA-A targeting gRNA
aggaggaattgtgaggtgggtgg

SEQ ID NO: 2300 - DNA, 23 bp, Artificial Sequence
  HLA-A targeting gRNA
aggtgggtgggctcccccatggg

SEQ ID NO: 2301 - DNA, 23 bp, Artificial Sequence
  HLA-A targeting gRNA
atgtgccctgtctcattcctggg

SEQ ID NO: 2302 - DNA, 23 bp, Artificial Sequence
  HLA-A targeting gRNA
atgtggaggaagaagagctcagg

SEQ ID NO: 2303 - DNA, 23 bp, Artificial Sequence
  HLA-A targeting gRNA
gaggtgggtgggctcccccatgg

SEQ ID NO: 2304 - DNA, 23 bp, Artificial Sequence
  HLA-A targeting gRNA
ggaggaattgtgaggtgggtggg

SEQ ID NO: 2305 - DNA, 23 bp, Artificial Sequence
  HLA-A targeting gRNA
atgttctgtgggatctgaccagg

SEQ ID NO: 2306 - DNA, 23 bp, Artificial Sequence
  HLA-A targeting gRNA
aattatgagcctacccagcctgg

SEQ ID NO: 2307 - DNA, 23 bp, Artificial Sequence
  HLA-A targeting gRNA
attatgagcctacccagcctggg

SEQ ID NO: 2308 - DNA, 23 bp, Artificial Sequence
  HLA-A targeting gRNA
ctcaggtggggaagggatgaagg

SEQ ID NO: 2309 - DNA, 23 bp, Artificial Sequence
  HLA-A targeting gRNA
ctctttggagctgtgatcgctgg

SEQ ID NO: 2310 - DNA, 23 bp, Artificial Sequence
  HLA-A targeting gRNA
attcatatcactcacagtgaggg

SEQ ID NO: 2311 - DNA, 23 bp, Artificial Sequence
  HLA-A targeting gRNA
gctgggtaggctcataattgtgg

SEQ ID NO: 2312 - DNA, 23 bp, Artificial Sequence
  HLA-A targeting gRNA
attcatatctgtcacagtgaggg

SEQ ID NO: 2313 - DNA, 23 bp, Artificial Sequence
  HLA-A targeting gRNA
ggtaggctcataattgtggatgg

SEQ ID NO: 2314 - DNA, 23 bp, Artificial Sequence
  HLA-A targeting gRNA
ggtggggaagggatgaagggtgg

SEQ ID NO: 2315 - DNA, 23 bp, Artificial Sequence
  HLA-A targeting gRNA
gtggggaagggatgaagggtggg

SEQ ID NO: 2316 - DNA, 23 bp, Artificial Sequence
  HLA-A targeting gRNA
tcaggtggggaagggatgaaggg

SEQ ID NO: 2317 - DNA, 23 bp, Artificial Sequence
  HLA-A targeting gRNA
ctctcaactgctccgcctcatgg

SEQ ID NO: 2318 - DNA, 23 bp, Artificial Sequence
  HLA-A targeting gRNA
tctcaactgctccgcctcatggg

SEQ ID NO: 2319 - DNA, 23 bp, Artificial Sequence
  HLA-A targeting gRNA
attgtggttgggagcccatgggg

SEQ ID NO: 2320 - DNA, 23 bp, Artificial Sequence
  HLA-A targeting gRNA
ccatctctgcctcaacttcatgg

SEQ ID NO: 2321 - DNA, 23 bp, Artificial Sequence
  HLA-A targeting gRNA
ccatgaagttgaggcagagatgg

SEQ ID NO: 2322 - DNA, 23 bp, Artificial Sequence
  HLA-A targeting gRNA
ctcagtgcaccatgaagttgagg

SEQ ID NO: 2323 - DNA, 23 bp, Artificial Sequence
  HLA-A targeting gRNA
aatcatgggcctacccagtctgg

SEQ ID NO: 2324 - DNA, 23 bp, Artificial Sequence
  HLA-A targeting gRNA
acacagggcccagactgggtagg

SEQ ID NO: 2325 - DNA, 23 bp, Artificial Sequence
  HLA-A targeting gRNA
actgggtaggcccatgattgtgg

SEQ ID NO: 2326 - DNA, 23 bp, Artificial Sequence
  HLA-A targeting gRNA
agccgcgccgggacgagggtcgg

SEQ ID NO: 2327 - DNA, 23 bp, Artificial Sequence
  HLA-A targeting gRNA
atcatgggcctacccagtctggg

SEQ ID NO: 2328 - DNA, 23 bp, Artificial Sequence
  HLA-A targeting gRNA
ccagccccgaccaacccgggggg

SEQ ID NO: 2329 - DNA, 23 bp, Artificial Sequence
  HLA-A targeting gRNA
atttctacatctccgtgtcccgg

SEQ ID NO: 2330 - DNA, 23 bp, Artificial Sequence
  HLA-A targeting gRNA
ccccccgggttggtcggggctgg

SEQ ID NO: 2331 - DNA, 23 bp, Artificial Sequence
  HLA-A targeting gRNA
cgccgggacgagggtcgggcagg

SEQ ID NO: 2332 - DNA, 23 bp, Artificial Sequence
  HLA-A targeting gRNA
atttcttcacattcgtgtcccgg

SEQ ID NO: 2333 - DNA, 23 bp, Artificial Sequence
  HLA-A targeting gRNA
ctagaggaggaattgtgaggtgg

SEQ ID NO: 2334 - DNA, 23 bp, Artificial Sequence
  HLA-A targeting gRNA
caaaaatccccctggttggtcgg

SEQ ID NO: 2335 - DNA, 23 bp, Artificial Sequence
  HLA-A targeting gRNA
caaaatggccacatgcgtgctgg

SEQ ID NO: 2336 - DNA, 23 bp, Artificial Sequence
  HLA-A targeting gRNA
caaagagaaccaggccagcaagg

SEQ ID NO: 2337 - DNA, 23 bp, Artificial Sequence
  HLA-A targeting gRNA
ctcacctttacaagctgtgaggg

SEQ ID NO: 2338 - DNA, 23 bp, Artificial Sequence
  HLA-A targeting gRNA
ctggcacacagggcccagactgg

SEQ ID NO: 2339 - DNA, 23 bp, Artificial Sequence
  HLA-A targeting gRNA
gaagcaccgtccacaatcatggg

SEQ ID NO: 2340 - DNA, 23 bp, Artificial Sequence
  HLA-A targeting gRNA
gacctgcccgaccctcgtcccgg

SEQ ID NO: 2341 - DNA, 23 bp, Artificial Sequence
  HLA-A targeting gRNA
gagggacacatcagagccctggg

SEQ ID NO: 2342 - DNA, 23 bp, Artificial Sequence
  HLA-A targeting gRNA
gcccgaccctcgtcccggcgcgg

SEQ ID NO: 2343 - DNA, 23 bp, Artificial Sequence
  HLA-A targeting gRNA
gccgcgccgggacgagggtcggg

SEQ ID NO: 2344 - DNA, 23 bp, Artificial Sequence
  HLA-A targeting gRNA
ggaagcaccgtccacaatcatgg

SEQ ID NO: 2345 - DNA, 23 bp, Artificial Sequence
  HLA-A targeting gRNA
ggggagccgcgccgggacgaggg

SEQ ID NO: 2346 - DNA, 23 bp, Artificial Sequence
  HLA-A targeting gRNA
caaggctacgaggttcctctagg

SEQ ID NO: 2347 - DNA, 23 bp, Artificial Sequence
  HLA-A targeting gRNA
gggggagccgcgccgggacgagg

SEQ ID NO: 2348 - DNA, 23 bp, Artificial Sequence
  HLA-A targeting gRNA
ggtaggcccatgattgtggacgg

SEQ ID NO: 2349 - DNA, 23 bp, Artificial Sequence
  HLA-A targeting gRNA
caagtgggaggcggcccatgagg

SEQ ID NO: 2350 - DNA, 23 bp, Artificial Sequence
  HLA-A targeting gRNA
gtgtccctcacagcttgtaaagg

SEQ ID NO: 2351 - DNA, 23 bp, Artificial Sequence
  HLA-A targeting gRNA
tacaggatctggaacccaggagg

SEQ ID NO: 2352 - DNA, 23 bp, Artificial Sequence
  HLA-A targeting gRNA
tagaggaggaattgtgaggtggg

SEQ ID NO: 2353 - DNA, 23 bp, Artificial Sequence
  HLA-A targeting gRNA
tcgtcccggcgcggctcccccgg

SEQ ID NO: 2354 - DNA, 23 bp, Artificial Sequence
  HLA-A targeting gRNA
caagtgggaggcggcccgttggg

SEQ ID NO: 2355 - DNA, 23 bp, Artificial Sequence
  HLA-A targeting gRNA
caagtgggaggcggtccatgcgg

SEQ ID NO: 2356 - DNA, 23 bp, Artificial Sequence
  HLA-A targeting gRNA
tctcacctttacaagctgtgagg

SEQ ID NO: 2357 - DNA, 23 bp, Artificial Sequence
  HLA-A targeting gRNA
caatccatataccgccttcgggg

SEQ ID NO: 2358 - DNA, 23 bp, Artificial Sequence
  HLA-A targeting gRNA
tgagggacacatcagagccctgg

SEQ ID NO: 2359 - DNA, 23 bp, Artificial Sequence
  HLA-A targeting gRNA
cacaagaaagggagacaaatggg

SEQ ID NO: 2360 - DNA, 23 bp, Artificial Sequence
  HLA-A targeting gRNA
tggcacacagggcccagactggg

SEQ ID NO: 2361 - DNA, 23 bp, Artificial Sequence
  HLA-A targeting gRNA
tggctagaggaggaattgtgagg

SEQ ID NO: 2362 - DNA, 23 bp, Artificial Sequence
  HLA-A targeting gRNA
tggtacaggatctggaacccagg

SEQ ID NO: 2363 - DNA, 23 bp, Artificial Sequence
  HLA-A targeting gRNA
cacaatggggatggtgggctggg

SEQ ID NO: 2364 - DNA, 23 bp, Artificial Sequence
  HLA-A targeting gRNA
cgccgtggatagagcaggagagg

SEQ ID NO: 2365 - DNA, 23 bp, Artificial Sequence
  HLA-A targeting gRNA
actccacgcacgtgccatccagg

SEQ ID NO: 2366 - DNA, 23 bp, Artificial Sequence
  HLA-A targeting gRNA
cacacaccggcggcagccttggg

SEQ ID NO: 2367 - DNA, 23 bp, Artificial Sequence
  HLA-A targeting gRNA
cacacagggcccaggctgggtgg

SEQ ID NO: 2368 - DNA, 23 bp, Artificial Sequence
  HLA-A targeting gRNA
cacgcacgtgccatccaggtagg

SEQ ID NO: 2369 - DNA, 23 bp, Artificial Sequence
  HLA-A targeting gRNA
ctacctggatggcacgtgcgtgg

SEQ ID NO: 2370 - DNA, 23 bp, Artificial Sequence
  HLA-A targeting gRNA
tggatggcacgtgcgtggagtgg

SEQ ID NO: 2371 - DNA, 23 bp, Artificial Sequence
  HLA-A targeting gRNA
gcaggacgcttacgacggcaagg

SEQ ID NO: 2372 - DNA, 23 bp, Artificial Sequence
  HLA-A targeting gRNA
agcaggagaggcctgagtattgg

SEQ ID NO: 2373 - DNA, 23 bp, Artificial Sequence
  HLA-A targeting gRNA
cacactgaccgagtggacctggg

SEQ ID NO: 2374 - DNA, 23 bp, Artificial Sequence
  HLA-A targeting gRNA
gaggcctgagtattgggaccagg

SEQ ID NO: 2375 - DNA, 23 bp, Artificial Sequence
  HLA-A targeting gRNA
cacagcatccagaggatgtatgg

SEQ ID NO: 2376 - DNA, 23 bp, Artificial Sequence
  HLA-A targeting gRNA
gcaggagaggcctgagtattggg

SEQ ID NO: 2377 - DNA, 23 bp, Artificial Sequence
  HLA-A targeting gRNA
ggcctctcctgctctatccacgg

SEQ ID NO: 2378 - DNA, 23 bp, Artificial Sequence
  HLA-A targeting gRNA
gtctcctggtcccaatactcagg

SEQ ID NO: 2379 - DNA, 23 bp, Artificial Sequence
  HLA-A targeting gRNA
cacaggtaccaggggccacgggg

SEQ ID NO: 2380 - DNA, 23 bp, Artificial Sequence
  HLA-A targeting gRNA
cacatcgtgggcatcattgctgg

SEQ ID NO: 2381 - DNA, 23 bp, Artificial Sequence
  HLA-A targeting gRNA
catgtaggcataatgtgaggagg

SEQ ID NO: 2382 - DNA, 23 bp, Artificial Sequence
  HLA-A targeting gRNA
cacccaataggagtgagaactgg

SEQ ID NO: 2383 - DNA, 23 bp, Artificial Sequence
  HLA-A targeting gRNA
cacccaattggagtgagaactgg

SEQ ID NO: 2384 - DNA, 23 bp, Artificial Sequence
  HLA-A targeting gRNA
agctgtgatcgctggagctgtgg

SEQ ID NO: 2385 - DNA, 23 bp, Artificial Sequence
  HLA-A targeting gRNA
aaagcccgcacgcacccaccggg

SEQ ID NO: 2386 - DNA, 23 bp, Artificial Sequence
  HLA-A targeting gRNA
cccggccgggggcgcaggtcagg

SEQ ID NO: 2387 - DNA, 23 bp, Artificial Sequence
  HLA-A targeting gRNA
cacccgccctggtctgggtcagg

SEQ ID NO: 2388 - DNA, 23 bp, Artificial Sequence
  HLA-A targeting gRNA
caccctccctctgctcctgaggg

SEQ ID NO: 2389 - DNA, 23 bp, Artificial Sequence
  HLA-A targeting gRNA
cctgacctgcgcccccggccggg

SEQ ID NO: 2390 - DNA, 23 bp, Artificial Sequence
  HLA-A targeting gRNA
caccctgagatgggataaggagg

SEQ ID NO: 2391 - DNA, 23 bp, Artificial Sequence
  HLA-A targeting gRNA
ctgacctgcgcccccggccgggg

SEQ ID NO: 2392 - DNA, 23 bp, Artificial Sequence
  HLA-A targeting gRNA
caccctgagatgggttaaggagg

SEQ ID NO: 2393 - DNA, 23 bp, Artificial Sequence
  HLA-A targeting gRNA
gagtcccggtgggtgcgtgcggg

SEQ ID NO: 2394 - DNA, 23 bp, Artificial Sequence
  HLA-A targeting gRNA
caccgagcgcaagtgggaggcgg

SEQ ID NO: 2395 - DNA, 23 bp, Artificial Sequence
  HLA-A targeting gRNA
caccggccggggtcactcaccgg

SEQ ID NO: 2396 - DNA, 23 bp, Artificial Sequence
  HLA-A targeting gRNA
caccgtggatagagcaggagagg

SEQ ID NO: 2397 - DNA, 23 bp, Artificial Sequence
  HLA-A targeting gRNA
ggggtcctgacctgcgcccccgg

SEQ ID NO: 2398 - DNA, 23 bp, Artificial Sequence
  HLA-A targeting gRNA
taaagcccgcacgcacccaccgg

SEQ ID NO: 2399 - DNA, 23 bp, Artificial Sequence
  HLA-A targeting gRNA
tcctgacctgcgcccccggccgg

SEQ ID NO: 2400 - DNA, 23 bp, Artificial Sequence
  HLA-A targeting gRNA
acatgaacacagacacatgcagg

SEQ ID NO: 2401 - DNA, 23 bp, Artificial Sequence
  HLA-A targeting gRNA
gcatgtgtctgtgttcatgtagg

SEQ ID NO: 2402 - DNA, 23 bp, Artificial Sequence
  HLA-A targeting gRNA
gttcatgtaggcataatgtgagg

SEQ ID NO: 2403 - DNA, 23 bp, Artificial Sequence
  HLA-A targeting gRNA
cacagccacccacttctggaagg

SEQ ID NO: 2404 - DNA, 23 bp, Artificial Sequence
  HLA-A targeting gRNA
cacgagtaccaggggccacgggg

SEQ ID NO: 2405 - DNA, 23 bp, Artificial Sequence
  HLA-A targeting gRNA
ccaccacagccacccacttctgg

SEQ ID NO: 2406 - DNA, 23 bp, Artificial Sequence
  HLA-A targeting gRNA
ccagaagtgggtggctgtggtgg

SEQ ID NO: 2407 - DNA, 23 bp, Artificial Sequence
  HLA-A targeting gRNA
cacgatgtggacggtgggctggg

SEQ ID NO: 2408 - DNA, 23 bp, Artificial Sequence
  HLA-A targeting gRNA
cttccagaagtgggtggctgtgg

SEQ ID NO: 2409 - DNA, 23 bp, Artificial Sequence
  HLA-A targeting gRNA
gtggctgtggtggtgccttctgg

SEQ ID NO: 2410 - DNA, 23 bp, Artificial Sequence
  HLA-A targeting gRNA
tggaaccttccagaagtgggtgg

SEQ ID NO: 2411 - DNA, 23 bp, Artificial Sequence
  HLA-A targeting gRNA
tcaggacccctcatcccccacgg

SEQ ID NO: 2412 - DNA, 23 bp, Artificial Sequence
  HLA-A targeting gRNA
cacgggcccaaggctgccgccgg

SEQ ID NO: 2413 - DNA, 23 bp, Artificial Sequence
  HLA-A targeting gRNA
cacgggtaccagggaccacgggg

SEQ ID NO: 2414 - DNA, 23 bp, Artificial Sequence
  HLA-A targeting gRNA
aatgatgcccacgatggggacgg

SEQ ID NO: 2415 - DNA, 23 bp, Artificial Sequence
  HLA-A targeting gRNA
atgcccacgatggggacggtggg

SEQ ID NO: 2416 - DNA, 23 bp, Artificial Sequence
  HLA-A targeting gRNA
cacgatggggacggtgggctggg

SEQ ID NO: 2417 - DNA, 23 bp, Artificial Sequence
  HLA-A targeting gRNA
cagcccaccgtccccatcgtggg

SEQ ID NO: 2418 - DNA, 23 bp, Artificial Sequence
  HLA-A targeting gRNA
ccacgatggggacggtgggctgg

SEQ ID NO: 2419 - DNA, 23 bp, Artificial Sequence
  HLA-A targeting gRNA
cactcggtcagtgtgtgactggg

SEQ ID NO: 2420 - DNA, 23 bp, Artificial Sequence
  HLA-A targeting gRNA
ccagcccaccgtccccatcgtgg

SEQ ID NO: 2421 - DNA, 23 bp, Artificial Sequence
  HLA-A targeting gRNA
gatgcccacgatggggacggtgg

SEQ ID NO: 2422 - DNA, 23 bp, Artificial Sequence
  HLA-A targeting gRNA
cactctgaggtgctgggccctgg

SEQ ID NO: 2423 - DNA, 23 bp, Artificial Sequence
  HLA-A targeting gRNA
cactgacctgacagcgggatggg

SEQ ID NO: 2424 - DNA, 23 bp, Artificial Sequence
  HLA-A targeting gRNA
cactgacctggcagcgggatagg

SEQ ID NO: 2425 - DNA, 23 bp, Artificial Sequence
  HLA-A targeting gRNA
gggacggtgggctgggaagatgg

SEQ ID NO: 2426 - DNA, 23 bp, Artificial Sequence
  HLA-A targeting gRNA
cccgggctggggtcactcaccgg

SEQ ID NO: 2427 - DNA, 23 bp, Artificial Sequence
  HLA-A targeting gRNA
cactggtaccaggggccacgggg

SEQ ID NO: 2428 - DNA, 23 bp, Artificial Sequence
  HLA-A targeting gRNA
ccggtgagtgaccccagcccggg

SEQ ID NO: 2429 - DNA, 23 bp, Artificial Sequence
  HLA-A targeting gRNA
cagaccagggcgggtgagtgcgg

SEQ ID NO: 2430 - DNA, 23 bp, Artificial Sequence
  HLA-A targeting gRNA
cggtgagtgaccccagcccgggg

SEQ ID NO: 2431 - DNA, 23 bp, Artificial Sequence
  HLA-A targeting gRNA
cgtgacctgcgccccgggctggg

SEQ ID NO: 2432 - DNA, 23 bp, Artificial Sequence
  HLA-A targeting gRNA
cagactaaccgagcgaacctggg

SEQ ID NO: 2433 - DNA, 23 bp, Artificial Sequence
  HLA-A targeting gRNA
gccggtgagtgaccccagcccgg

SEQ ID NO: 2434 - DNA, 23 bp, Artificial Sequence
  HLA-A targeting gRNA
gtgaccccagcccggggcgcagg

SEQ ID NO: 2435 - DNA, 23 bp, Artificial Sequence
  HLA-A targeting gRNA
cagactgaccgagagaactgcgg

SEQ ID NO: 2436 - DNA, 23 bp, Artificial Sequence
  HLA-A targeting gRNA
gtgacctgcgccccgggctgggg

SEQ ID NO: 2437 - DNA, 23 bp, Artificial Sequence
  HLA-A targeting gRNA
tcgtgacctgcgccccgggctgg

SEQ ID NO: 2438 - DNA, 23 bp, Artificial Sequence
  HLA-A targeting gRNA
cagagcgaggacggtgaccccgg

SEQ ID NO: 2439 - DNA, 23 bp, Artificial Sequence
  HLA-A targeting gRNA
aatgtgtgttgggtgttgggcgg

SEQ ID NO: 2440 - DNA, 23 bp, Artificial Sequence
  HLA-A targeting gRNA
cagatacctgaagaacgggaagg

SEQ ID NO: 2441 - DNA, 23 bp, Artificial Sequence
  HLA-A targeting gRNA
ctctctgctgctccgccacatgg

SEQ ID NO: 2442 - DNA, 23 bp, Artificial Sequence
  HLA-A targeting gRNA
cagatacctggagaacggtaagg

SEQ ID NO: 2443 - DNA, 23 bp, Artificial Sequence
  HLA-A targeting gRNA
tctctgctgctccgccacatggg

SEQ ID NO: 2444 - DNA, 23 bp, Artificial Sequence
  HLA-A targeting gRNA
acacagctccaaagagaactagg

SEQ ID NO: 2445 - DNA, 23 bp, Artificial Sequence
  HLA-A targeting gRNA
accacatccgtgtcccggcccgg

SEQ ID NO: 2446 - DNA, 23 bp, Artificial Sequence
  HLA-A targeting gRNA
agctgtgttcgctggagctgtgg

SEQ ID NO: 2447 - DNA, 23 bp, Artificial Sequence
  HLA-A targeting gRNA
atgggggtgtcatgtcttttagg

SEQ ID NO: 2448 - DNA, 23 bp, Artificial Sequence
  HLA-A targeting gRNA
cagcaaggatgcccacgatgggg

SEQ ID NO: 2449 - DNA, 23 bp, Artificial Sequence
  HLA-A targeting gRNA
cagcaatgatgcccacaatgggg

SEQ ID NO: 2450 - DNA, 23 bp, Artificial Sequence
  HLA-A targeting gRNA
atttcaccacatccgtgtcccgg

SEQ ID NO: 2451 - DNA, 23 bp, Artificial Sequence
  HLA-A targeting gRNA
cagcaatgatgcccacgatgtgg

SEQ ID NO: 2452 - DNA, 23 bp, Artificial Sequence
  HLA-A targeting gRNA
ctctttggagctgtgttcgctgg

SEQ ID NO: 2453 - DNA, 23 bp, Artificial Sequence
  HLA-A targeting gRNA
ggatgtggtgaaatacctcatgg

SEQ ID NO: 2454 - DNA, 23 bp, Artificial Sequence
  HLA-A targeting gRNA
cagccattttgcatctgtcatgg

SEQ ID NO: 2455 - DNA, 23 bp, Artificial Sequence
  HLA-A targeting gRNA
ggtgaaatacctcatggagtggg

SEQ ID NO: 2456 - DNA, 23 bp, Artificial Sequence
  HLA-A targeting gRNA
cagcccaccatccccattgtggg

SEQ ID NO: 2457 - DNA, 23 bp, Artificial Sequence
  HLA-A targeting gRNA
cagcccaccgtccacatcgtggg

SEQ ID NO: 2458 - DNA, 23 bp, Artificial Sequence
  HLA-A targeting gRNA
tgggggtgtcatgtcttttaggg

SEQ ID NO: 2459 - DNA, 23 bp, Artificial Sequence
  HLA-A targeting gRNA
tggtgaaatacctcatggagtgg

SEQ ID NO: 2460 - DNA, 23 bp, Artificial Sequence
  HLA-A targeting gRNA
ccccggccggggtcactcaccgg

SEQ ID NO: 2461 - DNA, 23 bp, Artificial Sequence
  HLA-A targeting gRNA
ccggtgagtgaccccggccgggg

SEQ ID NO: 2462 - DNA, 23 bp, Artificial Sequence
  HLA-A targeting gRNA
cggtgagtgaccccggccggggg

SEQ ID NO: 2463 - DNA, 23 bp, Artificial Sequence
  HLA-A targeting gRNA
cagcggagagtctacctggaggg

SEQ ID NO: 2464 - DNA, 23 bp, Artificial Sequence
  HLA-A targeting gRNA
gccggtgagtgaccccggccggg

SEQ ID NO: 2465 - DNA, 23 bp, Artificial Sequence
  HLA-A targeting gRNA
cagctgagagcctacctggatgg

SEQ ID NO: 2466 - DNA, 23 bp, Artificial Sequence
  HLA-A targeting gRNA
gtgaccccggccgggggcgcagg

SEQ ID NO: 2467 - DNA, 23 bp, Artificial Sequence
  HLA-A targeting gRNA
ctgggcggggctcgggggactgg

SEQ ID NO: 2468 - DNA, 23 bp, Artificial Sequence
  HLA-A targeting gRNA
tgggcggggctcgggggactggg

SEQ ID NO: 2469 - DNA, 23 bp, Artificial Sequence
  HLA-A targeting gRNA
aagtcgctgttccctcctcaggg

SEQ ID NO: 2470 - DNA, 23 bp, Artificial Sequence
  HLA-A targeting gRNA
acactccaccagcatgcatgtgg

SEQ ID NO: 2471 - DNA, 23 bp, Artificial Sequence
  HLA-A targeting gRNA
gaagtcgctgttccctcctcagg

SEQ ID NO: 2472 - DNA, 23 bp, Artificial Sequence
  HLA-A targeting gRNA
gaggagggaacagcgacttctgg

SEQ ID NO: 2473 - DNA, 23 bp, Artificial Sequence
  HLA-A targeting gRNA
gatggccacatgcatgctggtgg

SEQ ID NO: 2474 - DNA, 23 bp, Artificial Sequence
  HLA-A targeting gRNA
ggccggtgagtgaccccggccgg

SEQ ID NO: 2475 - DNA, 23 bp, Artificial Sequence
  HLA-A targeting gRNA
actctgagatgctgggccctggg

SEQ ID NO: 2476 - DNA, 23 bp, Artificial Sequence
  HLA-A targeting gRNA
agcatctcagagtggcctcatgg

SEQ ID NO: 2477 - DNA, 23 bp, Artificial Sequence
  HLA-A targeting gRNA
caggccccgaaggcggtatatgg

SEQ ID NO: 2478 - DNA, 23 bp, Artificial Sequence
  HLA-A targeting gRNA
atgaggccactctgagatgctgg

SEQ ID NO: 2479 - DNA, 23 bp, Artificial Sequence
  HLA-A targeting gRNA
cactctgagatgctgggccctgg

SEQ ID NO: 2480 - DNA, 23 bp, Artificial Sequence
  HLA-A targeting gRNA
cagggcccagcatctcagagtgg

SEQ ID NO: 2481 - DNA, 23 bp, Artificial Sequence
  HLA-A targeting gRNA
cagggcccagcacctcagagtgg

SEQ ID NO: 2482 - DNA, 23 bp, Artificial Sequence
  HLA-A targeting gRNA
tgaggccactctgagatgctggg

SEQ ID NO: 2483 - DNA, 23 bp, Artificial Sequence
  HLA-A targeting gRNA
cggcccgtccgtgggggatgagg

SEQ ID NO: 2484 - DNA, 23 bp, Artificial Sequence
  HLA-A targeting gRNA
cagggtttttcaagtcacaaagg

SEQ ID NO: 2485 - DNA, 23 bp, Artificial Sequence
  HLA-A targeting gRNA
caggtcagtgtgatctccacagg

SEQ ID NO: 2486 - DNA, 23 bp, Artificial Sequence
  HLA-A targeting gRNA
caggtcagtgtgatctctgcagg

SEQ ID NO: 2487 - DNA, 23 bp, Artificial Sequence
  HLA-A targeting gRNA
cgtccacgcacgtgccctccagg

SEQ ID NO: 2488 - DNA, 23 bp, Artificial Sequence
  HLA-A targeting gRNA
ctggagggcacgtgcgtggacgg

SEQ ID NO: 2489 - DNA, 23 bp, Artificial Sequence
  HLA-A targeting gRNA
caggttctcacagcatccagagg

SEQ ID NO: 2490 - DNA, 23 bp, Artificial Sequence
  HLA-A targeting gRNA
tggagggcacgtgcgtggacggg

SEQ ID NO: 2491 - DNA, 23 bp, Artificial Sequence
  HLA-A targeting gRNA
acctaatgtgtgttgggtgttgg

SEQ ID NO: 2492 - DNA, 23 bp, Artificial Sequence
  HLA-A targeting gRNA
cccaacacccaacacacattagg

SEQ ID NO: 2493 - DNA, 23 bp, Artificial Sequence
  HLA-A targeting gRNA
cccagccccgaccaacccggggg

SEQ ID NO: 2494 - DNA, 23 bp, Artificial Sequence
  HLA-A targeting gRNA
cccccgggttggtcggggctggg

SEQ ID NO: 2495 - DNA, 23 bp, Artificial Sequence
  HLA-A targeting gRNA
ccgcccagccccgaccaacccgg

SEQ ID NO: 2496 - DNA, 23 bp, Artificial Sequence
  HLA-A targeting gRNA
cagttgagagcctacctggatgg

SEQ ID NO: 2497 - DNA, 23 bp, Artificial Sequence
  HLA-A targeting gRNA
ccgggttggtcggggctgggcgg

SEQ ID NO: 2498 - DNA, 23 bp, Artificial Sequence
  HLA-A targeting gRNA
cctaatgtgtgttgggtgttggg

SEQ ID NO: 2499 - DNA, 23 bp, Artificial Sequence
  HLA-A targeting gRNA
catctcagggtgaggggctcggg

SEQ ID NO: 2500 - DNA, 23 bp, Artificial Sequence
  HLA-A targeting gRNA
cgcccagccccgaccaacccggg

SEQ ID NO: 2501 - DNA, 23 bp, Artificial Sequence
  HLA-A targeting gRNA
cggggctgggcggggctcggggg

SEQ ID NO: 2502 - DNA, 23 bp, Artificial Sequence
  HLA-A targeting gRNA
cgggttggtcggggctgggcggg

SEQ ID NO: 2503 - DNA, 23 bp, Artificial Sequence
  HLA-A targeting gRNA
cttctcacagatagaaaaggagg

SEQ ID NO: 2504 - DNA, 23 bp, Artificial Sequence
  HLA-A targeting gRNA
gcccagccccgaccaacccgggg

SEQ ID NO: 2505 - DNA, 23 bp, Artificial Sequence
  HLA-A targeting gRNA
gggttggtcggggctgggcgggg

SEQ ID NO: 2506 - DNA, 23 bp, Artificial Sequence
  HLA-A targeting gRNA
ggtcggggctgggcggggctcgg

SEQ ID NO: 2507 - DNA, 23 bp, Artificial Sequence
  HLA-A targeting gRNA
gtcggggctgggcggggctcggg

SEQ ID NO: 2508 - DNA, 23 bp, Artificial Sequence
  HLA-A targeting gRNA
tcggggctgggcggggctcgggg

SEQ ID NO: 2509 - DNA, 23 bp, Artificial Sequence
  HLA-A targeting gRNA
catttgtctccctttcttgtggg

SEQ ID NO: 2510 - DNA, 23 bp, Artificial Sequence
  HLA-A targeting gRNA
tggaggacctaatgtgtgttggg

SEQ ID NO: 2511 - DNA, 23 bp, Artificial Sequence
  HLA-A targeting gRNA
ttctcacagatagaaaaggaggg

SEQ ID NO: 2512 - DNA, 23 bp, Artificial Sequence
  HLA-A targeting gRNA
ccaatccatataccgccttcggg

SEQ ID NO: 2513 - DNA, 23 bp, Artificial Sequence
  HLA-A targeting gRNA
ttggaggacctaatgtgtgttgg

SEQ ID NO: 2514 - DNA, 23 bp, Artificial Sequence
  HLA-A targeting gRNA
ccacaagaaagggagacaaatgg

SEQ ID NO: 2515 - DNA, 23 bp, Artificial Sequence
  HLA-A targeting gRNA
tttcttctcacagatagaaaagg

SEQ ID NO: 2516 - DNA, 23 bp, Artificial Sequence
  HLA-A targeting gRNA
ccacaatggggatggtgggctgg

SEQ ID NO: 2517 - DNA, 23 bp, Artificial Sequence
  HLA-A targeting gRNA
aaccagtcatcagtattcgaggg

SEQ ID NO: 2518 - DNA, 23 bp, Artificial Sequence
  HLA-A targeting gRNA
aatcttctattccctgaggaggg

SEQ ID NO: 2519 - DNA, 23 bp, Artificial Sequence
  HLA-A targeting gRNA
acagatctcaggagggcgattgg

SEQ ID NO: 2520 - DNA, 23 bp, Artificial Sequence
  HLA-A targeting gRNA
acttcatatctgtcacagtgagg

SEQ ID NO: 2521 - DNA, 23 bp, Artificial Sequence
  HLA-A targeting gRNA
agacctacaggcgatcaggtagg

SEQ ID NO: 2522 - DNA, 23 bp, Artificial Sequence
  HLA-A targeting gRNA
aggaacagctcaggtggagaagg

SEQ ID NO: 2523 - DNA, 23 bp, Artificial Sequence
  HLA-A targeting gRNA
atccctcgaatactgatgactgg

SEQ ID NO: 2524 - DNA, 23 bp, Artificial Sequence
  HLA-A targeting gRNA
ccacgatgtggacggtgggctgg

SEQ ID NO: 2525 - DNA, 23 bp, Artificial Sequence
  HLA-A targeting gRNA
atgatgtttggctgcgacgtggg

SEQ ID NO: 2526 - DNA, 23 bp, Artificial Sequence
  HLA-A targeting gRNA
atgtggaggaggaacagctcagg

SEQ ID NO: 2527 - DNA, 23 bp, Artificial Sequence
  HLA-A targeting gRNA
caagatggccacatgcatgctgg

SEQ ID NO: 2528 - DNA, 23 bp, Artificial Sequence
  HLA-A targeting gRNA
cacaccctccagatgatgtttgg

SEQ ID NO: 2529 - DNA, 23 bp, Artificial Sequence
  HLA-A targeting gRNA
cacggtcccaaggctgctgccgg

SEQ ID NO: 2530 - DNA, 23 bp, Artificial Sequence
  HLA-A targeting gRNA
ccctcctgagatctgtcgtcagg

SEQ ID NO: 2531 - DNA, 23 bp, Artificial Sequence
  HLA-A targeting gRNA
ccctgacgacagatctcaggagg

SEQ ID NO: 2532 - DNA, 23 bp, Artificial Sequence
  HLA-A targeting gRNA
ccactcggtcagtgtgtgactgg

SEQ ID NO: 2533 - DNA, 23 bp, Artificial Sequence
  HLA-A targeting gRNA
cctcctgagatctgtcgtcaggg

SEQ ID NO: 2534 - DNA, 23 bp, Artificial Sequence
  HLA-A targeting gRNA
ccactgctccgcctcatgggcgg

SEQ ID NO: 2535 - DNA, 23 bp, Artificial Sequence
  HLA-A targeting gRNA
cctgacgacagatctcaggaggg

SEQ ID NO: 2536 - DNA, 23 bp, Artificial Sequence
  HLA-A targeting gRNA
cgcagccaaacatcatctggagg

SEQ ID NO: 2537 - DNA, 23 bp, Artificial Sequence
  HLA-A targeting gRNA
cgcctgtaggtctcccgggctgg

SEQ ID NO: 2538 - DNA, 23 bp, Artificial Sequence
  HLA-A targeting gRNA
cgggagacctacaggcgatcagg

SEQ ID NO: 2539 - DNA, 23 bp, Artificial Sequence
  HLA-A targeting gRNA
cgtcgcagccaaacatcatctgg

SEQ ID NO: 2540 - DNA, 23 bp, Artificial Sequence
  HLA-A targeting gRNA
ctgaaaatgaaaccgggttaagg

SEQ ID NO: 2541 - DNA, 23 bp, Artificial Sequence
  HLA-A targeting gRNA
ccagcaaggatgcccacgatggg

SEQ ID NO: 2542 - DNA, 23 bp, Artificial Sequence
  HLA-A targeting gRNA
ccagcaatgatgcccacaatggg

SEQ ID NO: 2543 - DNA, 23 bp, Artificial Sequence
  HLA-A targeting gRNA
ctgatcgcctgtaggtctcccgg

SEQ ID NO: 2544 - DNA, 23 bp, Artificial Sequence
  HLA-A targeting gRNA
cttcatatctgtcacagtgaggg

SEQ ID NO: 2545 - DNA, 23 bp, Artificial Sequence
  HLA-A targeting gRNA
gaaaccgggttaaggcgcctggg

SEQ ID NO: 2546 - DNA, 23 bp, Artificial Sequence
  HLA-A targeting gRNA
ccagcccaccatccccattgtgg

SEQ ID NO: 2547 - DNA, 23 bp, Artificial Sequence
  HLA-A targeting gRNA
ccagcccaccgtccacatcgtgg

SEQ ID NO: 2548 - DNA, 23 bp, Artificial Sequence
  HLA-A targeting gRNA
gaacagctcaggtggagaagggg

SEQ ID NO: 2549 - DNA, 23 bp, Artificial Sequence
  HLA-A targeting gRNA
gaaccagtcatcagtattcgagg

SEQ ID NO: 2550 - DNA, 23 bp, Artificial Sequence
  HLA-A targeting gRNA
gaggaaaagtcacggtcccaagg

SEQ ID NO: 2551 - DNA, 23 bp, Artificial Sequence
  HLA-A targeting gRNA
gaggcccaggcgccttaacccgg

SEQ ID NO: 2552 - DNA, 23 bp, Artificial Sequence
  HLA-A targeting gRNA
ccaggacacggagctcgtggagg

SEQ ID NO: 2553 - DNA, 23 bp, Artificial Sequence
  HLA-A targeting gRNA
ccaggagacacggaatatgaagg

SEQ ID NO: 2554 - DNA, 23 bp, Artificial Sequence
  HLA-A targeting gRNA
gatgatgtttggctgcgacgtgg

SEQ ID NO: 2555 - DNA, 23 bp, Artificial Sequence
  HLA-A targeting gRNA
ccaggagacgcggaatgtgaagg

SEQ ID NO: 2556 - DNA, 23 bp, Artificial Sequence
  HLA-A targeting gRNA
gcagccaaacatcatctggaggg

SEQ ID NO: 2557 - DNA, 23 bp, Artificial Sequence
  HLA-A targeting gRNA
gcagctgtggtggtaccttctgg

SEQ ID NO: 2558 - DNA, 23 bp, Artificial Sequence
  HLA-A targeting gRNA
gcgatcaggtaggcgccccgtgg

SEQ ID NO: 2559 - DNA, 23 bp, Artificial Sequence
  HLA-A targeting gRNA
gcgcctacctgatcgcctgtagg

SEQ ID NO: 2560 - DNA, 23 bp, Artificial Sequence
  HLA-A targeting gRNA
ggaacagctcaggtggagaaggg

SEQ ID NO: 2561 - DNA, 23 bp, Artificial Sequence
  HLA-A targeting gRNA
ggaccgtgacttttcctctcagg

SEQ ID NO: 2562 - DNA, 23 bp, Artificial Sequence
  HLA-A targeting gRNA
ggataatcttctattccctgagg

SEQ ID NO: 2563 - DNA, 23 bp, Artificial Sequence
  HLA-A targeting gRNA
ggccagcccgggagacctacagg

SEQ ID NO: 2564 - DNA, 23 bp, Artificial Sequence
  HLA-A targeting gRNA
ggggtggttgagctcccccatgg

SEQ ID NO: 2565 - DNA, 23 bp, Artificial Sequence
  HLA-A targeting gRNA
gggtggttgagctcccccatggg

SEQ ID NO: 2566 - DNA, 23 bp, Artificial Sequence
  HLA-A targeting gRNA
ggtaggcgccccgtggcccctgg

SEQ ID NO: 2567 - DNA, 23 bp, Artificial Sequence
  HLA-A targeting gRNA
ggtccctgacgacagatctcagg

SEQ ID NO: 2568 - DNA, 23 bp, Artificial Sequence
  HLA-A targeting gRNA
ccagtcacacactgaccgagtgg

SEQ ID NO: 2569 - DNA, 23 bp, Artificial Sequence
  HLA-A targeting gRNA
ggtcggcccatgattgtggatgg

SEQ ID NO: 2570 - DNA, 23 bp, Artificial Sequence
  HLA-A targeting gRNA
taaaatctctgacggaatgacgg

SEQ ID NO: 2571 - DNA, 23 bp, Artificial Sequence
  HLA-A targeting gRNA
taaggcgcctgggcctctcccgg

SEQ ID NO: 2572 - DNA, 23 bp, Artificial Sequence
  HLA-A targeting gRNA
taatcttctattccctgaggagg

SEQ ID NO: 2573 - DNA, 23 bp, Artificial Sequence
  HLA-A targeting gRNA
tgaaaccgggttaaggcgcctgg

SEQ ID NO: 2574 - DNA, 23 bp, Artificial Sequence
  HLA-A targeting gRNA
ccatctcagggtgaggggctcgg

SEQ ID NO: 2575 - DNA, 23 bp, Artificial Sequence
  HLA-A targeting gRNA
tgactggttccctttgacaccgg

SEQ ID NO: 2576 - DNA, 23 bp, Artificial Sequence
  HLA-A targeting gRNA
tgatcgcctgtaggtctcccggg

SEQ ID NO: 2577 - DNA, 23 bp, Artificial Sequence
  HLA-A targeting gRNA
tgatgtttggctgcgacgtgggg

SEQ ID NO: 2578 - DNA, 23 bp, Artificial Sequence
  HLA-A targeting gRNA
tggaggaggaacagctcaggtgg

SEQ ID NO: 2579 - DNA, 23 bp, Artificial Sequence
  HLA-A targeting gRNA
tgtggtggtaccttctggagagg

SEQ ID NO: 2580 - DNA, 23 bp, Artificial Sequence
  HLA-A targeting gRNA
ttaagggataaaatctctgacgg

SEQ ID NO: 2581 - DNA, 23 bp, Artificial Sequence
  HLA-A targeting gRNA
ccatttgtctccctttcttgtgg

SEQ ID NO: 2582 - DNA, 23 bp, Artificial Sequence
  HLA-A targeting gRNA
aaacatgaagaaagcagatgtgg

SEQ ID NO: 2583 - DNA, 23 bp, Artificial Sequence
  HLA-A targeting gRNA
aacatgaagaaagcagatgtggg

SEQ ID NO: 2584 - DNA, 23 bp, Artificial Sequence
  HLA-A targeting gRNA
aagaaagcagatgtgggccctgg

SEQ ID NO: 2585 - DNA, 23 bp, Artificial Sequence
  HLA-A targeting gRNA
cccaatccatataccgccttcgg

SEQ ID NO: 2586 - DNA, 23 bp, Artificial Sequence
  HLA-A targeting gRNA
cccacagaacatgtggctagagg

SEQ ID NO: 2587 - DNA, 23 bp, Artificial Sequence
  HLA-A targeting gRNA
cccatcgtgggcatccttgctgg

SEQ ID NO: 2588 - DNA, 23 bp, Artificial Sequence
  HLA-A targeting gRNA
cccattgtgggcatcattgctgg

SEQ ID NO: 2589 - DNA, 23 bp, Artificial Sequence
  HLA-A targeting gRNA
ccccaggctcccaatccatgagg

SEQ ID NO: 2590 - DNA, 23 bp, Artificial Sequence
  HLA-A targeting gRNA
ccccaggctcctactccatgagg

SEQ ID NO: 2591 - DNA, 23 bp, Artificial Sequence
  HLA-A targeting gRNA
ctcaggagggcgattggtccagg

SEQ ID NO: 2592 - DNA, 23 bp, Artificial Sequence
  HLA-A targeting gRNA
ccccccgggtgggtcggggcggg

SEQ ID NO: 2593 - DNA, 23 bp, Artificial Sequence
  HLA-A targeting gRNA
tcaggagggcgattggtccaggg

SEQ ID NO: 2594 - DNA, 23 bp, Artificial Sequence
  HLA-A targeting gRNA
ttcatatctgtcacagtgagggg

SEQ ID NO: 2595 - DNA, 23 bp, Artificial Sequence
  HLA-A targeting gRNA
cccccgggtgggtcggggcgggg

SEQ ID NO: 2596 - DNA, 23 bp, Artificial Sequence
  HLA-A targeting gRNA
ccccctggttggtcggggccggg

SEQ ID NO: 2597 - DNA, 23 bp, Artificial Sequence
  HLA-A targeting gRNA
ccccgaccccgcggtcagcccgg

SEQ ID NO: 2598 - DNA, 23 bp, Artificial Sequence
  HLA-A targeting gRNA
ccccgccccgacccacccggggg

SEQ ID NO: 2599 - DNA, 23 bp, Artificial Sequence
  HLA-A targeting gRNA
cccgaaggcggtatatggattgg

SEQ ID NO: 2600 - DNA, 23 bp, Artificial Sequence
  HLA-A targeting gRNA
agactgaccgagagaacctgcgg

SEQ ID NO: 2601 - DNA, 23 bp, Artificial Sequence
  HLA-A targeting gRNA
cgccgggaggagggtcgggcagg

SEQ ID NO: 2602 - DNA, 23 bp, Artificial Sequence
  HLA-A targeting gRNA
gacctgcccgaccctcctcccgg

SEQ ID NO: 2603 - DNA, 23 bp, Artificial Sequence
  HLA-A targeting gRNA
cccgccccgacccacccgggggg

SEQ ID NO: 2604 - DNA, 23 bp, Artificial Sequence
  HLA-A targeting gRNA
tgtgactgcagacccagggcagg

SEQ ID NO: 2605 - DNA, 23 bp, Artificial Sequence
  HLA-A targeting gRNA
actccacgcaccggccctccagg

SEQ ID NO: 2606 - DNA, 23 bp, Artificial Sequence
  HLA-A targeting gRNA
cacgcaccggccctccaggtagg

SEQ ID NO: 2607 - DNA, 23 bp, Artificial Sequence
  HLA-A targeting gRNA
cttcctccgcgggtaccagcagg

SEQ ID NO: 2608 - DNA, 23 bp, Artificial Sequence
  HLA-A targeting gRNA
tgcggagccactccacgcaccgg

SEQ ID NO: 2609 - DNA, 23 bp, Artificial Sequence
  HLA-A targeting gRNA
tggagggccggtgcgtggagtgg

SEQ ID NO: 2610 - DNA, 23 bp, Artificial Sequence
  HLA-A targeting gRNA
aagatggctctgggaaaagaggg

SEQ ID NO: 2611 - DNA, 23 bp, Artificial Sequence
  HLA-A targeting gRNA
cccggccccgaccaaccaggggg

SEQ ID NO: 2612 - DNA, 23 bp, Artificial Sequence
  HLA-A targeting gRNA
aatctgtccttcattgtcacagg

SEQ ID NO: 2613 - DNA, 23 bp, Artificial Sequence
  HLA-A targeting gRNA
acctgcccaggtctgggtcaggg

SEQ ID NO: 2614 - DNA, 23 bp, Artificial Sequence
  HLA-A targeting gRNA
cccggccggtggcgcaggtcagg

SEQ ID NO: 2615 - DNA, 23 bp, Artificial Sequence
  HLA-A targeting gRNA
agacctgggcaggtgagtgcggg

SEQ ID NO: 2616 - DNA, 23 bp, Artificial Sequence
  HLA-A targeting gRNA
agatggctctgggaaaagagggg

SEQ ID NO: 2617 - DNA, 23 bp, Artificial Sequence
  HLA-A targeting gRNA
aggtgagtgcggggtcgggaggg

SEQ ID NO: 2618 - DNA, 23 bp, Artificial Sequence
  HLA-A targeting gRNA
agtggcctcatggtcagagatgg

SEQ ID NO: 2619 - DNA, 23 bp, Artificial Sequence
  HLA-A targeting gRNA
cacctgcccaggtctgggtcagg

SEQ ID NO: 2620 - DNA, 23 bp, Artificial Sequence
  HLA-A targeting gRNA
cagacctgggcaggtgagtgcgg

SEQ ID NO: 2621 - DNA, 23 bp, Artificial Sequence
  HLA-A targeting gRNA
caggtgagtgcggggtcgggagg

SEQ ID NO: 2622 - DNA, 23 bp, Artificial Sequence
  HLA-A targeting gRNA
cgcactcacctgcccaggtctgg

SEQ ID NO: 2623 - DNA, 23 bp, Artificial Sequence
  HLA-A targeting gRNA
gaccccgcactcacctgcccagg

SEQ ID NO: 2624 - DNA, 23 bp, Artificial Sequence
  HLA-A targeting gRNA
gacctgggcaggtgagtgcgggg

SEQ ID NO: 2625 - DNA, 23 bp, Artificial Sequence
  HLA-A targeting gRNA
gcactcacctgcccaggtctggg

SEQ ID NO: 2626 - DNA, 23 bp, Artificial Sequence
  HLA-A targeting gRNA
gccctgacccagacctgggcagg

SEQ ID NO: 2627 - DNA, 23 bp, Artificial Sequence
  HLA-A targeting gRNA
gggcaggtgagtgcggggtcggg

SEQ ID NO: 2628 - DNA, 23 bp, Artificial Sequence
  HLA-A targeting gRNA
ccctcctgaggtctgtcgtcagg

SEQ ID NO: 2629 - DNA, 23 bp, Artificial Sequence
  HLA-A targeting gRNA
taaagcacctgtgacaatgaagg

SEQ ID NO: 2630 - DNA, 23 bp, Artificial Sequence
  HLA-A targeting gRNA
ccctgacgacagacctcaggagg

SEQ ID NO: 2631 - DNA, 23 bp, Artificial Sequence
  HLA-A targeting gRNA
tgggcaggtgagtgcggggtcgg

SEQ ID NO: 2632 - DNA, 23 bp, Artificial Sequence
  HLA-A targeting gRNA
ccctggccctgacccagaccagg

SEQ ID NO: 2633 - DNA, 23 bp, Artificial Sequence
  HLA-A targeting gRNA
ccctggtctgggtcagggccagg

SEQ ID NO: 2634 - DNA, 23 bp, Artificial Sequence
  HLA-A targeting gRNA
actccctccttttctatctgtgg

SEQ ID NO: 2635 - DNA, 23 bp, Artificial Sequence
  HLA-A targeting gRNA
ccgaaggcggtatatggattggg

SEQ ID NO: 2636 - DNA, 23 bp, Artificial Sequence
  HLA-A targeting gRNA
gaagcaccttccacaatcatggg

SEQ ID NO: 2637 - DNA, 23 bp, Artificial Sequence
  HLA-A targeting gRNA
ccgagcccctcaccctgagatgg

SEQ ID NO: 2638 - DNA, 23 bp, Artificial Sequence
  HLA-A targeting gRNA
ggaagcaccttccacaatcatgg

SEQ ID NO: 2639 - DNA, 23 bp, Artificial Sequence
  HLA-A targeting gRNA
ccgcccatgaggcggagcagtgg

SEQ ID NO: 2640 - DNA, 23 bp, Artificial Sequence
  HLA-A targeting gRNA
ggtcggcccatgattgtggaagg

SEQ ID NO: 2641 - DNA, 23 bp, Artificial Sequence
  HLA-A targeting gRNA
gcagccatacatcctctggatgg

SEQ ID NO: 2642 - DNA, 23 bp, Artificial Sequence
  HLA-A targeting gRNA
ccgccccgccccgacccacccgg

SEQ ID NO: 2643 - DNA, 23 bp, Artificial Sequence
  HLA-A targeting gRNA
agatctataggcgatcagggagg

SEQ ID NO: 2644 - DNA, 23 bp, Artificial Sequence
  HLA-A targeting gRNA
cgcctatagatctcccgggctgg

SEQ ID NO: 2645 - DNA, 23 bp, Artificial Sequence
  HLA-A targeting gRNA
cgggagatctataggcgatcagg

SEQ ID NO: 2646 - DNA, 23 bp, Artificial Sequence
  HLA-A targeting gRNA
ctgatcgcctatagatctcccgg

SEQ ID NO: 2647 - DNA, 23 bp, Artificial Sequence
  HLA-A targeting gRNA
ccgccgcggtctaagagcgcagg

SEQ ID NO: 2648 - DNA, 23 bp, Artificial Sequence
  HLA-A targeting gRNA
ggccagcccgggagatctatagg

SEQ ID NO: 2649 - DNA, 23 bp, Artificial Sequence
  HLA-A targeting gRNA
gggagatctataggcgatcaggg

SEQ ID NO: 2650 - DNA, 23 bp, Artificial Sequence
  HLA-A targeting gRNA
tgatcgcctatagatctcccggg

SEQ ID NO: 2651 - DNA, 23 bp, Artificial Sequence
  HLA-A targeting gRNA
ccggaacacacggaaagtgaagg

SEQ ID NO: 2652 - DNA, 23 bp, Artificial Sequence
  HLA-A targeting gRNA
cacaccatccagaggatgtatgg

SEQ ID NO: 2653 - DNA, 23 bp, Artificial Sequence
  HLA-A targeting gRNA
accctacgtaggttgggagaggg

SEQ ID NO: 2654 - DNA, 23 bp, Artificial Sequence
  HLA-A targeting gRNA
atgaaggaccctacgtaggttgg

SEQ ID NO: 2655 - DNA, 23 bp, Artificial Sequence
  HLA-A targeting gRNA
caggatgaaggaccctacgtagg

SEQ ID NO: 2656 - DNA, 23 bp, Artificial Sequence
  HLA-A targeting gRNA
ccggagatctacaggcgatcagg

SEQ ID NO: 2657 - DNA, 23 bp, Artificial Sequence
  HLA-A targeting gRNA
catcctggatactcacgacgcgg

SEQ ID NO: 2658 - DNA, 23 bp, Artificial Sequence
  HLA-A targeting gRNA
ctacgtagggtccttcatcctgg

SEQ ID NO: 2659 - DNA, 23 bp, Artificial Sequence
  HLA-A targeting gRNA
ctccctctcccaacctacgtagg

SEQ ID NO: 2660 - DNA, 23 bp, Artificial Sequence
  HLA-A targeting gRNA
gaagatggctctgggaaaagagg

SEQ ID NO: 2661 - DNA, 23 bp, Artificial Sequence
  HLA-A targeting gRNA
gaccctacgtaggttgggagagg

SEQ ID NO: 2662 - DNA, 23 bp, Artificial Sequence
  HLA-A targeting gRNA
gtcgtgagtatccaggatgaagg

SEQ ID NO: 2663 - DNA, 23 bp, Artificial Sequence
  HLA-A targeting gRNA
ccgggctgaccgcggggtcgggg

SEQ ID NO: 2664 - DNA, 23 bp, Artificial Sequence
  HLA-A targeting gRNA
tccctctcccaacctacgtaggg

SEQ ID NO: 2665 - DNA, 23 bp, Artificial Sequence
  HLA-A targeting gRNA
tgaaggaccctacgtaggttggg

SEQ ID NO: 2666 - DNA, 23 bp, Artificial Sequence
  HLA-A targeting gRNA
aaccctcctcctgctactcttgg

SEQ ID NO: 2667 - DNA, 23 bp, Artificial Sequence
  HLA-A targeting gRNA
acccgggtagccgcgccgggagg

SEQ ID NO: 2668 - DNA, 23 bp, Artificial Sequence
  HLA-A targeting gRNA
accctcctcctgctactcttggg

SEQ ID NO: 2669 - DNA, 23 bp, Artificial Sequence
  HLA-A targeting gRNA
ccgggtgggtcggggcggggcgg

SEQ ID NO: 2670 - DNA, 23 bp, Artificial Sequence
  HLA-A targeting gRNA
aggacccgggtagccgcgccggg

SEQ ID NO: 2671 - DNA, 23 bp, Artificial Sequence
  HLA-A targeting gRNA
caggacccgggtagccgcgccgg

SEQ ID NO: 2672 - DNA, 23 bp, Artificial Sequence
  HLA-A targeting gRNA
ccagggcccccaagagtagcagg

SEQ ID NO: 2673 - DNA, 23 bp, Artificial Sequence
  HLA-A targeting gRNA
ccccaagagtagcaggaggaggg

SEQ ID NO: 2674 - DNA, 23 bp, Artificial Sequence
  HLA-A targeting gRNA
cccccaagagtagcaggaggagg

SEQ ID NO: 2675 - DNA, 23 bp, Artificial Sequence
  HLA-A targeting gRNA
ccctcctcctgctactcttgggg

SEQ ID NO: 2676 - DNA, 23 bp, Artificial Sequence
  HLA-A targeting gRNA
cctcctcctgctactcttggggg

SEQ ID NO: 2677 - DNA, 23 bp, Artificial Sequence
  HLA-A targeting gRNA
cctgctactcttgggggccctgg

SEQ ID NO: 2678 - DNA, 23 bp, Artificial Sequence
  HLA-A targeting gRNA
cgggtagccgcgccgggaggagg

SEQ ID NO: 2679 - DNA, 23 bp, Artificial Sequence
  HLA-A targeting gRNA
cgggtgagtgcggggtcgtgggg

SEQ ID NO: 2680 - DNA, 23 bp, Artificial Sequence
  HLA-A targeting gRNA
cgtggggaaaccgcctctgcggg

SEQ ID NO: 2681 - DNA, 23 bp, Artificial Sequence
  HLA-A targeting gRNA
ctcctcccggcgcggctacccgg

SEQ ID NO: 2682 - DNA, 23 bp, Artificial Sequence
  HLA-A targeting gRNA
cctcaccctgagatgggataagg

SEQ ID NO: 2683 - DNA, 23 bp, Artificial Sequence
  HLA-A targeting gRNA
gcgggtgagtgcggggtcgtggg

SEQ ID NO: 2684 - DNA, 23 bp, Artificial Sequence
  HLA-A targeting gRNA
cctcaccctgagatgggttaagg

SEQ ID NO: 2685 - DNA, 23 bp, Artificial Sequence
  HLA-A targeting gRNA
ggcgggtgagtgcggggtcgtgg

SEQ ID NO: 2686 - DNA, 23 bp, Artificial Sequence
  HLA-A targeting gRNA
cctcatggagtaggagcctgggg

SEQ ID NO: 2687 - DNA, 23 bp, Artificial Sequence
  HLA-A targeting gRNA
gggcccccaagagtagcaggagg

SEQ ID NO: 2688 - DNA, 23 bp, Artificial Sequence
  HLA-A targeting gRNA
gggtagccgcgccgggaggaggg

SEQ ID NO: 2689 - DNA, 23 bp, Artificial Sequence
  HLA-A targeting gRNA
cctcatggattgggagcctgggg

SEQ ID NO: 2690 - DNA, 23 bp, Artificial Sequence
  HLA-A targeting gRNA
gtggggaaaccgcctctgcgggg

SEQ ID NO: 2691 - DNA, 23 bp, Artificial Sequence
  HLA-A targeting gRNA
tcctcccggcgcggctacccggg

SEQ ID NO: 2692 - DNA, 23 bp, Artificial Sequence
  HLA-A targeting gRNA
cctccacgagctccgtgtcctgg

SEQ ID NO: 2693 - DNA, 23 bp, Artificial Sequence
  HLA-A targeting gRNA
tcgtggggaaaccgcctctgcgg

SEQ ID NO: 2694 - DNA, 23 bp, Artificial Sequence
  HLA-A targeting gRNA
caggttctcacaccatccagagg

SEQ ID NO: 2695 - DNA, 23 bp, Artificial Sequence
  HLA-A targeting gRNA
ctctggatggtgtgagaacctgg

SEQ ID NO: 2696 - DNA, 23 bp, Artificial Sequence
  HLA-A targeting gRNA
gagtctctcagcctccactcagg

SEQ ID NO: 2697 - DNA, 23 bp, Artificial Sequence
  HLA-A targeting gRNA
gctgagagactcagaagtgctgg

SEQ ID NO: 2698 - DNA, 23 bp, Artificial Sequence
  HLA-A targeting gRNA
cctcctgaggtctgtcgtcaggg

SEQ ID NO: 2699 - DNA, 23 bp, Artificial Sequence
  HLA-A targeting gRNA
tctcagcctccactcaggtcagg

SEQ ID NO: 2700 - DNA, 23 bp, Artificial Sequence
  HLA-A targeting gRNA
cctctagccacatgttctgtggg

SEQ ID NO: 2701 - DNA, 23 bp, Artificial Sequence
  HLA-A targeting gRNA
cctctctggagacctttatcagg

SEQ ID NO: 2702 - DNA, 23 bp, Artificial Sequence
  HLA-A targeting gRNA
cctgacctgcgccaccggccggg

SEQ ID NO: 2703 - DNA, 23 bp, Artificial Sequence
  HLA-A targeting gRNA
cctgacgacagacctcaggaggg

SEQ ID NO: 2704 - DNA, 23 bp, Artificial Sequence
  HLA-A targeting gRNA
cctgataaaggtctccagagagg

SEQ ID NO: 2705 - DNA, 23 bp, Artificial Sequence
  HLA-A targeting gRNA
cctgatcgcctgtagatctccgg

SEQ ID NO: 2706 - DNA, 23 bp, Artificial Sequence
  HLA-A targeting gRNA
cctgcagacacgtaatgtgaagg

SEQ ID NO: 2707 - DNA, 23 bp, Artificial Sequence
  HLA-A targeting gRNA
cctgcgctcttagaccgcggcgg

SEQ ID NO: 2708 - DNA, 23 bp, Artificial Sequence
  HLA-A targeting gRNA
cctggccctgacccagaccaggg

SEQ ID NO: 2709 - DNA, 23 bp, Artificial Sequence
  HLA-A targeting gRNA
cctgggcctctcccgggacaagg

SEQ ID NO: 2710 - DNA, 23 bp, Artificial Sequence
  HLA-A targeting gRNA
cctggtctgggtcagggccaggg

SEQ ID NO: 2711 - DNA, 23 bp, Artificial Sequence
  HLA-A targeting gRNA
ccttaacccatctcagggtgagg

SEQ ID NO: 2712 - DNA, 23 bp, Artificial Sequence
  HLA-A targeting gRNA
ccttatcccatctcagggtgagg

SEQ ID NO: 2713 - DNA, 23 bp, Artificial Sequence
  HLA-A targeting gRNA
ccttcacattacgtgtctgcagg

SEQ ID NO: 2714 - DNA, 23 bp, Artificial Sequence
  HLA-A targeting gRNA
ccttcacattccgcgtctcctgg

SEQ ID NO: 2715 - DNA, 23 bp, Artificial Sequence
  HLA-A targeting gRNA
ccttcactttccgtgtgttccgg

SEQ ID NO: 2716 - DNA, 23 bp, Artificial Sequence
  HLA-A targeting gRNA
ccttcatattccgtgtctcctgg

SEQ ID NO: 2717 - DNA, 23 bp, Artificial Sequence
  HLA-A targeting gRNA
acagactgaccgagcgaacctgg

SEQ ID NO: 2718 - DNA, 23 bp, Artificial Sequence
  HLA-A targeting gRNA
agactgaccgagcgaacctgggg

SEQ ID NO: 2719 - DNA, 23 bp, Artificial Sequence
  HLA-A targeting gRNA
cagactgaccgagcgaacctggg

SEQ ID NO: 2720 - DNA, 23 bp, Artificial Sequence
  HLA-A targeting gRNA
ccttgtcccgggagaggcccagg

SEQ ID NO: 2721 - DNA, 23 bp, Artificial Sequence
  HLA-A targeting gRNA
cgaaggcggtatatggattgggg

SEQ ID NO: 2722 - DNA, 23 bp, Artificial Sequence
  HLA-A targeting gRNA
gaagcaccatccacaatcatggg

SEQ ID NO: 2723 - DNA, 23 bp, Artificial Sequence
  HLA-A targeting gRNA
cgacacgcagttcgtgcggttgg

SEQ ID NO: 2724 - DNA, 23 bp, Artificial Sequence
  HLA-A targeting gRNA
cgaccaaccagggggatttttgg

SEQ ID NO: 2725 - DNA, 23 bp, Artificial Sequence
  HLA-A targeting gRNA
cgacctgccggtacccgcggagg

SEQ ID NO: 2726 - DNA, 23 bp, Artificial Sequence
  HLA-A targeting gRNA
cgacgccgcgagccaaaggatgg

SEQ ID NO: 2727 - DNA, 23 bp, Artificial Sequence
  HLA-A targeting gRNA
cgacgccgcgagccagaagatgg

SEQ ID NO: 2728 - DNA, 23 bp, Artificial Sequence
  HLA-A targeting gRNA
ggaagcaccatccacaatcatgg

SEQ ID NO: 2729 - DNA, 23 bp, Artificial Sequence
  HLA-A targeting gRNA
gatggtgtgagaacctggcccgg

SEQ ID NO: 2730 - DNA, 23 bp, Artificial Sequence
  HLA-A targeting gRNA
ctcatcccccacggacgggccgg

SEQ ID NO: 2731 - DNA, 23 bp, Artificial Sequence
  HLA-A targeting gRNA
gcgacccggcccgtccgtggggg

SEQ ID NO: 2732 - DNA, 23 bp, Artificial Sequence
  HLA-A targeting gRNA
cgagacccttgtcccgggagagg

SEQ ID NO: 2733 - DNA, 23 bp, Artificial Sequence
  HLA-A targeting gRNA
tcatcccccacggacgggccggg

SEQ ID NO: 2734 - DNA, 23 bp, Artificial Sequence
  HLA-A targeting gRNA
cgagccaaaggatggagccgcgg

SEQ ID NO: 2735 - DNA, 23 bp, Artificial Sequence
  HLA-A targeting gRNA
cgagccagaagatggagccgcgg

SEQ ID NO: 2736 - DNA, 23 bp, Artificial Sequence
  HLA-A targeting gRNA
cgagcccctcaccctgagatggg

SEQ ID NO: 2737 - DNA, 23 bp, Artificial Sequence
  HLA-A targeting gRNA
accgggctgacctcggggtccgg

SEQ ID NO: 2738 - DNA, 23 bp, Artificial Sequence
  HLA-A targeting gRNA
agaacctggcccggaccccgagg

SEQ ID NO: 2739 - DNA, 23 bp, Artificial Sequence
  HLA-A targeting gRNA
cgaggacggtgaccccggcccgg

SEQ ID NO: 2740 - DNA, 23 bp, Artificial Sequence
  HLA-A targeting gRNA
cgaggagacacggaatgtgaagg

SEQ ID NO: 2741 - DNA, 23 bp, Artificial Sequence
  HLA-A targeting gRNA
cccggaccccgaggtcagcccgg

SEQ ID NO: 2742 - DNA, 23 bp, Artificial Sequence
  HLA-A targeting gRNA
ccgggctgacctcggggtccggg

SEQ ID NO: 2743 - DNA, 23 bp, Artificial Sequence
  HLA-A targeting gRNA
cgatgaagcagggctccccgcgg

SEQ ID NO: 2744 - DNA, 23 bp, Artificial Sequence
  HLA-A targeting gRNA
cgggggaccgggctgacctcggg

SEQ ID NO: 2745 - DNA, 23 bp, Artificial Sequence
  HLA-A targeting gRNA
ctgacctcggggtccgggccagg

SEQ ID NO: 2746 - DNA, 23 bp, Artificial Sequence
  HLA-A targeting gRNA
cgatgaagcggggttccccgcgg

SEQ ID NO: 2747 - DNA, 23 bp, Artificial Sequence
  HLA-A targeting gRNA
cgcacaggtaccaggggccacgg

SEQ ID NO: 2748 - DNA, 23 bp, Artificial Sequence
  HLA-A targeting gRNA
cgcacgagtaccaggggccacgg

SEQ ID NO: 2749 - DNA, 23 bp, Artificial Sequence
  HLA-A targeting gRNA
cgcacgggtaccagggaccacgg

SEQ ID NO: 2750 - DNA, 23 bp, Artificial Sequence
  HLA-A targeting gRNA
gggggaccgggctgacctcgggg

SEQ ID NO: 2751 - DNA, 23 bp, Artificial Sequence
  HLA-A targeting gRNA
tcgggggaccgggctgacctcgg

SEQ ID NO: 2752 - DNA, 23 bp, Artificial Sequence
  HLA-A targeting gRNA
cccggagactgtgggcgacccgg

SEQ ID NO: 2753 - DNA, 23 bp, Artificial Sequence
  HLA-A targeting gRNA
cgcactcacccgccctggtctgg

SEQ ID NO: 2754 - DNA, 23 bp, Artificial Sequence
  HLA-A targeting gRNA
ccgggtcgcccacagtctccggg

SEQ ID NO: 2755 - DNA, 23 bp, Artificial Sequence
  HLA-A targeting gRNA
cgcactggtaccaggggccacgg

SEQ ID NO: 2756 - DNA, 23 bp, Artificial Sequence
  HLA-A targeting gRNA
gccgggtcgcccacagtctccgg

SEQ ID NO: 2757 - DNA, 23 bp, Artificial Sequence
  HLA-A targeting gRNA
ggcgacccggcccgtccgtgggg

SEQ ID NO: 2758 - DNA, 23 bp, Artificial Sequence
  HLA-A targeting gRNA
gggcgacccggcccgtccgtggg

SEQ ID NO: 2759 - DNA, 23 bp, Artificial Sequence
  HLA-A targeting gRNA
tgggcgacccggcccgtccgtgg

SEQ ID NO: 2760 - DNA, 23 bp, Artificial Sequence
  HLA-A targeting gRNA
ccggaacacacggaatgtgaagg

SEQ ID NO: 2761 - DNA, 23 bp, Artificial Sequence
  HLA-A targeting gRNA
ccttcacattccgtgtgttccgg

SEQ ID NO: 2762 - DNA, 23 bp, Artificial Sequence
  HLA-A targeting gRNA
gcagggtccccaggttcgctcgg

SEQ ID NO: 2763 - DNA, 23 bp, Artificial Sequence
  HLA-A targeting gRNA
cgccccgccccgacccacccggg

SEQ ID NO: 2764 - DNA, 23 bp, Artificial Sequence
  HLA-A targeting gRNA
gcgaacctggggaccctgcgcgg

SEQ ID NO: 2765 - DNA, 23 bp, Artificial Sequence
  HLA-A targeting gRNA
acccgggaagccgcgcctggagg

SEQ ID NO: 2766 - DNA, 23 bp, Artificial Sequence
  HLA-A targeting gRNA
cgccctccctctggtcttgaggg

SEQ ID NO: 2767 - DNA, 23 bp, Artificial Sequence
  HLA-A targeting gRNA
agccgcgcctggaggagggtcgg

SEQ ID NO: 2768 - DNA, 23 bp, Artificial Sequence
  HLA-A targeting gRNA
aggacccgggaagccgcgcctgg

SEQ ID NO: 2769 - DNA, 23 bp, Artificial Sequence
  HLA-A targeting gRNA
ccccttgcttctccccacagagg

SEQ ID NO: 2770 - DNA, 23 bp, Artificial Sequence
  HLA-A targeting gRNA
cctctgtggggagaagcaagggg

SEQ ID NO: 2771 - DNA, 23 bp, Artificial Sequence
  HLA-A targeting gRNA
cgcctggaggagggtcgggcggg

SEQ ID NO: 2772 - DNA, 23 bp, Artificial Sequence
  HLA-A targeting gRNA
cgggaagccgcgcctggaggagg

SEQ ID NO: 2773 - DNA, 23 bp, Artificial Sequence
  HLA-A targeting gRNA
ctcctccaggcgcggcttcccgg

SEQ ID NO: 2774 - DNA, 23 bp, Artificial Sequence
  HLA-A targeting gRNA
gacccgcccgaccctcctccagg

SEQ ID NO: 2775 - DNA, 23 bp, Artificial Sequence
  HLA-A targeting gRNA
gcccgaccctcctccaggcgcgg

SEQ ID NO: 2776 - DNA, 23 bp, Artificial Sequence
  HLA-A targeting gRNA
gccgcgcctggaggagggtcggg

SEQ ID NO: 2777 - DNA, 23 bp, Artificial Sequence
  HLA-A targeting gRNA
gcctctgtggggagaagcaaggg

SEQ ID NO: 2778 - DNA, 23 bp, Artificial Sequence
  HLA-A targeting gRNA
gcgcctggaggagggtcgggcgg

SEQ ID NO: 2779 - DNA, 23 bp, Artificial Sequence
  HLA-A targeting gRNA
cgcctgtagatctccggggctgg

SEQ ID NO: 2780 - DNA, 23 bp, Artificial Sequence
  HLA-A targeting gRNA
ggcctctgtggggagaagcaagg

SEQ ID NO: 2781 - DNA, 23 bp, Artificial Sequence
  HLA-A targeting gRNA
gggaagccgcgcctggaggaggg

SEQ ID NO: 2782 - DNA, 23 bp, Artificial Sequence
  HLA-A targeting gRNA
tcctccaggcgcggcttcccggg

SEQ ID NO: 2783 - DNA, 23 bp, Artificial Sequence
  HLA-A targeting gRNA
cgcgggtaccaggggccacaggg

SEQ ID NO: 2784 - DNA, 23 bp, Artificial Sequence
  HLA-A targeting gRNA
accgggggagccgcgccgggagg

SEQ ID NO: 2785 - DNA, 23 bp, Artificial Sequence
  HLA-A targeting gRNA
cgctcggtcagtctgtgagtggg

SEQ ID NO: 2786 - DNA, 23 bp, Artificial Sequence
  HLA-A targeting gRNA
cgctcggttagtctgtgagtggg

SEQ ID NO: 2787 - DNA, 23 bp, Artificial Sequence
  HLA-A targeting gRNA
cgctgcagcgcacaggtaccagg

SEQ ID NO: 2788 - DNA, 23 bp, Artificial Sequence
  HLA-A targeting gRNA
cgctgcagcgcacgagtaccagg

SEQ ID NO: 2789 - DNA, 23 bp, Artificial Sequence
  HLA-A targeting gRNA
gggggagccgcgccgggaggagg

SEQ ID NO: 2790 - DNA, 23 bp, Artificial Sequence
  HLA-A targeting gRNA
cgctgcagcgcactggtaccagg

SEQ ID NO: 2791 - DNA, 23 bp, Artificial Sequence
  HLA-A targeting gRNA
tcctcccggcgcggctcccccgg

SEQ ID NO: 2792 - DNA, 23 bp, Artificial Sequence
  HLA-A targeting gRNA
agtattgggaccggaacacacgg

SEQ ID NO: 2793 - DNA, 23 bp, Artificial Sequence
  HLA-A targeting gRNA
cggagatctacaggcgatcaggg

SEQ ID NO: 2794 - DNA, 23 bp, Artificial Sequence
  HLA-A targeting gRNA
cggagtctcccacttgcgctggg

SEQ ID NO: 2795 - DNA, 23 bp, Artificial Sequence
  HLA-A targeting gRNA
cggcccgtccgtggggaatgagg

SEQ ID NO: 2796 - DNA, 23 bp, Artificial Sequence
  HLA-A targeting gRNA
cggcccgtcgggcggagcagcgg

SEQ ID NO: 2797 - DNA, 23 bp, Artificial Sequence
  HLA-A targeting gRNA
cggctactacaacgagagcgagg

SEQ ID NO: 2798 - DNA, 23 bp, Artificial Sequence
  HLA-A targeting gRNA
cagcagagagcctacctggaggg

SEQ ID NO: 2799 - DNA, 23 bp, Artificial Sequence
  HLA-A targeting gRNA
gcagcagagagcctacctggagg

SEQ ID NO: 2800 - DNA, 23 bp, Artificial Sequence
  HLA-A targeting gRNA
cggctccatcctttggctcgcgg

SEQ ID NO: 2801 - DNA, 23 bp, Artificial Sequence
  HLA-A targeting gRNA
cggctccatcttctggctcgcgg

SEQ ID NO: 2802 - DNA, 23 bp, Artificial Sequence
  HLA-A targeting gRNA
ccgccgcggtccaggagcgcagg

SEQ ID NO: 2803 - DNA, 23 bp, Artificial Sequence
  HLA-A targeting gRNA
cctgcgctcctggaccgcggcgg

SEQ ID NO: 2804 - DNA, 23 bp, Artificial Sequence
  HLA-A targeting gRNA
ctacctggagggccggtgcgtgg

SEQ ID NO: 2805 - DNA, 23 bp, Artificial Sequence
  HLA-A targeting gRNA
ggacctgcgctcctggaccgcgg

SEQ ID NO: 2806 - DNA, 23 bp, Artificial Sequence
  HLA-A targeting gRNA
ggacgggctccgcagatacctgg

SEQ ID NO: 2807 - DNA, 23 bp, Artificial Sequence
  HLA-A targeting gRNA
ggagcagcagagagcctacctgg

SEQ ID NO: 2808 - DNA, 23 bp, Artificial Sequence
  HLA-A targeting gRNA
cagacacctggagaacgggaagg

SEQ ID NO: 2809 - DNA, 23 bp, Artificial Sequence
  HLA-A targeting gRNA
accttgattatggcggtgatggg

SEQ ID NO: 2810 - DNA, 23 bp, Artificial Sequence
  HLA-A targeting gRNA
atttatcaccttgattatggcgg

SEQ ID NO: 2811 - DNA, 23 bp, Artificial Sequence
  HLA-A targeting gRNA
caccttgattatggcggtgatgg

SEQ ID NO: 2812 - DNA, 23 bp, Artificial Sequence
  HLA-A targeting gRNA
cagatttatcaccttgattatgg

SEQ ID NO: 2813 - DNA, 23 bp, Artificial Sequence
  HLA-A targeting gRNA
tcccatcaccgccataatcaagg

SEQ ID NO: 2814 - DNA, 23 bp, Artificial Sequence
  HLA-A targeting gRNA
cggggctcgggggagctgggcgg

SEQ ID NO: 2815 - DNA, 23 bp, Artificial Sequence
  HLA-A targeting gRNA
ctccgcagacacctggagaacgg

SEQ ID NO: 2816 - DNA, 23 bp, Artificial Sequence
  HLA-A targeting gRNA
tcccgttctccaggtgtctgcgg

SEQ ID NO: 2817 - DNA, 23 bp, Artificial Sequence
  HLA-A targeting gRNA
tccgcagacacctggagaacggg

SEQ ID NO: 2818 - DNA, 23 bp, Artificial Sequence
  HLA-A targeting gRNA
cgggggagctgggcggggctcgg

SEQ ID NO: 2819 - DNA, 23 bp, Artificial Sequence
  HLA-A targeting gRNA
cgggggctgggctgaccgcgggg

SEQ ID NO: 2820 - DNA, 23 bp, Artificial Sequence
  HLA-A targeting gRNA
cggggtcaccgtcctcgctctgg

SEQ ID NO: 2821 - DNA, 23 bp, Artificial Sequence
  HLA-A targeting gRNA
ggagtggctccgcagacacctgg

SEQ ID NO: 2822 - DNA, 23 bp, Artificial Sequence
  HLA-A targeting gRNA
cgggtgggtcggggcggggcggg

SEQ ID NO: 2823 - DNA, 23 bp, Artificial Sequence
  HLA-A targeting gRNA
gaagaaatacctcatggagtggg

SEQ ID NO: 2824 - DNA, 23 bp, Artificial Sequence
  HLA-A targeting gRNA
tgaagaaatacctcatggagtgg

SEQ ID NO: 2825 - DNA, 23 bp, Artificial Sequence
  HLA-A targeting gRNA
atttctccacatccgtgtcccgg

SEQ ID NO: 2826 - DNA, 23 bp, Artificial Sequence
  HLA-A targeting gRNA
tccacatccgtgtcccggcccgg

SEQ ID NO: 2827 - DNA, 23 bp, Artificial Sequence
  HLA-A targeting gRNA
cggtccatgcggcggagcagcgg

SEQ ID NO: 2828 - DNA, 23 bp, Artificial Sequence
  HLA-A targeting gRNA
cggtgagtgaccccggccggtgg

SEQ ID NO: 2829 - DNA, 23 bp, Artificial Sequence
  HLA-A targeting gRNA
cgtagcccacagcgatgaagcgg

SEQ ID NO: 2830 - DNA, 23 bp, Artificial Sequence
  HLA-A targeting gRNA
cgtccacgcaccggccctccagg

SEQ ID NO: 2831 - DNA, 23 bp, Artificial Sequence
  HLA-A targeting gRNA
cgtccacgcactcgccctccagg

SEQ ID NO: 2832 - DNA, 23 bp, Artificial Sequence
  HLA-A targeting gRNA
cgtcgcaaccatacatcctctgg

SEQ ID NO: 2833 - DNA, 23 bp, Artificial Sequence
  HLA-A targeting gRNA
cgtcttggggggggtctgtcagg

SEQ ID NO: 2834 - DNA, 23 bp, Artificial Sequence
  HLA-A targeting gRNA
cgtgacctgcgcccccggccggg

SEQ ID NO: 2835 - DNA, 23 bp, Artificial Sequence
  HLA-A targeting gRNA
cgtgctgccggtacccgcggagg

SEQ ID NO: 2836 - DNA, 23 bp, Artificial Sequence
  HLA-A targeting gRNA
cgtggaggccaggcctgcagggg

SEQ ID NO: 2837 - DNA, 23 bp, Artificial Sequence
  HLA-A targeting gRNA
cgtggcagccatacatcatctgg

SEQ ID NO: 2838 - DNA, 23 bp, Artificial Sequence
  HLA-A targeting gRNA
cgtgggcatccttgctggcctgg

SEQ ID NO: 2839 - DNA, 23 bp, Artificial Sequence
  HLA-A targeting gRNA
cgtgtcgtccatgtagcccacgg

SEQ ID NO: 2840 - DNA, 23 bp, Artificial Sequence
  HLA-A targeting gRNA
ctacctggagggcgagttcgtgg

SEQ ID NO: 2841 - DNA, 23 bp, Artificial Sequence
  HLA-A targeting gRNA
ctagaggaacctcgtagccttgg

SEQ ID NO: 2842 - DNA, 23 bp, Artificial Sequence
  HLA-A targeting gRNA
ctataatatcgccctccctctgg

SEQ ID NO: 2843 - DNA, 23 bp, Artificial Sequence
  HLA-A targeting gRNA
ctcacccactcctcgcccccagg

SEQ ID NO: 2844 - DNA, 23 bp, Artificial Sequence
  HLA-A targeting gRNA
ctcagatcaccaagcacaagtgg

SEQ ID NO: 2845 - DNA, 23 bp, Artificial Sequence
  HLA-A targeting gRNA
ctcagatcaccgagcgcaagtgg

SEQ ID NO: 2846 - DNA, 23 bp, Artificial Sequence
  HLA-A targeting gRNA
ctcagctactcctcgcccccagg

SEQ ID NO: 2847 - DNA, 23 bp, Artificial Sequence
  HLA-A targeting gRNA
ctcaggagggcggttggtccagg

SEQ ID NO: 2848 - DNA, 23 bp, Artificial Sequence
  HLA-A targeting gRNA
ctcatggagtaggagcctggggg

SEQ ID NO: 2849 - DNA, 23 bp, Artificial Sequence
  HLA-A targeting gRNA
ctcattccccacggacgggccgg

SEQ ID NO: 2850 - DNA, 23 bp, Artificial Sequence
  HLA-A targeting gRNA
ctccacagggtagaagctcaggg

SEQ ID NO: 2851 - DNA, 23 bp, Artificial Sequence
  HLA-A targeting gRNA
ctccagcgatcacagctccaagg

SEQ ID NO: 2852 - DNA, 23 bp, Artificial Sequence
  HLA-A targeting gRNA
ctcccaaccacaatatcccaagg

SEQ ID NO: 2853 - DNA, 23 bp, Artificial Sequence
  HLA-A targeting gRNA
ctccctcaagaccagagggaggg

SEQ ID NO: 2854 - DNA, 23 bp, Artificial Sequence
  HLA-A targeting gRNA
ctccctcaggagcagagggaggg

SEQ ID NO: 2855 - DNA, 23 bp, Artificial Sequence
  HLA-A targeting gRNA
ctccctccttaacccatctcagg

SEQ ID NO: 2856 - DNA, 23 bp, Artificial Sequence
  HLA-A targeting gRNA
ctccctccttatcccatctcagg

SEQ ID NO: 2857 - DNA, 23 bp, Artificial Sequence
  HLA-A targeting gRNA
ctccctccttttctaactgtggg

SEQ ID NO: 2858 - DNA, 23 bp, Artificial Sequence
  HLA-A targeting gRNA
ctccgcagatacctgaagaacgg

SEQ ID NO: 2859 - DNA, 23 bp, Artificial Sequence
  HLA-A targeting gRNA
ctccgcctcccacttgcgcttgg

SEQ ID NO: 2860 - DNA, 23 bp, Artificial Sequence
  HLA-A targeting gRNA
ctcctggaccgcggcggacatgg

SEQ ID NO: 2861 - DNA, 23 bp, Artificial Sequence
  HLA-A targeting gRNA
ctccttggagctgtgatcgctgg

SEQ ID NO: 2862 - DNA, 23 bp, Artificial Sequence
  HLA-A targeting gRNA
ctcggagccccgcggcttcgggg

SEQ ID NO: 2863 - DNA, 23 bp, Artificial Sequence
  HLA-A targeting gRNA
ctcggagtcccgcggcttcgggg

SEQ ID NO: 2864 - DNA, 23 bp, Artificial Sequence
  HLA-A targeting gRNA
ctcgggggctgggctgaccgcgg

SEQ ID NO: 2865 - DNA, 23 bp, Artificial Sequence
  HLA-A targeting gRNA
ctcgtggaggccaggcctgcagg

SEQ ID NO: 2866 - DNA, 23 bp, Artificial Sequence
  HLA-A targeting gRNA
ctcgttgtagtagccgcgcaggg

SEQ ID NO: 2867 - DNA, 23 bp, Artificial Sequence
  HLA-A targeting gRNA
ctctcaactgctccgcccaacgg

SEQ ID NO: 2868 - DNA, 23 bp, Artificial Sequence
  HLA-A targeting gRNA
ctctcaactgctcctccacacgg

SEQ ID NO: 2869 - DNA, 23 bp, Artificial Sequence
  HLA-A targeting gRNA
ctctcaactgctctgccacacgg

SEQ ID NO: 2870 - DNA, 23 bp, Artificial Sequence
  HLA-A targeting gRNA
ctctcagctgctccgccacatgg

SEQ ID NO: 2871 - DNA, 23 bp, Artificial Sequence
  HLA-A targeting gRNA
ctctcagctgctccgcccgacgg

SEQ ID NO: 2872 - DNA, 23 bp, Artificial Sequence
  HLA-A targeting gRNA
ctctcccgggacaagggtctcgg

SEQ ID NO: 2873 - DNA, 23 bp, Artificial Sequence
  HLA-A targeting gRNA
ctctccgctgctccgcccgacgg

SEQ ID NO: 2874 - DNA, 23 bp, Artificial Sequence
  HLA-A targeting gRNA
ctctccgctgctccgccgcatgg

SEQ ID NO: 2875 - DNA, 23 bp, Artificial Sequence
  HLA-A targeting gRNA
ctctcggtcagtctgtgactggg

SEQ ID NO: 2876 - DNA, 23 bp, Artificial Sequence
  HLA-A targeting gRNA
ctctctgctgctccgccacacgg

SEQ ID NO: 2877 - DNA, 23 bp, Artificial Sequence
  HLA-A targeting gRNA
ctctctgctgctccgcctcatgg

SEQ ID NO: 2878 - DNA, 23 bp, Artificial Sequence
  HLA-A targeting gRNA
ctctctggagacctttatcaggg

SEQ ID NO: 2879 - DNA, 23 bp, Artificial Sequence
  HLA-A targeting gRNA
ctctgcagggtagaagcccaggg

SEQ ID NO: 2880 - DNA, 23 bp, Artificial Sequence
  HLA-A targeting gRNA
ctctggatgctgtgagaacctgg

SEQ ID NO: 2881 - DNA, 23 bp, Artificial Sequence
  HLA-A targeting gRNA
ctctggggtccaaggctacgagg

SEQ ID NO: 2882 - DNA, 23 bp, Artificial Sequence
  HLA-A targeting gRNA
ctcttagaccgcggcggacatgg

SEQ ID NO: 2883 - DNA, 23 bp, Artificial Sequence
  HLA-A targeting gRNA
ctgaaaatgaaaccggctaaagg

SEQ ID NO: 2884 - DNA, 23 bp, Artificial Sequence
  HLA-A targeting gRNA
ctgaccatgaggccactctgagg

SEQ ID NO: 2885 - DNA, 23 bp, Artificial Sequence
  HLA-A targeting gRNA
ccccccgggttggtcggggcggg

SEQ ID NO: 2886 - DNA, 23 bp, Artificial Sequence
  HLA-A targeting gRNA
cccccgggttggtcggggcgggg

SEQ ID NO: 2887 - DNA, 23 bp, Artificial Sequence
  HLA-A targeting gRNA
ctgacctgcgccaccggccgggg

SEQ ID NO: 2888 - DNA, 23 bp, Artificial Sequence
  HLA-A targeting gRNA
ccccgccccgaccaacccggggg

SEQ ID NO: 2889 - DNA, 23 bp, Artificial Sequence
  HLA-A targeting gRNA
cccgccccgaccaacccgggggg

SEQ ID NO: 2890 - DNA, 23 bp, Artificial Sequence
  HLA-A targeting gRNA
ccgccccgccccgaccaacccgg

SEQ ID NO: 2891 - DNA, 23 bp, Artificial Sequence
  HLA-A targeting gRNA
ccgggttggtcggggcggggcgg

SEQ ID NO: 2892 - DNA, 23 bp, Artificial Sequence
  HLA-A targeting gRNA
ctgaggtccttgggatattgtgg

SEQ ID NO: 2893 - DNA, 23 bp, Artificial Sequence
  HLA-A targeting gRNA
cgccccgccccgaccaacccggg

SEQ ID NO: 2894 - DNA, 23 bp, Artificial Sequence
  HLA-A targeting gRNA
gccccgccccgaccaacccgggg

SEQ ID NO: 2895 - DNA, 23 bp, Artificial Sequence
  HLA-A targeting gRNA
ctgatcgcctgtagatctccggg

SEQ ID NO: 2896 - DNA, 23 bp, Artificial Sequence
  HLA-A targeting gRNA
tccccccgggttggtcggggcgg

SEQ ID NO: 2897 - DNA, 23 bp, Artificial Sequence
  HLA-A targeting gRNA
ctgatgtgtgttgggtgttgggg

SEQ ID NO: 2898 - DNA, 23 bp, Artificial Sequence
  HLA-A targeting gRNA
ctgcagagatcacactgacctgg

SEQ ID NO: 2899 - DNA, 23 bp, Artificial Sequence
  HLA-A targeting gRNA
ctgcagcgcacaggtaccagggg

SEQ ID NO: 2900 - DNA, 23 bp, Artificial Sequence
  HLA-A targeting gRNA
ctgcagcgcacgagtaccagggg

SEQ ID NO: 2901 - DNA, 23 bp, Artificial Sequence
  HLA-A targeting gRNA
cgggagggaaaccgcctctgcgg

SEQ ID NO: 2902 - DNA, 23 bp, Artificial Sequence
  HLA-A targeting gRNA
ggagggaaaccgcctctgcgggg

SEQ ID NO: 2903 - DNA, 23 bp, Artificial Sequence
  HLA-A targeting gRNA
ctgcagcgcactggtaccagggg

SEQ ID NO: 2904 - DNA, 23 bp, Artificial Sequence
  HLA-A targeting gRNA
gggagggaaaccgcctctgcggg

SEQ ID NO: 2905 - DNA, 23 bp, Artificial Sequence
  HLA-A targeting gRNA
ctgcccggccccgaccaaccagg

SEQ ID NO: 2906 - DNA, 23 bp, Artificial Sequence
  HLA-A targeting gRNA
ctgccgccggtgtgtgtcaaagg

SEQ ID NO: 2907 - DNA, 23 bp, Artificial Sequence
  HLA-A targeting gRNA
ctgccttgtgtgggactgaaagg

SEQ ID NO: 2908 - DNA, 23 bp, Artificial Sequence
  HLA-A targeting gRNA
ggtgtgacccctcactgtgatgg

SEQ ID NO: 2909 - DNA, 23 bp, Artificial Sequence
  HLA-A targeting gRNA
ctcagccactgctcgcccccagg

SEQ ID NO: 2910 - DNA, 23 bp, Artificial Sequence
  HLA-A targeting gRNA
gggagcctgggggcgagcagtgg

SEQ ID NO: 2911 - DNA, 23 bp, Artificial Sequence
  HLA-A targeting gRNA
ctggaaacccgacacccaatagg

SEQ ID NO: 2912 - DNA, 23 bp, Artificial Sequence
  HLA-A targeting gRNA
aagacagctctgggaaaagaggg

SEQ ID NO: 2913 - DNA, 23 bp, Artificial Sequence
  HLA-A targeting gRNA
ctggaaacccgacacccaattgg

SEQ ID NO: 2914 - DNA, 23 bp, Artificial Sequence
  HLA-A targeting gRNA
agacagctctgggaaaagagggg

SEQ ID NO: 2915 - DNA, 23 bp, Artificial Sequence
  HLA-A targeting gRNA
agctctgggaaaagaggggaagg

SEQ ID NO: 2916 - DNA, 23 bp, Artificial Sequence
  HLA-A targeting gRNA
ctggaccaaccgccctcctgagg

SEQ ID NO: 2917 - DNA, 23 bp, Artificial Sequence
  HLA-A targeting gRNA
gaagacagctctgggaaaagagg

SEQ ID NO: 2918 - DNA, 23 bp, Artificial Sequence
  HLA-A targeting gRNA
ctggaccaatcgccctcctgagg

SEQ ID NO: 2919 - DNA, 23 bp, Artificial Sequence
  HLA-A targeting gRNA
gtgggctgggaagacagctctgg

SEQ ID NO: 2920 - DNA, 23 bp, Artificial Sequence
  HLA-A targeting gRNA
ctggagggccggtgcgtggacgg

SEQ ID NO: 2921 - DNA, 23 bp, Artificial Sequence
  HLA-A targeting gRNA
tgggctgggaagacagctctggg

SEQ ID NO: 2922 - DNA, 23 bp, Artificial Sequence
  HLA-A targeting gRNA
ctggagggcgagtgcgtggacgg

SEQ ID NO: 2923 - DNA, 23 bp, Artificial Sequence
  HLA-A targeting gRNA
aaaaggagggagttacactcagg

SEQ ID NO: 2924 - DNA, 23 bp, Artificial Sequence
  HLA-A targeting gRNA
acagacctcaggagggctattgg

SEQ ID NO: 2925 - DNA, 23 bp, Artificial Sequence
  HLA-A targeting gRNA
ctcaggagggctattggtccagg

SEQ ID NO: 2926 - DNA, 23 bp, Artificial Sequence
  HLA-A targeting gRNA
ctggaccaatagccctcctgagg

SEQ ID NO: 2927 - DNA, 23 bp, Artificial Sequence
  HLA-A targeting gRNA
gctcttcctcctccacatcacgg

SEQ ID NO: 2928 - DNA, 23 bp, Artificial Sequence
  HLA-A targeting gRNA
tcgctgccgtgatgtggaggagg

SEQ ID NO: 2929 - DNA, 23 bp, Artificial Sequence
  HLA-A targeting gRNA
agcatgcgatgggctgtttaagg

SEQ ID NO: 2930 - DNA, 23 bp, Artificial Sequence
  HLA-A targeting gRNA
ctgggcctctcccgggacaaggg

SEQ ID NO: 2931 - DNA, 23 bp, Artificial Sequence
  HLA-A targeting gRNA
aaaatctctgaaggagtgacggg

SEQ ID NO: 2932 - DNA, 23 bp, Artificial Sequence
  HLA-A targeting gRNA
aagcaaggggccctcctggcggg

SEQ ID NO: 2933 - DNA, 23 bp, Artificial Sequence
  HLA-A targeting gRNA
aagtcgctgttcccttctcaggg

SEQ ID NO: 2934 - DNA, 23 bp, Artificial Sequence
  HLA-A targeting gRNA
ctgggcggggctcgggggctggg

SEQ ID NO: 2935 - DNA, 23 bp, Artificial Sequence
  HLA-A targeting gRNA
aatcttctattccctgagaaggg

SEQ ID NO: 2936 - DNA, 23 bp, Artificial Sequence
  HLA-A targeting gRNA
agcaaggggccctcctggcgggg

SEQ ID NO: 2937 - DNA, 23 bp, Artificial Sequence
  HLA-A targeting gRNA
aggaagagctcaggtggagaagg

SEQ ID NO: 2938 - DNA, 23 bp, Artificial Sequence
  HLA-A targeting gRNA
aggaccgggggagccgcgccggg

SEQ ID NO: 2939 - DNA, 23 bp, Artificial Sequence
  HLA-A targeting gRNA
ctgggtgggcccatgattgtggg

SEQ ID NO: 2940 - DNA, 23 bp, Artificial Sequence
  HLA-A targeting gRNA
ctggttggtcggggccgggcagg

SEQ ID NO: 2941 - DNA, 23 bp, Artificial Sequence
  HLA-A targeting gRNA
caagatggccacatgcgtgctgg

SEQ ID NO: 2942 - DNA, 23 bp, Artificial Sequence
  HLA-A targeting gRNA
caggaccgggggagccgcgccgg

SEQ ID NO: 2943 - DNA, 23 bp, Artificial Sequence
  HLA-A targeting gRNA
ctggttgtagtagccgtgcaggg

SEQ ID NO: 2944 - DNA, 23 bp, Artificial Sequence
  HLA-A targeting gRNA
cccggtcctgcgcccccgccagg

SEQ ID NO: 2945 - DNA, 23 bp, Artificial Sequence
  HLA-A targeting gRNA
ctgtggagatcacactgacctgg

SEQ ID NO: 2946 - DNA, 23 bp, Artificial Sequence
  HLA-A targeting gRNA
cctggcgggggcgcaggaccggg

SEQ ID NO: 2947 - DNA, 23 bp, Artificial Sequence
  HLA-A targeting gRNA
ctggcgggggcgcaggaccgggg

SEQ ID NO: 2948 - DNA, 23 bp, Artificial Sequence
  HLA-A targeting gRNA
gaagcaaggggccctcctggcgg

SEQ ID NO: 2949 - DNA, 23 bp, Artificial Sequence
  HLA-A targeting gRNA
gaagtcgctgttcccttctcagg

SEQ ID NO: 2950 - DNA, 23 bp, Artificial Sequence
  HLA-A targeting gRNA
cttaacccatctcagggtgaggg

SEQ ID NO: 2951 - DNA, 23 bp, Artificial Sequence
  HLA-A targeting gRNA
gagaagggaacagcgacttctgg

SEQ ID NO: 2952 - DNA, 23 bp, Artificial Sequence
  HLA-A targeting gRNA
gatggccacatgcgtgctggtgg

SEQ ID NO: 2953 - DNA, 23 bp, Artificial Sequence
  HLA-A targeting gRNA
gcaaggggccctcctggcggggg

SEQ ID NO: 2954 - DNA, 23 bp, Artificial Sequence
  HLA-A targeting gRNA
ggaagagctcaggtggagaaggg

SEQ ID NO: 2955 - DNA, 23 bp, Artificial Sequence
  HLA-A targeting gRNA
cttatcccatctcagggtgaggg

SEQ ID NO: 2956 - DNA, 23 bp, Artificial Sequence
  HLA-A targeting gRNA
cttcacactcaatatgtgtgggg

SEQ ID NO: 2957 - DNA, 23 bp, Artificial Sequence
  HLA-A targeting gRNA
ggagaagcaaggggccctcctgg

SEQ ID NO: 2958 - DNA, 23 bp, Artificial Sequence
  HLA-A targeting gRNA
ggccctcctggcgggggcgcagg

SEQ ID NO: 2959 - DNA, 23 bp, Artificial Sequence
  HLA-A targeting gRNA
ggtcctgcgcccccgccaggagg

SEQ ID NO: 2960 - DNA, 23 bp, Artificial Sequence
  HLA-A targeting gRNA
gtcctgcgcccccgccaggaggg

SEQ ID NO: 2961 - DNA, 23 bp, Artificial Sequence
  HLA-A targeting gRNA
cttcatcgccgtgggctacatgg

SEQ ID NO: 2962 - DNA, 23 bp, Artificial Sequence
  HLA-A targeting gRNA
taaaatctctgaaggagtgacgg

SEQ ID NO: 2963 - DNA, 23 bp, Artificial Sequence
  HLA-A targeting gRNA
cttcatcgctgtgggctacgtgg

SEQ ID NO: 2964 - DNA, 23 bp, Artificial Sequence
  HLA-A targeting gRNA
taatcttctattccctgagaagg

SEQ ID NO: 2965 - DNA, 23 bp, Artificial Sequence
  HLA-A targeting gRNA
tcctggcgggggcgcaggaccgg

SEQ ID NO: 2966 - DNA, 23 bp, Artificial Sequence
  HLA-A targeting gRNA
tgagtggttccctttgacaccgg

SEQ ID NO: 2967 - DNA, 23 bp, Artificial Sequence
  HLA-A targeting gRNA
tggcgggggcgcaggaccggggg

SEQ ID NO: 2968 - DNA, 23 bp, Artificial Sequence
  HLA-A targeting gRNA
tgtggtggtgccttctggagagg

SEQ ID NO: 2969 - DNA, 23 bp, Artificial Sequence
  HLA-A targeting gRNA
ggccgcctcccacttgcgcttgg

SEQ ID NO: 2970 - DNA, 23 bp, Artificial Sequence
  HLA-A targeting gRNA
cttcccacagttagaaaaggagg

SEQ ID NO: 2971 - DNA, 23 bp, Artificial Sequence
  HLA-A targeting gRNA
ggggccggagtattgggaccagg

SEQ ID NO: 2972 - DNA, 23 bp, Artificial Sequence
  HLA-A targeting gRNA
gtctcctggtcccaatactccgg

SEQ ID NO: 2973 - DNA, 23 bp, Artificial Sequence
  HLA-A targeting gRNA
aatcatgggccgacccagcctgg

SEQ ID NO: 2974 - DNA, 23 bp, Artificial Sequence
  HLA-A targeting gRNA
acacagggcccaggctgggtcgg

SEQ ID NO: 2975 - DNA, 23 bp, Artificial Sequence
  HLA-A targeting gRNA
atcatgggccgacccagcctggg

SEQ ID NO: 2976 - DNA, 23 bp, Artificial Sequence
  HLA-A targeting gRNA
gctgggtcggcccatgattgtgg

SEQ ID NO: 2977 - DNA, 23 bp, Artificial Sequence
  HLA-A targeting gRNA
cttgctggcctggttctctttgg

SEQ ID NO: 2978 - DNA, 23 bp, Artificial Sequence
  HLA-A targeting gRNA
tgtaaaggtgagagcttggaggg

SEQ ID NO: 2979 - DNA, 23 bp, Artificial Sequence
  HLA-A targeting gRNA
ttggagggcctgatgtgtgttgg

SEQ ID NO: 2980 - DNA, 23 bp, Artificial Sequence
  HLA-A targeting gRNA
cttgtggagaccaagcctgcagg

SEQ ID NO: 2981 - DNA, 23 bp, Artificial Sequence
  HLA-A targeting gRNA
aattcatatccatcacagtgagg

SEQ ID NO: 2982 - DNA, 23 bp, Artificial Sequence
  HLA-A targeting gRNA
attcatatccatcacagtgaggg

SEQ ID NO: 2983 - DNA, 23 bp, Artificial Sequence
  HLA-A targeting gRNA
ttcatatccatcacagtgagggg

SEQ ID NO: 2984 - DNA, 23 bp, Artificial Sequence
  HLA-A targeting gRNA
ccaggagacacggaatgtgaagg

SEQ ID NO: 2985 - DNA, 23 bp, Artificial Sequence
  HLA-A targeting gRNA
ccttcacattccgtgtctcctgg

SEQ ID NO: 2986 - DNA, 23 bp, Artificial Sequence
  HLA-A targeting gRNA
ccctcctgaggtctgtcctcagg

SEQ ID NO: 2987 - DNA, 23 bp, Artificial Sequence
  HLA-A targeting gRNA
gaaaccggctaaaggcgcctggg

SEQ ID NO: 2988 - DNA, 23 bp, Artificial Sequence
  HLA-A targeting gRNA
ccctgaggacagacctcaggagg

SEQ ID NO: 2989 - DNA, 23 bp, Artificial Sequence
  HLA-A targeting gRNA
gaaaccgggttaaaggcgcctgg

SEQ ID NO: 2990 - DNA, 23 bp, Artificial Sequence
  HLA-A targeting gRNA
cctcctgaggtctgtcctcaggg

SEQ ID NO: 2991 - DNA, 23 bp, Artificial Sequence
  HLA-A targeting gRNA
cctgaggacagacctcaggaggg

SEQ ID NO: 2992 - DNA, 23 bp, Artificial Sequence
  HLA-A targeting gRNA
ctgtggtcgctgccgtgatgtgg

SEQ ID NO: 2993 - DNA, 23 bp, Artificial Sequence
  HLA-A targeting gRNA
ggtccctgaggacagacctcagg

SEQ ID NO: 2994 - DNA, 23 bp, Artificial Sequence
  HLA-A targeting gRNA
gaaccccgcttcatcgccgtggg

SEQ ID NO: 2995 - DNA, 23 bp, Artificial Sequence
  HLA-A targeting gRNA
tggtcgctgccgtgatgtggagg

SEQ ID NO: 2996 - DNA, 23 bp, Artificial Sequence
  HLA-A targeting gRNA
cactcggtcagtctgtgactggg

SEQ ID NO: 2997 - DNA, 23 bp, Artificial Sequence
  HLA-A targeting gRNA
ccactcggtcagtctgtgactgg

SEQ ID NO: 2998 - DNA, 23 bp, Artificial Sequence
  HLA-A targeting gRNA
ccagtcacagactgaccgagtgg

SEQ ID NO: 2999 - DNA, 23 bp, Artificial Sequence
  HLA-A targeting gRNA
aaccctcctcctgctactctcgg

SEQ ID NO: 3000 - DNA, 23 bp, Artificial Sequence
  HLA-A targeting gRNA
acactccaccagcacgcatgtgg

SEQ ID NO: 3001 - DNA, 23 bp, Artificial Sequence
  HLA-A targeting gRNA
accctcctcctgctactctcggg

SEQ ID NO: 3002 - DNA, 23 bp, Artificial Sequence
  HLA-A targeting gRNA
cccccgagagtagcaggaggagg

SEQ ID NO: 3003 - DNA, 23 bp, Artificial Sequence
  HLA-A targeting gRNA
ccccgagagtagcaggaggaggg

SEQ ID NO: 3004 - DNA, 23 bp, Artificial Sequence
  HLA-A targeting gRNA
ccctcctcctgctactctcgggg

SEQ ID NO: 3005 - DNA, 23 bp, Artificial Sequence
  HLA-A targeting gRNA
cctcctcctgctactctcggggg

SEQ ID NO: 3006 - DNA, 23 bp, Artificial Sequence
  HLA-A targeting gRNA
gaagagctcaggtggagaagggg

SEQ ID NO: 3007 - DNA, 23 bp, Artificial Sequence
  HLA-A targeting gRNA
gggcccccgagagtagcaggagg

SEQ ID NO: 3008 - DNA, 23 bp, Artificial Sequence
  HLA-A targeting gRNA
gaagcaccacccacaatcatggg

SEQ ID NO: 3009 - DNA, 23 bp, Artificial Sequence
  HLA-A targeting gRNA
ataatgtatggctgcgacgtggg

SEQ ID NO: 3010 - DNA, 23 bp, Artificial Sequence
  HLA-A targeting gRNA
cacaccatccagataatgtatgg

SEQ ID NO: 3011 - DNA, 23 bp, Artificial Sequence
  HLA-A targeting gRNA
cgtcgcagccatacattatctgg

SEQ ID NO: 3012 - DNA, 23 bp, Artificial Sequence
  HLA-A targeting gRNA
gataatgtatggctgcgacgtgg

SEQ ID NO: 3013 - DNA, 23 bp, Artificial Sequence
  HLA-A targeting gRNA
gcagccatacattatctggatgg

SEQ ID NO: 3014 - DNA, 23 bp, Artificial Sequence
  HLA-A targeting gRNA
gaagcagggctccccgcggccgg

SEQ ID NO: 3015 - DNA, 23 bp, Artificial Sequence
  HLA-A targeting gRNA
taatgtatggctgcgacgtgggg

SEQ ID NO: 3016 - DNA, 23 bp, Artificial Sequence
  HLA-A targeting gRNA
cccggcgggggcgcaggacccgg

SEQ ID NO: 3017 - DNA, 23 bp, Artificial Sequence
  HLA-A targeting gRNA
cccgggtcctgcgcccccgccgg

SEQ ID NO: 3018 - DNA, 23 bp, Artificial Sequence
  HLA-A targeting gRNA
ccggcgggggcgcaggacccggg

SEQ ID NO: 3019 - DNA, 23 bp, Artificial Sequence
  HLA-A targeting gRNA
ccgggtcctgcgcccccgccggg

SEQ ID NO: 3020 - DNA, 23 bp, Artificial Sequence
  HLA-A targeting gRNA
gaagcggggttccccgcggccgg

SEQ ID NO: 3021 - DNA, 23 bp, Artificial Sequence
  HLA-A targeting gRNA
gaaggaaacgctgcagcgcacgg

SEQ ID NO: 3022 - DNA, 23 bp, Artificial Sequence
  HLA-A targeting gRNA
gcaaggggcccgcccggcggggg

SEQ ID NO: 3023 - DNA, 23 bp, Artificial Sequence
  HLA-A targeting gRNA
ggcccgcccggcgggggcgcagg

SEQ ID NO: 3024 - DNA, 23 bp, Artificial Sequence
  HLA-A targeting gRNA
gaaggagatgctgcagcgcacgg

SEQ ID NO: 3025 - DNA, 23 bp, Artificial Sequence
  HLA-A targeting gRNA
ggtcctgcgcccccgccgggcgg

SEQ ID NO: 3026 - DNA, 23 bp, Artificial Sequence
  HLA-A targeting gRNA
gtcctgcgcccccgccgggcggg

SEQ ID NO: 3027 - DNA, 23 bp, Artificial Sequence
  HLA-A targeting gRNA
gaagtcgctgttccctcgtcagg

SEQ ID NO: 3028 - DNA, 23 bp, Artificial Sequence
  HLA-A targeting gRNA
gaagtcgctgttccctctgcagg

SEQ ID NO: 3029 - DNA, 23 bp, Artificial Sequence
  HLA-A targeting gRNA
gaatgtgaagaaatacctcatgg

SEQ ID NO: 3030 - DNA, 23 bp, Artificial Sequence
  HLA-A targeting gRNA
ggagtgggagcctggggacgagg

SEQ ID NO: 3031 - DNA, 23 bp, Artificial Sequence
  HLA-A targeting gRNA
gaccagggcgggtgagtgcgggg

SEQ ID NO: 3032 - DNA, 23 bp, Artificial Sequence
  HLA-A targeting gRNA
gacccacccggggggatttttgg

SEQ ID NO: 3033 - DNA, 23 bp, Artificial Sequence
  HLA-A targeting gRNA
gacccagttctcactccaattgg

SEQ ID NO: 3034 - DNA, 23 bp, Artificial Sequence
  HLA-A targeting gRNA
gacccagttctcactcctattgg

SEQ ID NO: 3035 - DNA, 23 bp, Artificial Sequence
  HLA-A targeting gRNA
gaccccgcactcacccgccctgg

SEQ ID NO: 3036 - DNA, 23 bp, Artificial Sequence
  HLA-A targeting gRNA
gacccctcatcccctacggacgg

SEQ ID NO: 3037 - DNA, 23 bp, Artificial Sequence
  HLA-A targeting gRNA
gacccctcattccccacggacgg

SEQ ID NO: 3038 - DNA, 23 bp, Artificial Sequence
  HLA-A targeting gRNA
gggagcctggggacgaggagtgg

SEQ ID NO: 3039 - DNA, 23 bp, Artificial Sequence
  HLA-A targeting gRNA
gaccgcctcccacttgcgcttgg

SEQ ID NO: 3040 - DNA, 23 bp, Artificial Sequence
  HLA-A targeting gRNA
gaccgggctgaccgcggggtcgg

SEQ ID NO: 3041 - DNA, 23 bp, Artificial Sequence
  HLA-A targeting gRNA
gacctgacagcgggatggggagg

SEQ ID NO: 3042 - DNA, 23 bp, Artificial Sequence
  HLA-A targeting gRNA
gacctggcagcgggatagggagg

SEQ ID NO: 3043 - DNA, 23 bp, Artificial Sequence
  HLA-A targeting gRNA
gacgagggaacagcgacttctgg

SEQ ID NO: 3044 - DNA, 23 bp, Artificial Sequence
  HLA-A targeting gRNA
gacgccgaggatggccatcatgg

SEQ ID NO: 3045 - DNA, 23 bp, Artificial Sequence
  HLA-A targeting gRNA
gactccgagacccttgccccggg

SEQ ID NO: 3046 - DNA, 23 bp, Artificial Sequence
  HLA-A targeting gRNA
gactccgagacccttgtcccggg

SEQ ID NO: 3047 - DNA, 23 bp, Artificial Sequence
  HLA-A targeting gRNA
gacttgtgactgctgggttcagg

SEQ ID NO: 3048 - DNA, 23 bp, Artificial Sequence
  HLA-A targeting gRNA
gagaccaagcctgcaggggatgg

SEQ ID NO: 3049 - DNA, 23 bp, Artificial Sequence
  HLA-A targeting gRNA
gagactgaccgagtggacctggg

SEQ ID NO: 3050 - DNA, 23 bp, Artificial Sequence
  HLA-A targeting gRNA
gccgggccgggacacggatgtgg

SEQ ID NO: 3051 - DNA, 23 bp, Artificial Sequence
  HLA-A targeting gRNA
gagccaaaggatggagccgcggg

SEQ ID NO: 3052 - DNA, 23 bp, Artificial Sequence
  HLA-A targeting gRNA
gagccagaagatggagccgcggg

SEQ ID NO: 3053 - DNA, 23 bp, Artificial Sequence
  HLA-A targeting gRNA
ctcagccactcctcgcccccagg

SEQ ID NO: 3054 - DNA, 23 bp, Artificial Sequence
  HLA-A targeting gRNA
caccctccctctggtcctgaggg

SEQ ID NO: 3055 - DNA, 23 bp, Artificial Sequence
  HLA-A targeting gRNA
ctagaatatcaccctccctctgg

SEQ ID NO: 3056 - DNA, 23 bp, Artificial Sequence
  HLA-A targeting gRNA
gagccccgcttcatcgctgtggg

SEQ ID NO: 3057 - DNA, 23 bp, Artificial Sequence
  HLA-A targeting gRNA
tcaccctccctctggtcctgagg

SEQ ID NO: 3058 - DNA, 23 bp, Artificial Sequence
  HLA-A targeting gRNA
ctcaggtggagaaggggtgaagg

SEQ ID NO: 3059 - DNA, 23 bp, Artificial Sequence
  HLA-A targeting gRNA
gagccctgcttcatcgccgtggg

SEQ ID NO: 3060 - DNA, 23 bp, Artificial Sequence
  HLA-A targeting gRNA
ggtggagaaggggtgaagggtgg

SEQ ID NO: 3061 - DNA, 23 bp, Artificial Sequence
  HLA-A targeting gRNA
gtggagaaggggtgaagggtggg

SEQ ID NO: 3062 - DNA, 23 bp, Artificial Sequence
  HLA-A targeting gRNA
gagctaccagaaaggagccaggg

SEQ ID NO: 3063 - DNA, 23 bp, Artificial Sequence
  HLA-A targeting gRNA
tcaggtggagaaggggtgaaggg

SEQ ID NO: 3064 - DNA, 23 bp, Artificial Sequence
  HLA-A targeting gRNA
tggagaaggggtgaagggtgggg

SEQ ID NO: 3065 - DNA, 23 bp, Artificial Sequence
  HLA-A targeting gRNA
gggagcctgggggcgaggagtgg

SEQ ID NO: 3066 - DNA, 23 bp, Artificial Sequence
  HLA-A targeting gRNA
gaggacagacctcaggagggcgg

SEQ ID NO: 3067 - DNA, 23 bp, Artificial Sequence
  HLA-A targeting gRNA
gaggacggtgaccccggcccggg

SEQ ID NO: 3068 - DNA, 23 bp, Artificial Sequence
  HLA-A targeting gRNA
ggagaaatacctcatggagtggg

SEQ ID NO: 3069 - DNA, 23 bp, Artificial Sequence
  HLA-A targeting gRNA
tggagaaatacctcatggagtgg

SEQ ID NO: 3070 - DNA, 23 bp, Artificial Sequence
  HLA-A targeting gRNA
gaggatgtatggttgcgacgtgg

SEQ ID NO: 3071 - DNA, 23 bp, Artificial Sequence
  HLA-A targeting gRNA
gaggccaggcctgcaggggatgg

SEQ ID NO: 3072 - DNA, 23 bp, Artificial Sequence
  HLA-A targeting gRNA
ggagggtgatattctagtgttgg

SEQ ID NO: 3073 - DNA, 23 bp, Artificial Sequence
  HLA-A targeting gRNA
caccaagcgcaagtgggaggcgg

SEQ ID NO: 3074 - DNA, 23 bp, Artificial Sequence
  HLA-A targeting gRNA
gaggcccaggcgcctttagccgg

SEQ ID NO: 3075 - DNA, 23 bp, Artificial Sequence
  HLA-A targeting gRNA
ctcagatcaccaagcgcaagtgg

SEQ ID NO: 3076 - DNA, 23 bp, Artificial Sequence
  HLA-A targeting gRNA
gatcaccaagcgcaagtgggagg

SEQ ID NO: 3077 - DNA, 23 bp, Artificial Sequence
  HLA-A targeting gRNA
tcagatcaccaagcgcaagtggg

SEQ ID NO: 3078 - DNA, 23 bp, Artificial Sequence
  HLA-A targeting gRNA
gaggggccggagtattgggacgg

SEQ ID NO: 3079 - DNA, 23 bp, Artificial Sequence
  HLA-A targeting gRNA
ggatgtggagaaatacctcatgg

SEQ ID NO: 3080 - DNA, 23 bp, Artificial Sequence
  HLA-A targeting gRNA
aagcaaggggcccgcccggcggg

SEQ ID NO: 3081 - DNA, 23 bp, Artificial Sequence
  HLA-A targeting gRNA
agcaaggggcccgcccggcgggg

SEQ ID NO: 3082 - DNA, 23 bp, Artificial Sequence
  HLA-A targeting gRNA
gagggttcggggcgccatgatgg

SEQ ID NO: 3083 - DNA, 23 bp, Artificial Sequence
  HLA-A targeting gRNA
gagggttcggggcggcatgacgg

SEQ ID NO: 3084 - DNA, 23 bp, Artificial Sequence
  HLA-A targeting gRNA
gaagcaaggggcccgcccggcgg

SEQ ID NO: 3085 - DNA, 23 bp, Artificial Sequence
  HLA-A targeting gRNA
gaggtgggtgagctcccccatgg

SEQ ID NO: 3086 - DNA, 23 bp, Artificial Sequence
  HLA-A targeting gRNA
ggagaagcaaggggcccgcccgg

SEQ ID NO: 3087 - DNA, 23 bp, Artificial Sequence
  HLA-A targeting gRNA
agtattgggaccaggagacacgg

SEQ ID NO: 3088 - DNA, 23 bp, Artificial Sequence
  HLA-A targeting gRNA
gagtcactctctggaaacccagg

SEQ ID NO: 3089 - DNA, 23 bp, Artificial Sequence
  HLA-A targeting gRNA
gagtcatatgcgtcctggggggg

SEQ ID NO: 3090 - DNA, 23 bp, Artificial Sequence
  HLA-A targeting gRNA
gagtggcccgaccctcctcccgg

SEQ ID NO: 3091 - DNA, 23 bp, Artificial Sequence
  HLA-A targeting gRNA
aagagcgcaggtcctcgttcagg

SEQ ID NO: 3092 - DNA, 23 bp, Artificial Sequence
  HLA-A targeting gRNA
agagcgcaggtcctcgttcaggg

SEQ ID NO: 3093 - DNA, 23 bp, Artificial Sequence
  HLA-A targeting gRNA
gatcacactgacctgacagcggg

SEQ ID NO: 3094 - DNA, 23 bp, Artificial Sequence
  HLA-A targeting gRNA
gatcaccaagcacaagtgggagg

SEQ ID NO: 3095 - DNA, 23 bp, Artificial Sequence
  HLA-A targeting gRNA
gatcaccgagcgcaagtgggagg

SEQ ID NO: 3096 - DNA, 23 bp, Artificial Sequence
  HLA-A targeting gRNA
gatgatgtatggctgccacgtgg

SEQ ID NO: 3097 - DNA, 23 bp, Artificial Sequence
  HLA-A targeting gRNA
gatgcccacaatggggatggtgg

SEQ ID NO: 3098 - DNA, 23 bp, Artificial Sequence
  HLA-A targeting gRNA
gatgcccacgatgtggacggtgg

SEQ ID NO: 3099 - DNA, 23 bp, Artificial Sequence
  HLA-A targeting gRNA
gatgctgtgagaacctggcccgg

SEQ ID NO: 3100 - DNA, 23 bp, Artificial Sequence
  HLA-A targeting gRNA
gatggacaggacacctgggatgg

SEQ ID NO: 3101 - DNA, 23 bp, Artificial Sequence
  HLA-A targeting gRNA
gatggccatcctcggcgtctggg

SEQ ID NO: 3102 - DNA, 23 bp, Artificial Sequence
  HLA-A targeting gRNA
gatgggataaggagggagatggg

SEQ ID NO: 3103 - DNA, 23 bp, Artificial Sequence
  HLA-A targeting gRNA
gatgggttaaggagggagatggg

SEQ ID NO: 3104 - DNA, 23 bp, Artificial Sequence
  HLA-A targeting gRNA
gatgtaatccttgccgtcttagg

SEQ ID NO: 3105 - DNA, 23 bp, Artificial Sequence
  HLA-A targeting gRNA
gatgtaatccttgccttcgtagg

SEQ ID NO: 3106 - DNA, 23 bp, Artificial Sequence
  HLA-A targeting gRNA
gatgtgtgttgggtgttgggggg

SEQ ID NO: 3107 - DNA, 23 bp, Artificial Sequence
  HLA-A targeting gRNA
gatgtgtgttgggtgttgggtgg

SEQ ID NO: 3108 - DNA, 23 bp, Artificial Sequence
  HLA-A targeting gRNA
gattgtgggtggtgcttcccagg

SEQ ID NO: 3109 - DNA, 23 bp, Artificial Sequence
  HLA-A targeting gRNA
gcaaccatacatcctctggatgg

SEQ ID NO: 3110 - DNA, 23 bp, Artificial Sequence
  HLA-A targeting gRNA
gcaagggtctcggagtcccgcgg

SEQ ID NO: 3111 - DNA, 23 bp, Artificial Sequence
  HLA-A targeting gRNA
gcaagtgggaggcggcccgttgg

SEQ ID NO: 3112 - DNA, 23 bp, Artificial Sequence
  HLA-A targeting gRNA
gcacagaacccagaccagcctgg

SEQ ID NO: 3113 - DNA, 23 bp, Artificial Sequence
  HLA-A targeting gRNA
gcacaggtaccaggggccacggg

SEQ ID NO: 3114 - DNA, 23 bp, Artificial Sequence
  HLA-A targeting gRNA
gcacctgcatgtgtctgtgttgg

SEQ ID NO: 3115 - DNA, 23 bp, Artificial Sequence
  HLA-A targeting gRNA
gcacgagtaccaggggccacggg

SEQ ID NO: 3116 - DNA, 23 bp, Artificial Sequence
  HLA-A targeting gRNA
gcacgcatgtggccattttgagg

SEQ ID NO: 3117 - DNA, 23 bp, Artificial Sequence
  HLA-A targeting gRNA
gcacgggtaccagggaccacggg

SEQ ID NO: 3118 - DNA, 23 bp, Artificial Sequence
  HLA-A targeting gRNA
gcactcacccgccctggtctggg

SEQ ID NO: 3119 - DNA, 23 bp, Artificial Sequence
  HLA-A targeting gRNA
gcactggtaccaggggccacggg

SEQ ID NO: 3120 - DNA, 23 bp, Artificial Sequence
  HLA-A targeting gRNA
aaggctgctgccggtgtcaaagg

SEQ ID NO: 3121 - DNA, 23 bp, Artificial Sequence
  HLA-A targeting gRNA
gcagagggaacagcgacttctgg

SEQ ID NO: 3122 - DNA, 23 bp, Artificial Sequence
  HLA-A targeting gRNA
gcagcacgcctacgacggcaagg

SEQ ID NO: 3123 - DNA, 23 bp, Artificial Sequence
  HLA-A targeting gRNA
aatggacaggacacccgggatgg

SEQ ID NO: 3124 - DNA, 23 bp, Artificial Sequence
  HLA-A targeting gRNA
aatgtgccctgtctcattactgg

SEQ ID NO: 3125 - DNA, 23 bp, Artificial Sequence
  HLA-A targeting gRNA
agcttgtaaaggtgagagcttgg

SEQ ID NO: 3126 - DNA, 23 bp, Artificial Sequence
  HLA-A targeting gRNA
aggctgctgccggtgtcaaaggg

SEQ ID NO: 3127 - DNA, 23 bp, Artificial Sequence
  HLA-A targeting gRNA
atggacaggacacccgggatggg

SEQ ID NO: 3128 - DNA, 23 bp, Artificial Sequence
  HLA-A targeting gRNA
atgtgccctgtctcattactggg

SEQ ID NO: 3129 - DNA, 23 bp, Artificial Sequence
  HLA-A targeting gRNA
caagactaggaggttcctctagg

SEQ ID NO: 3130 - DNA, 23 bp, Artificial Sequence
  HLA-A targeting gRNA
gcagcggagagtctacctggagg

SEQ ID NO: 3131 - DNA, 23 bp, Artificial Sequence
  HLA-A targeting gRNA
cgggaagagtcagaaaattcagg

SEQ ID NO: 3132 - DNA, 23 bp, Artificial Sequence
  HLA-A targeting gRNA
ctagaggaacctcctagtcttgg

SEQ ID NO: 3133 - DNA, 23 bp, Artificial Sequence
  HLA-A targeting gRNA
gcaggacgcctaagacggcaagg

SEQ ID NO: 3134 - DNA, 23 bp, Artificial Sequence
  HLA-A targeting gRNA
gcaggacgcctacgaaggcaagg

SEQ ID NO: 3135 - DNA, 23 bp, Artificial Sequence
  HLA-A targeting gRNA
ctccagtgatcacagctccaagg

SEQ ID NO: 3136 - DNA, 23 bp, Artificial Sequence
  HLA-A targeting gRNA
ctccttggagctgtgatcactgg

SEQ ID NO: 3137 - DNA, 23 bp, Artificial Sequence
  HLA-A targeting gRNA
ctctggggtccaagactaggagg

SEQ ID NO: 3138 - DNA, 23 bp, Artificial Sequence
  HLA-A targeting gRNA
gcaggaggagccggagtattggg

SEQ ID NO: 3139 - DNA, 23 bp, Artificial Sequence
  HLA-A targeting gRNA
ctgtgctctcttccccatcccgg

SEQ ID NO: 3140 - DNA, 23 bp, Artificial Sequence
  HLA-A targeting gRNA
cttctctggggtccaagactagg

SEQ ID NO: 3141 - DNA, 23 bp, Artificial Sequence
  HLA-A targeting gRNA
gcatgtggccatcttgagaatgg

SEQ ID NO: 3142 - DNA, 23 bp, Artificial Sequence
  HLA-A targeting gRNA
ggagacctttagcagggtcaggg

SEQ ID NO: 3143 - DNA, 23 bp, Artificial Sequence
  HLA-A targeting gRNA
gtgcttcccagtaatgagacagg

SEQ ID NO: 3144 - DNA, 23 bp, Artificial Sequence
  HLA-A targeting gRNA
gcaggtcgcctacgacggcaagg

SEQ ID NO: 3145 - DNA, 23 bp, Artificial Sequence
  HLA-A targeting gRNA
tatctctgctcctctccagaagg

SEQ ID NO: 3146 - DNA, 23 bp, Artificial Sequence
  HLA-A targeting gRNA
tgagaatggacaggacacccggg

SEQ ID NO: 3147 - DNA, 23 bp, Artificial Sequence
  HLA-A targeting gRNA
gcatctccttcccgttctccagg

SEQ ID NO: 3148 - DNA, 23 bp, Artificial Sequence
  HLA-A targeting gRNA
tgcttcccagtaatgagacaggg

SEQ ID NO: 3149 - DNA, 23 bp, Artificial Sequence
  HLA-A targeting gRNA
gcatgtggccattttgaggatgg

SEQ ID NO: 3150 - DNA, 23 bp, Artificial Sequence
  HLA-A targeting gRNA
tggacaggacacccgggatgggg

SEQ ID NO: 3151 - DNA, 23 bp, Artificial Sequence
  HLA-A targeting gRNA
tggagacctttagcagggtcagg

SEQ ID NO: 3152 - DNA, 23 bp, Artificial Sequence
  HLA-A targeting gRNA
tggccatcttgagaatggacagg

SEQ ID NO: 3153 - DNA, 23 bp, Artificial Sequence
  HLA-A targeting gRNA
gcatgtgtctgtgttggtgtagg

SEQ ID NO: 3154 - DNA, 23 bp, Artificial Sequence
  HLA-A targeting gRNA
tgtcctgtccattctcaagatgg

SEQ ID NO: 3155 - DNA, 23 bp, Artificial Sequence
  HLA-A targeting gRNA
gccagcaaggatgcccacgatgg

SEQ ID NO: 3156 - DNA, 23 bp, Artificial Sequence
  HLA-A targeting gRNA
gccagcaatgatgcccacaatgg

SEQ ID NO: 3157 - DNA, 23 bp, Artificial Sequence
  HLA-A targeting gRNA
tgtgctctcttccccatcccggg

SEQ ID NO: 3158 - DNA, 23 bp, Artificial Sequence
  HLA-A targeting gRNA
ttgacaccggcagcagccttggg

SEQ ID NO: 3159 - DNA, 23 bp, Artificial Sequence
  HLA-A targeting gRNA
ttgagaatggacaggacacccgg

SEQ ID NO: 3160 - DNA, 23 bp, Artificial Sequence
  HLA-A targeting gRNA
ttgtaaaggtgagagcttggagg

SEQ ID NO: 3161 - DNA, 23 bp, Artificial Sequence
  HLA-A targeting gRNA
tttgacaccggcagcagccttgg

SEQ ID NO: 3162 - DNA, 23 bp, Artificial Sequence
  HLA-A targeting gRNA
gtgtcttgggggggtctgacggg

SEQ ID NO: 3163 - DNA, 23 bp, Artificial Sequence
  HLA-A targeting gRNA
tgtgtcttgggggggtctgacgg

SEQ ID NO: 3164 - DNA, 23 bp, Artificial Sequence
  HLA-A targeting gRNA
atgtttcctgatcctgccctggg

SEQ ID NO: 3165 - DNA, 23 bp, Artificial Sequence
  HLA-A targeting gRNA
gccccgccccgacccacccgggg

SEQ ID NO: 3166 - DNA, 23 bp, Artificial Sequence
  HLA-A targeting gRNA
catgtttcctgatcctgccctgg

SEQ ID NO: 3167 - DNA, 23 bp, Artificial Sequence
  HLA-A targeting gRNA
gcccggccccgaccaaccagggg

SEQ ID NO: 3168 - DNA, 23 bp, Artificial Sequence
  HLA-A targeting gRNA
gcccgtccgtaggggatgagggg

SEQ ID NO: 3169 - DNA, 23 bp, Artificial Sequence
  HLA-A targeting gRNA
gcccgtccgtggggaatgagggg

SEQ ID NO: 3170 - DNA, 23 bp, Artificial Sequence
  HLA-A targeting gRNA
gcgcgatccgcaggttctctcgg

SEQ ID NO: 3171 - DNA, 23 bp, Artificial Sequence
  HLA-A targeting gRNA
gccctgacccagaccagggcggg

SEQ ID NO: 3172 - DNA, 23 bp, Artificial Sequence
  HLA-A targeting gRNA
cctctctggagacctttagcagg

SEQ ID NO: 3173 - DNA, 23 bp, Artificial Sequence
  HLA-A targeting gRNA
cctgctaaaggtctccagagagg

SEQ ID NO: 3174 - DNA, 23 bp, Artificial Sequence
  HLA-A targeting gRNA
ctctctggagacctttagcaggg

SEQ ID NO: 3175 - DNA, 23 bp, Artificial Sequence
  HLA-A targeting gRNA
gccggtttcattttcagtttagg

SEQ ID NO: 3176 - DNA, 23 bp, Artificial Sequence
  HLA-A targeting gRNA
gggtcatatgtgtcttggggggg

SEQ ID NO: 3177 - DNA, 23 bp, Artificial Sequence
  HLA-A targeting gRNA
ggtgggtcatatgtgtcttgggg

SEQ ID NO: 3178 - DNA, 23 bp, Artificial Sequence
  HLA-A targeting gRNA
gtgggtcatatgtgtcttggggg

SEQ ID NO: 3179 - DNA, 23 bp, Artificial Sequence
  HLA-A targeting gRNA
gtggtgggtcatatgtgtcttgg

SEQ ID NO: 3180 - DNA, 23 bp, Artificial Sequence
  HLA-A targeting gRNA
gcctgtgtccaggctggtctggg

SEQ ID NO: 3181 - DNA, 23 bp, Artificial Sequence
  HLA-A targeting gRNA
tgggtcatatgtgtcttgggggg

SEQ ID NO: 3182 - DNA, 23 bp, Artificial Sequence
  HLA-A targeting gRNA
tggtgggtcatatgtgtcttggg

SEQ ID NO: 3183 - DNA, 23 bp, Artificial Sequence
  HLA-A targeting gRNA
gcgacctggcccgtccgtagggg

SEQ ID NO: 3184 - DNA, 23 bp, Artificial Sequence
  HLA-A targeting gRNA
acagggcacatttctagctgggg

SEQ ID NO: 3185 - DNA, 23 bp, Artificial Sequence
  HLA-A targeting gRNA
acatttctggaaacttctctggg

SEQ ID NO: 3186 - DNA, 23 bp, Artificial Sequence
  HLA-A targeting gRNA
agacagggcacatttctagctgg

SEQ ID NO: 3187 - DNA, 23 bp, Artificial Sequence
  HLA-A targeting gRNA
agggaaagcaggagcctctctgg

SEQ ID NO: 3188 - DNA, 23 bp, Artificial Sequence
  HLA-A targeting gRNA
gcgatcagggaggcgccctgtgg

SEQ ID NO: 3189 - DNA, 23 bp, Artificial Sequence
  HLA-A targeting gRNA
agggaatagaagattatcccagg

SEQ ID NO: 3190 - DNA, 23 bp, Artificial Sequence
  HLA-A targeting gRNA
atgggggtgtcatgtctcttagg

SEQ ID NO: 3191 - DNA, 23 bp, Artificial Sequence
  HLA-A targeting gRNA
attgctggcctggttctccttgg

SEQ ID NO: 3192 - DNA, 23 bp, Artificial Sequence
  HLA-A targeting gRNA
cacatttctggaaacttctctgg

SEQ ID NO: 3193 - DNA, 23 bp, Artificial Sequence
  HLA-A targeting gRNA
gcgcccgcggctccatcctttgg

SEQ ID NO: 3194 - DNA, 23 bp, Artificial Sequence
  HLA-A targeting gRNA
gcgcccgcggctccatcttctgg

SEQ ID NO: 3195 - DNA, 23 bp, Artificial Sequence
  HLA-A targeting gRNA
catttctggaaacttctctgggg

SEQ ID NO: 3196 - DNA, 23 bp, Artificial Sequence
  HLA-A targeting gRNA
gacagggcacatttctagctggg

SEQ ID NO: 3197 - DNA, 23 bp, Artificial Sequence
  HLA-A targeting gRNA
gcacatttctagctggggcttgg

SEQ ID NO: 3198 - DNA, 23 bp, Artificial Sequence
  HLA-A targeting gRNA
tcacagctccaaggagaaccagg

SEQ ID NO: 3199 - DNA, 23 bp, Artificial Sequence
  HLA-A targeting gRNA
tcatgtctcttagggaaagcagg

SEQ ID NO: 3200 - DNA, 23 bp, Artificial Sequence
  HLA-A targeting gRNA
tgggggtgtcatgtctcttaggg

SEQ ID NO: 3201 - DNA, 23 bp, Artificial Sequence
  HLA-A targeting gRNA
gcgcgatccgcagtttctctcgg

SEQ ID NO: 3202 - DNA, 23 bp, Artificial Sequence
  HLA-A targeting gRNA
gcgcgggtaccaggggccacagg

SEQ ID NO: 3203 - DNA, 23 bp, Artificial Sequence
  HLA-A targeting gRNA
gcggagtctcccacttgcgctgg

SEQ ID NO: 3204 - DNA, 23 bp, Artificial Sequence
  HLA-A targeting gRNA
cgcctctgcggggagaagcaagg

SEQ ID NO: 3205 - DNA, 23 bp, Artificial Sequence
  HLA-A targeting gRNA
gcggagttggggaatctccaagg

SEQ ID NO: 3206 - DNA, 23 bp, Artificial Sequence
  HLA-A targeting gRNA
cttgcttctccccgcagaggcgg

SEQ ID NO: 3207 - DNA, 23 bp, Artificial Sequence
  HLA-A targeting gRNA
gcggctgtggtggtaccttctgg

SEQ ID NO: 3208 - DNA, 23 bp, Artificial Sequence
  HLA-A targeting gRNA
gcgtcctgggggggtctgtcagg

SEQ ID NO: 3209 - DNA, 23 bp, Artificial Sequence
  HLA-A targeting gRNA
gcgtctccttaccgttctccagg

SEQ ID NO: 3210 - DNA, 23 bp, Artificial Sequence
  HLA-A targeting gRNA
gcgtctccttcccgttcttcagg

SEQ ID NO: 3211 - DNA, 23 bp, Artificial Sequence
  HLA-A targeting gRNA
agagtagcaggaggagggttcgg

SEQ ID NO: 3212 - DNA, 23 bp, Artificial Sequence
  HLA-A targeting gRNA
gcgtttccttcccgttctccagg

SEQ ID NO: 3213 - DNA, 23 bp, Artificial Sequence
  HLA-A targeting gRNA
gcgttttgggggcgtctctcagg

SEQ ID NO: 3214 - DNA, 23 bp, Artificial Sequence
  HLA-A targeting gRNA
agtagcaggaggagggttcgggg

SEQ ID NO: 3215 - DNA, 23 bp, Artificial Sequence
  HLA-A targeting gRNA
gagtagcaggaggagggttcggg

SEQ ID NO: 3216 - DNA, 23 bp, Artificial Sequence
  HLA-A targeting gRNA
agagccccgcttcatcgcagtgg

SEQ ID NO: 3217 - DNA, 23 bp, Artificial Sequence
  HLA-A targeting gRNA
gctatggggtttctttgcgttgg

SEQ ID NO: 3218 - DNA, 23 bp, Artificial Sequence
  HLA-A targeting gRNA
gctccctccttttctaactgtgg

SEQ ID NO: 3219 - DNA, 23 bp, Artificial Sequence
  HLA-A targeting gRNA
gctcctttctggtagctcacagg

SEQ ID NO: 3220 - DNA, 23 bp, Artificial Sequence
  HLA-A targeting gRNA
gctcttcttcctccacatcacgg

SEQ ID NO: 3221 - DNA, 23 bp, Artificial Sequence
  HLA-A targeting gRNA
gctgcagcgcacaggtaccaggg

SEQ ID NO: 3222 - DNA, 23 bp, Artificial Sequence
  HLA-A targeting gRNA
gctgcagcgcacgagtaccaggg

SEQ ID NO: 3223 - DNA, 23 bp, Artificial Sequence
  HLA-A targeting gRNA
gctgcagcgcactggtaccaggg

SEQ ID NO: 3224 - DNA, 23 bp, Artificial Sequence
  HLA-A targeting gRNA
gctgccacgtggggtcggacggg

SEQ ID NO: 3225 - DNA, 23 bp, Artificial Sequence
  HLA-A targeting gRNA
gctgggcggggctcgggggctgg

SEQ ID NO: 3226 - DNA, 23 bp, Artificial Sequence
  HLA-A targeting gRNA
gctgggctgaccgcggggtcggg

SEQ ID NO: 3227 - DNA, 23 bp, Artificial Sequence
  HLA-A targeting gRNA
gctgggtgggcccatgattgtgg

SEQ ID NO: 3228 - DNA, 23 bp, Artificial Sequence
  HLA-A targeting gRNA
gcttcacactcaatatgtgtggg

SEQ ID NO: 3229 - DNA, 23 bp, Artificial Sequence
  HLA-A targeting gRNA
ggaaacttctctggggtccaagg

SEQ ID NO: 3230 - DNA, 23 bp, Artificial Sequence
  HLA-A targeting gRNA
ggaaccccgcttcatcgccgtgg

SEQ ID NO: 3231 - DNA, 23 bp, Artificial Sequence
  HLA-A targeting gRNA
ggaagcaccacccacaatcatgg

SEQ ID NO: 3232 - DNA, 23 bp, Artificial Sequence
  HLA-A targeting gRNA
ggaaggagacgctgcagcgaagg

SEQ ID NO: 3233 - DNA, 23 bp, Artificial Sequence
  HLA-A targeting gRNA
tggcccgtccgtgggggatgagg

SEQ ID NO: 3234 - DNA, 23 bp, Artificial Sequence
  HLA-A targeting gRNA
ggaccaggagactgaccgagtgg

SEQ ID NO: 3235 - DNA, 23 bp, Artificial Sequence
  HLA-A targeting gRNA
ggaccctcagagtcactctctgg

SEQ ID NO: 3236 - DNA, 23 bp, Artificial Sequence
  HLA-A targeting gRNA
cggggcggggctcgggggactgg

SEQ ID NO: 3237 - DNA, 23 bp, Artificial Sequence
  HLA-A targeting gRNA
ggacctgcgctcttagaccgcgg

SEQ ID NO: 3238 - DNA, 23 bp, Artificial Sequence
  HLA-A targeting gRNA
ggggcggggctcgggggactggg

SEQ ID NO: 3239 - DNA, 23 bp, Artificial Sequence
  HLA-A targeting gRNA
ggactccgagacccttgccccgg

SEQ ID NO: 3240 - DNA, 23 bp, Artificial Sequence
  HLA-A targeting gRNA
ggactccgagacccttgtcccgg

SEQ ID NO: 3241 - DNA, 23 bp, Artificial Sequence
  HLA-A targeting gRNA
ggagaaatacctcatggattggg

SEQ ID NO: 3242 - DNA, 23 bp, Artificial Sequence
  HLA-A targeting gRNA
tcacgacccctcatcccccacgg

SEQ ID NO: 3243 - DNA, 23 bp, Artificial Sequence
  HLA-A targeting gRNA
ggagactgaccgagtggacctgg

SEQ ID NO: 3244 - DNA, 23 bp, Artificial Sequence
  HLA-A targeting gRNA
ggagagcctacctggagggccgg

SEQ ID NO: 3245 - DNA, 23 bp, Artificial Sequence
  HLA-A targeting gRNA
ggagagtctacctggagggccgg

SEQ ID NO: 3246 - DNA, 23 bp, Artificial Sequence
  HLA-A targeting gRNA
ggagatgtagaaatacctcatgg

SEQ ID NO: 3247 - DNA, 23 bp, Artificial Sequence
  HLA-A targeting gRNA
ggagcagcggagagtctacctgg

SEQ ID NO: 3248 - DNA, 23 bp, Artificial Sequence
  HLA-A targeting gRNA
ggagccccgcggcttcggggtgg

SEQ ID NO: 3249 - DNA, 23 bp, Artificial Sequence
  HLA-A targeting gRNA
ggagccccgcttcatcgctgtgg

SEQ ID NO: 3250 - DNA, 23 bp, Artificial Sequence
  HLA-A targeting gRNA
ggagccctgcttcatcgccgtgg

SEQ ID NO: 3251 - DNA, 23 bp, Artificial Sequence
  HLA-A targeting gRNA
ggagccggagtattgggacgagg

SEQ ID NO: 3252 - DNA, 23 bp, Artificial Sequence
  HLA-A targeting gRNA
ggagcctgggggcgaggagtggg

SEQ ID NO: 3253 - DNA, 23 bp, Artificial Sequence
  HLA-A targeting gRNA
ggaggactagacccaggacacgg

SEQ ID NO: 3254 - DNA, 23 bp, Artificial Sequence
  HLA-A targeting gRNA
ggagggcgatattatagtgttgg

SEQ ID NO: 3255 - DNA, 23 bp, Artificial Sequence
  HLA-A targeting gRNA
ggagtaggagcctgggggcgagg

SEQ ID NO: 3256 - DNA, 23 bp, Artificial Sequence
  HLA-A targeting gRNA
ggagtcccgcggcttcggggcgg

SEQ ID NO: 3257 - DNA, 23 bp, Artificial Sequence
  HLA-A targeting gRNA
ggagtcccgcggcttcggggtgg

SEQ ID NO: 3258 - DNA, 23 bp, Artificial Sequence
  HLA-A targeting gRNA
cacgcactcgccctccaggtagg

SEQ ID NO: 3259 - DNA, 23 bp, Artificial Sequence
  HLA-A targeting gRNA
ctacctggagggcgagtgcgtgg

SEQ ID NO: 3260 - DNA, 23 bp, Artificial Sequence
  HLA-A targeting gRNA
ggatagggaggaccagacccagg

SEQ ID NO: 3261 - DNA, 23 bp, Artificial Sequence
  HLA-A targeting gRNA
ggatgggaccttccagaagtggg

SEQ ID NO: 3262 - DNA, 23 bp, Artificial Sequence
  HLA-A targeting gRNA
ggatggggaggactagacccagg

SEQ ID NO: 3263 - DNA, 23 bp, Artificial Sequence
  HLA-A targeting gRNA
ggatgtatggttgcgacgtgggg

SEQ ID NO: 3264 - DNA, 23 bp, Artificial Sequence
  HLA-A targeting gRNA
ggatgtattgagcatgcaatggg

SEQ ID NO: 3265 - DNA, 23 bp, Artificial Sequence
  HLA-A targeting gRNA
ggattgggagcctggggacgagg

SEQ ID NO: 3266 - DNA, 23 bp, Artificial Sequence
  HLA-A targeting gRNA
ggccaaaaatccccccgggtggg

SEQ ID NO: 3267 - DNA, 23 bp, Artificial Sequence
  HLA-A targeting gRNA
ggccagccccggagatctacagg

SEQ ID NO: 3268 - DNA, 23 bp, Artificial Sequence
  HLA-A targeting gRNA
ggcccgtccgtaggggatgaggg

SEQ ID NO: 3269 - DNA, 23 bp, Artificial Sequence
  HLA-A targeting gRNA
ggcccgtccgtggggaatgaggg

SEQ ID NO: 3270 - DNA, 23 bp, Artificial Sequence
  HLA-A targeting gRNA
ggccctgacccagaccagggcgg

SEQ ID NO: 3271 - DNA, 23 bp, Artificial Sequence
  HLA-A targeting gRNA
ggccctgagcttctaccctgtgg

SEQ ID NO: 3272 - DNA, 23 bp, Artificial Sequence
  HLA-A targeting gRNA
ggccgcctcccacttgcgctcgg

SEQ ID NO: 3273 - DNA, 23 bp, Artificial Sequence
  HLA-A targeting gRNA
ggcgacctggcccgtccgtaggg

SEQ ID NO: 3274 - DNA, 23 bp, Artificial Sequence
  HLA-A targeting gRNA
ggcgccatgatggccatcctcgg

SEQ ID NO: 3275 - DNA, 23 bp, Artificial Sequence
  HLA-A targeting gRNA
ggcggcatgacggccatcctcgg

SEQ ID NO: 3276 - DNA, 23 bp, Artificial Sequence
  HLA-A targeting gRNA
ggctccgagacccttgtcccggg

SEQ ID NO: 3277 - DNA, 23 bp, Artificial Sequence
  HLA-A targeting gRNA
ggctcctcctgctctatccacgg

SEQ ID NO: 3278 - DNA, 23 bp, Artificial Sequence
  HLA-A targeting gRNA
ggctgccacgtggggtcggacgg

SEQ ID NO: 3279 - DNA, 23 bp, Artificial Sequence
  HLA-A targeting gRNA
ggctggcctcccacaagaaaggg

SEQ ID NO: 3280 - DNA, 23 bp, Artificial Sequence
  HLA-A targeting gRNA
ggctgggctgaccgcggggtcgg

SEQ ID NO: 3281 - DNA, 23 bp, Artificial Sequence
  HLA-A targeting gRNA
gggagactccgcccatgaggcgg

SEQ ID NO: 3282 - DNA, 23 bp, Artificial Sequence
  HLA-A targeting gRNA
gggagctgggcggggctcggggg

SEQ ID NO: 3283 - DNA, 23 bp, Artificial Sequence
  HLA-A targeting gRNA
gggaggcgccccgtggtccctgg

SEQ ID NO: 3284 - DNA, 23 bp, Artificial Sequence
  HLA-A targeting gRNA
gggaggcgccctgtggcccctgg

SEQ ID NO: 3285 - DNA, 23 bp, Artificial Sequence
  HLA-A targeting gRNA
gggatgggaccttccagaagtgg

SEQ ID NO: 3286 - DNA, 23 bp, Artificial Sequence
  HLA-A targeting gRNA
gggcctgagaggaaaagtcacgg

SEQ ID NO: 3287 - DNA, 23 bp, Artificial Sequence
  HLA-A targeting gRNA
gggcgacctggcccgtccgtagg

SEQ ID NO: 3288 - DNA, 23 bp, Artificial Sequence
  HLA-A targeting gRNA
gggcggggctcgggggagctggg

SEQ ID NO: 3289 - DNA, 23 bp, Artificial Sequence
  HLA-A targeting gRNA
gggctccgagacccttgtcccgg

SEQ ID NO: 3290 - DNA, 23 bp, Artificial Sequence
  HLA-A targeting gRNA
gggctcgggggagctgggcgggg

SEQ ID NO: 3291 - DNA, 23 bp, Artificial Sequence
  HLA-A targeting gRNA
gggctggcctcccacaagaaagg

SEQ ID NO: 3292 - DNA, 23 bp, Artificial Sequence
  HLA-A targeting gRNA
ggggagctgggcggggctcgggg

SEQ ID NO: 3293 - DNA, 23 bp, Artificial Sequence
  HLA-A targeting gRNA
ggggccggagtattgggacgggg

SEQ ID NO: 3294 - DNA, 23 bp, Artificial Sequence
  HLA-A targeting gRNA
acccctcatcccccacggacggg

SEQ ID NO: 3295 - DNA, 23 bp, Artificial Sequence
  HLA-A targeting gRNA
ggggctcgggggagctgggcggg

SEQ ID NO: 3296 - DNA, 23 bp, Artificial Sequence
  HLA-A targeting gRNA
gacccctcatcccccacggacgg

SEQ ID NO: 3297 - DNA, 23 bp, Artificial Sequence
  HLA-A targeting gRNA
gcccgtccgtgggggatgagggg

SEQ ID NO: 3298 - DNA, 23 bp, Artificial Sequence
  HLA-A targeting gRNA
ggcccgtccgtgggggatgaggg

SEQ ID NO: 3299 - DNA, 23 bp, Artificial Sequence
  HLA-A targeting gRNA
gggggagctgggcggggctcggg

SEQ ID NO: 3300 - DNA, 23 bp, Artificial Sequence
  HLA-A targeting gRNA
ccagggcccccgagagtagcagg

SEQ ID NO: 3301 - DNA, 23 bp, Artificial Sequence
  HLA-A targeting gRNA
cctgctactctcgggggccctgg

SEQ ID NO: 3302 - DNA, 23 bp, Artificial Sequence
  HLA-A targeting gRNA
ggggtcctgacctgcgccaccgg

SEQ ID NO: 3303 - DNA, 23 bp, Artificial Sequence
  HLA-A targeting gRNA
ggggttccccgcggccgggccgg

SEQ ID NO: 3304 - DNA, 23 bp, Artificial Sequence
  HLA-A targeting gRNA
gggtgggtcggggcggggcgggg

SEQ ID NO: 3305 - DNA, 23 bp, Artificial Sequence
  HLA-A targeting gRNA
gggttccccgcggccgggccggg

SEQ ID NO: 3306 - DNA, 23 bp, Artificial Sequence
  HLA-A targeting gRNA
ggtacagaatctggaaacccagg

SEQ ID NO: 3307 - DNA, 23 bp, Artificial Sequence
  HLA-A targeting gRNA
ggtcatatgtgtcttgggggggg

SEQ ID NO: 3308 - DNA, 23 bp, Artificial Sequence
  HLA-A targeting gRNA
ggtccactcggtcagtctcctgg

SEQ ID NO: 3309 - DNA, 23 bp, Artificial Sequence
  HLA-A targeting gRNA
ggtccatgcggcgggagcagcgg

SEQ ID NO: 3310 - DNA, 23 bp, Artificial Sequence
  HLA-A targeting gRNA
ggtcccatcccctgcaggcctgg

SEQ ID NO: 3311 - DNA, 23 bp, Artificial Sequence
  HLA-A targeting gRNA
ggtccctgacgacagacctcagg

SEQ ID NO: 3312 - DNA, 23 bp, Artificial Sequence
  HLA-A targeting gRNA
ggtccttgggatattgtggttgg

SEQ ID NO: 3313 - DNA, 23 bp, Artificial Sequence
  HLA-A targeting gRNA
gagccccgcttcatcgccgtggg

SEQ ID NO: 3314 - DNA, 23 bp, Artificial Sequence
  HLA-A targeting gRNA
ggagccccgcttcatcgccgtgg

SEQ ID NO: 3315 - DNA, 23 bp, Artificial Sequence
  HLA-A targeting gRNA
ggtctgcattcacacatttctgg

SEQ ID NO: 3316 - DNA, 23 bp, Artificial Sequence
  HLA-A targeting gRNA
cgtagcccacggcgatgaagcgg

SEQ ID NO: 3317 - DNA, 23 bp, Artificial Sequence
  HLA-A targeting gRNA
ggtgagtcatatgcgtcctgggg

SEQ ID NO: 3318 - DNA, 23 bp, Artificial Sequence
  HLA-A targeting gRNA
gtagcccacggcgatgaagcggg

SEQ ID NO: 3319 - DNA, 23 bp, Artificial Sequence
  HLA-A targeting gRNA
ggtgagtcatatgtgtcttgggg

SEQ ID NO: 3320 - DNA, 23 bp, Artificial Sequence
  HLA-A targeting gRNA
ggtggacatgggggtggggtggg

SEQ ID NO: 3321 - DNA, 23 bp, Artificial Sequence
  HLA-A targeting gRNA
tagcccacggcgatgaagcgggg

SEQ ID NO: 3322 - DNA, 23 bp, Artificial Sequence
  HLA-A targeting gRNA
cttcatcgccgtgggctacgtgg

SEQ ID NO: 3323 - DNA, 23 bp, Artificial Sequence
  HLA-A targeting gRNA
ggtgggcccatgattgtgggtgg

SEQ ID NO: 3324 - DNA, 23 bp, Artificial Sequence
  HLA-A targeting gRNA
ggtggtcatatgtgtcttggggg

SEQ ID NO: 3325 - DNA, 23 bp, Artificial Sequence
  HLA-A targeting gRNA
ggtggtggtcatatgtgtcttgg

SEQ ID NO: 3326 - DNA, 23 bp, Artificial Sequence
  HLA-A targeting gRNA
ggttccatcccctgcaggcttgg

SEQ ID NO: 3327 - DNA, 23 bp, Artificial Sequence
  HLA-A targeting gRNA
ggttgcgacgtggggccggacgg

SEQ ID NO: 3328 - DNA, 23 bp, Artificial Sequence
  HLA-A targeting gRNA
gtagaaatacctcatggagtagg

SEQ ID NO: 3329 - DNA, 23 bp, Artificial Sequence
  HLA-A targeting gRNA
gtagcccacagcgatgaagcggg

SEQ ID NO: 3330 - DNA, 23 bp, Artificial Sequence
  HLA-A targeting gRNA
gtagcccacggcgatgaagcagg

SEQ ID NO: 3331 - DNA, 23 bp, Artificial Sequence
  HLA-A targeting gRNA
gtatggctgccacgtggggtcgg

SEQ ID NO: 3332 - DNA, 23 bp, Artificial Sequence
  HLA-A targeting gRNA
gtatggttgcgacgtggggccgg

SEQ ID NO: 3333 - DNA, 23 bp, Artificial Sequence
  HLA-A targeting gRNA
gtcagatcccacagaacatgtgg

SEQ ID NO: 3334 - DNA, 23 bp, Artificial Sequence
  HLA-A targeting gRNA
gtcccatgacagatgcaaaatgg

SEQ ID NO: 3335 - DNA, 23 bp, Artificial Sequence
  HLA-A targeting gRNA
gtcctccccatcccgctgtcagg

SEQ ID NO: 3336 - DNA, 23 bp, Artificial Sequence
  HLA-A targeting gRNA
gtcctccctatcccgctgccagg

SEQ ID NO: 3337 - DNA, 23 bp, Artificial Sequence
  HLA-A targeting gRNA
gtccttgggatattgtggttggg

SEQ ID NO: 3338 - DNA, 23 bp, Artificial Sequence
  HLA-A targeting gRNA
gtctcggagccccgcggcttcgg

SEQ ID NO: 3339 - DNA, 23 bp, Artificial Sequence
  HLA-A targeting gRNA
gtctcggagtcccgcggcttcgg

SEQ ID NO: 3340 - DNA, 23 bp, Artificial Sequence
  HLA-A targeting gRNA
ccaggtctgggtcagggccaggg

SEQ ID NO: 3341 - DNA, 23 bp, Artificial Sequence
  HLA-A targeting gRNA
cccaggtctgggtcagggccagg

SEQ ID NO: 3342 - DNA, 23 bp, Artificial Sequence
  HLA-A targeting gRNA
ccctggccctgacccagacctgg

SEQ ID NO: 3343 - DNA, 23 bp, Artificial Sequence
  HLA-A targeting gRNA
cctggccctgacccagacctggg

SEQ ID NO: 3344 - DNA, 23 bp, Artificial Sequence
  HLA-A targeting gRNA
gtgaccccggccggtggcgcagg

SEQ ID NO: 3345 - DNA, 23 bp, Artificial Sequence
  HLA-A targeting gRNA
gtgacctgcgcccccggccgggg

SEQ ID NO: 3346 - DNA, 23 bp, Artificial Sequence
  HLA-A targeting gRNA
gtgagtcatatgcgtcctggggg

SEQ ID NO: 3347 - DNA, 23 bp, Artificial Sequence
  HLA-A targeting gRNA
gtgagtcatatgtgtcttggggg

SEQ ID NO: 3348 - DNA, 23 bp, Artificial Sequence
  HLA-A targeting gRNA
gtgcttcccaggaatgagacagg

SEQ ID NO: 3349 - DNA, 23 bp, Artificial Sequence
  HLA-A targeting gRNA
gtcactcaccgtcctcgctctgg

SEQ ID NO: 3350 - DNA, 23 bp, Artificial Sequence
  HLA-A targeting gRNA
acggtgagtgaccccggcccggg

SEQ ID NO: 3351 - DNA, 23 bp, Artificial Sequence
  HLA-A targeting gRNA
gacggtgagtgaccccggcccgg

SEQ ID NO: 3352 - DNA, 23 bp, Artificial Sequence
  HLA-A targeting gRNA
gtggacctggggaccctgcacgg

SEQ ID NO: 3353 - DNA, 23 bp, Artificial Sequence
  HLA-A targeting gRNA
tactacaaccagagcgaggacgg

SEQ ID NO: 3354 - DNA, 23 bp, Artificial Sequence
  HLA-A targeting gRNA
gtggatagagcaggaggagccgg

SEQ ID NO: 3355 - DNA, 23 bp, Artificial Sequence
  HLA-A targeting gRNA
gcgaggacggtgagtgaccccgg

SEQ ID NO: 3356 - DNA, 23 bp, Artificial Sequence
  HLA-A targeting gRNA
gtgttccggtcccaatactccgg

SEQ ID NO: 3357 - DNA, 23 bp, Artificial Sequence
  HLA-A targeting gRNA
gtgggaggcggcccatgaggcgg

SEQ ID NO: 3358 - DNA, 23 bp, Artificial Sequence
  HLA-A targeting gRNA
gtgggaggcggcccgtgtggagg

SEQ ID NO: 3359 - DNA, 23 bp, Artificial Sequence
  HLA-A targeting gRNA
gtgggctgggaagatggctctgg

SEQ ID NO: 3360 - DNA, 23 bp, Artificial Sequence
  HLA-A targeting gRNA
gtgggaggcggcccgttgggcgg

SEQ ID NO: 3361 - DNA, 23 bp, Artificial Sequence
  HLA-A targeting gRNA
gtgggaggcggtccatgcggcgg

SEQ ID NO: 3362 - DNA, 23 bp, Artificial Sequence
  HLA-A targeting gRNA
tgggctgggaagatggctctggg

SEQ ID NO: 3363 - DNA, 23 bp, Artificial Sequence
  HLA-A targeting gRNA
gtggtcatatgtgtcttgggggg

SEQ ID NO: 3364 - DNA, 23 bp, Artificial Sequence
  HLA-A targeting gRNA
gtggtgagtcatatgcgtcctgg

SEQ ID NO: 3365 - DNA, 23 bp, Artificial Sequence
  HLA-A targeting gRNA
gtggtgagtcatatgtgtcttgg

SEQ ID NO: 3366 - DNA, 23 bp, Artificial Sequence
  HLA-A targeting gRNA
gtggtggtcatatgtgtcttggg

SEQ ID NO: 3367 - DNA, 23 bp, Artificial Sequence
  HLA-A targeting gRNA
gtgtcttgggggcgtctgtcagg

SEQ ID NO: 3368 - DNA, 23 bp, Artificial Sequence
  HLA-A targeting gRNA
gtgtcttggggggggtctgacgg

SEQ ID NO: 3369 - DNA, 23 bp, Artificial Sequence
  HLA-A targeting gRNA
gttgcgacgtggggccggacggg

SEQ ID NO: 3370 - DNA, 23 bp, Artificial Sequence
  HLA-A targeting gRNA
gttggggaatctccaaggctggg

SEQ ID NO: 3371 - DNA, 23 bp, Artificial Sequence
  HLA-A targeting gRNA
gttggtgtaggcataatgtgagg

SEQ ID NO: 3372 - DNA, 23 bp, Artificial Sequence
  HLA-A targeting gRNA
gtttaggccaaaaatccccctgg

SEQ ID NO: 3373 - DNA, 23 bp, Artificial Sequence
  HLA-A targeting gRNA
gtttccagagagtgactctgagg

SEQ ID NO: 3374 - DNA, 23 bp, Artificial Sequence
  HLA-A targeting gRNA
taaagcacctgttacaatgaagg

SEQ ID NO: 3375 - DNA, 23 bp, Artificial Sequence
  HLA-A targeting gRNA
taaggagacgctgcagcgcacgg

SEQ ID NO: 3376 - DNA, 23 bp, Artificial Sequence
  HLA-A targeting gRNA
taagggataaaaatctctgaagg

SEQ ID NO: 3377 - DNA, 23 bp, Artificial Sequence
  HLA-A targeting gRNA
taatcttctattccctgacgagg

SEQ ID NO: 3378 - DNA, 23 bp, Artificial Sequence
  HLA-A targeting gRNA
taatcttctattccctgcagagg

SEQ ID NO: 3379 - DNA, 23 bp, Artificial Sequence
  HLA-A targeting gRNA
tacatctccgtgtcccggcccgg

SEQ ID NO: 3380 - DNA, 23 bp, Artificial Sequence
  HLA-A targeting gRNA
taccagcaggacgcttacgacgg

SEQ ID NO: 3381 - DNA, 23 bp, Artificial Sequence
  HLA-A targeting gRNA
taccggcagcacgcctacgacgg

SEQ ID NO: 3382 - DNA, 23 bp, Artificial Sequence
  HLA-A targeting gRNA
taccggcaggacgcctaagacgg

SEQ ID NO: 3383 - DNA, 23 bp, Artificial Sequence
  HLA-A targeting gRNA
taccggcaggacgcctacgaagg

SEQ ID NO: 3384 - DNA, 23 bp, Artificial Sequence
  HLA-A targeting gRNA
taccggcaggtcgcctacgacgg

SEQ ID NO: 3385 - DNA, 23 bp, Artificial Sequence
  HLA-A targeting gRNA
taccgttctccaggtatctgcgg

SEQ ID NO: 3386 - DNA, 23 bp, Artificial Sequence
  HLA-A targeting gRNA
tacctcatggagtaggagcctgg

SEQ ID NO: 3387 - DNA, 23 bp, Artificial Sequence
  HLA-A targeting gRNA
tacctcatggattgggagcctgg

SEQ ID NO: 3388 - DNA, 23 bp, Artificial Sequence
  HLA-A targeting gRNA
tactacaacgagagcgaggccgg

SEQ ID NO: 3389 - DNA, 23 bp, Artificial Sequence
  HLA-A targeting gRNA
tagcccacagcgatgaagcgggg

SEQ ID NO: 3390 - DNA, 23 bp, Artificial Sequence
  HLA-A targeting gRNA
tagcccacggcgatgaagcaggg

SEQ ID NO: 3391 - DNA, 23 bp, Artificial Sequence
  HLA-A targeting gRNA
taggcataatgtgaggagatagg

SEQ ID NO: 3392 - DNA, 23 bp, Artificial Sequence
  HLA-A targeting gRNA
tatctcttctcctttccagaagg

SEQ ID NO: 3393 - DNA, 23 bp, Artificial Sequence
  HLA-A targeting gRNA
tattgtggttgggagcccatggg

SEQ ID NO: 3394 - DNA, 23 bp, Artificial Sequence
  HLA-A targeting gRNA
tcaccctccctctgctcctgagg

SEQ ID NO: 3395 - DNA, 23 bp, Artificial Sequence
  HLA-A targeting gRNA
tcacgacccctcatcccctacgg

SEQ ID NO: 3396 - DNA, 23 bp, Artificial Sequence
  HLA-A targeting gRNA
tcacgacccctcattccccacgg

SEQ ID NO: 3397 - DNA, 23 bp, Artificial Sequence
  HLA-A targeting gRNA
gggatggtgggctgggaagatgg

SEQ ID NO: 3398 - DNA, 23 bp, Artificial Sequence
  HLA-A targeting gRNA
tcactctctggaaacccaggagg

SEQ ID NO: 3399 - DNA, 23 bp, Artificial Sequence
  HLA-A targeting gRNA
tcactctctggtacagaatctgg

SEQ ID NO: 3400 - DNA, 23 bp, Artificial Sequence
  HLA-A targeting gRNA
tcagatcaccaagcacaagtggg

SEQ ID NO: 3401 - DNA, 23 bp, Artificial Sequence
  HLA-A targeting gRNA
tcagatcaccgagcgcaagtggg

SEQ ID NO: 3402 - DNA, 23 bp, Artificial Sequence
  HLA-A targeting gRNA
tcatcccctacggacgggccagg

SEQ ID NO: 3403 - DNA, 23 bp, Artificial Sequence
  HLA-A targeting gRNA
tcattccccacggacgggccggg

SEQ ID NO: 3404 - DNA, 23 bp, Artificial Sequence
  HLA-A targeting gRNA
tccccccgggtgggtcggggcgg

SEQ ID NO: 3405 - DNA, 23 bp, Artificial Sequence
  HLA-A targeting gRNA
gagcccctcaccctgagatgggg

SEQ ID NO: 3406 - DNA, 23 bp, Artificial Sequence
  HLA-A targeting gRNA
tccccctggttggtcggggccgg

SEQ ID NO: 3407 - DNA, 23 bp, Artificial Sequence
  HLA-A targeting gRNA
tcccgttcttcaggtatctgcgg

SEQ ID NO: 3408 - DNA, 23 bp, Artificial Sequence
  HLA-A targeting gRNA
tccctccttaacccatctcaggg

SEQ ID NO: 3409 - DNA, 23 bp, Artificial Sequence
  HLA-A targeting gRNA
tccctccttatcccatctcaggg

SEQ ID NO: 3410 - DNA, 23 bp, Artificial Sequence
  HLA-A targeting gRNA
tccctctgctcctgagggagagg

SEQ ID NO: 3411 - DNA, 23 bp, Artificial Sequence
  HLA-A targeting gRNA
tccgcagatacctgaagaacggg

SEQ ID NO: 3412 - DNA, 23 bp, Artificial Sequence
  HLA-A targeting gRNA
tcctctagccacatgttctgtgg

SEQ ID NO: 3413 - DNA, 23 bp, Artificial Sequence
  HLA-A targeting gRNA
tcctctccctcaggagcagaggg

SEQ ID NO: 3414 - DNA, 23 bp, Artificial Sequence
  HLA-A targeting gRNA
tcctgacctgcgccaccggccgg

SEQ ID NO: 3415 - DNA, 23 bp, Artificial Sequence
  HLA-A targeting gRNA
tcgccctccctctggtcttgagg

SEQ ID NO: 3416 - DNA, 23 bp, Artificial Sequence
  HLA-A targeting gRNA
tcgctcggtcagtctgtgagtgg

SEQ ID NO: 3417 - DNA, 23 bp, Artificial Sequence
  HLA-A targeting gRNA
tcgctcggttagtctgtgagtgg

SEQ ID NO: 3418 - DNA, 23 bp, Artificial Sequence
  HLA-A targeting gRNA
tcgggccactcctcgcccccagg

SEQ ID NO: 3419 - DNA, 23 bp, Artificial Sequence
  HLA-A targeting gRNA
tcgggggctgggctgaccgcggg

SEQ ID NO: 3420 - DNA, 23 bp, Artificial Sequence
  HLA-A targeting gRNA
tcgtgacctgcgcccccggccgg

SEQ ID NO: 3421 - DNA, 23 bp, Artificial Sequence
  HLA-A targeting gRNA
tcgtggaggccaggcctgcaggg

SEQ ID NO: 3422 - DNA, 23 bp, Artificial Sequence
  HLA-A targeting gRNA
tcgtgtcccggcccggccgcggg

SEQ ID NO: 3423 - DNA, 23 bp, Artificial Sequence
  HLA-A targeting gRNA
tctcaactgctccgcccaacggg

SEQ ID NO: 3424 - DNA, 23 bp, Artificial Sequence
  HLA-A targeting gRNA
tctcaactgctcctccacacggg

SEQ ID NO: 3425 - DNA, 23 bp, Artificial Sequence
  HLA-A targeting gRNA
tctcaactgctctgccacacggg

SEQ ID NO: 3426 - DNA, 23 bp, Artificial Sequence
  HLA-A targeting gRNA
tctcactccaattgggtgtcggg

SEQ ID NO: 3427 - DNA, 23 bp, Artificial Sequence
  HLA-A targeting gRNA
tctcactcctattgggtgtcggg

SEQ ID NO: 3428 - DNA, 23 bp, Artificial Sequence
  HLA-A targeting gRNA
tctcagccactgctcgccccagg

SEQ ID NO: 3429 - DNA, 23 bp, Artificial Sequence
  HLA-A targeting gRNA
tctcagctgctccgccacatggg

SEQ ID NO: 3430 - DNA, 23 bp, Artificial Sequence
  HLA-A targeting gRNA
tctcagctgctccgcccgacggg

SEQ ID NO: 3431 - DNA, 23 bp, Artificial Sequence
  HLA-A targeting gRNA
tctccacagggtagaagctcagg

SEQ ID NO: 3432 - DNA, 23 bp, Artificial Sequence
  HLA-A targeting gRNA
tctccctcaagaccagagggagg

SEQ ID NO: 3433 - DNA, 23 bp, Artificial Sequence
  HLA-A targeting gRNA
tctccctcaggagcagagggagg

SEQ ID NO: 3434 - DNA, 23 bp, Artificial Sequence
  HLA-A targeting gRNA
tctccgctgctcccgccgcatgg

SEQ ID NO: 3435 - DNA, 23 bp, Artificial Sequence
  HLA-A targeting gRNA
tctccgctgctccgcccgacggg

SEQ ID NO: 3436 - DNA, 23 bp, Artificial Sequence
  HLA-A targeting gRNA
tctcggagccccgcggcttcggg

SEQ ID NO: 3437 - DNA, 23 bp, Artificial Sequence
  HLA-A targeting gRNA
tctcggagtcccgcggcttcggg

SEQ ID NO: 3438 - DNA, 23 bp, Artificial Sequence
  HLA-A targeting gRNA
tctcgttgtagtagccgcgcagg

SEQ ID NO: 3439 - DNA, 23 bp, Artificial Sequence
  HLA-A targeting gRNA
tctctcggtcagtctgtgactgg

SEQ ID NO: 3440 - DNA, 23 bp, Artificial Sequence
  HLA-A targeting gRNA
tctctcggtcagtctgtgatggg

SEQ ID NO: 3441 - DNA, 23 bp, Artificial Sequence
  HLA-A targeting gRNA
tctctgcagggtagaagcccagg

SEQ ID NO: 3442 - DNA, 23 bp, Artificial Sequence
  HLA-A targeting gRNA
tctctgctgctccgccacacggg

SEQ ID NO: 3443 - DNA, 23 bp, Artificial Sequence
  HLA-A targeting gRNA
tctctgctgctccgcctcatggg

SEQ ID NO: 3444 - DNA, 23 bp, Artificial Sequence
  HLA-A targeting gRNA
tctggttgtagtagccgtgcagg

SEQ ID NO: 3445 - DNA, 23 bp, Artificial Sequence
  HLA-A targeting gRNA
tcttcctgacagacccccccagg

SEQ ID NO: 3446 - DNA, 23 bp, Artificial Sequence
  HLA-A targeting gRNA
tcttctccctcaagaccagaggg

SEQ ID NO: 3447 - DNA, 23 bp, Artificial Sequence
  HLA-A targeting gRNA
tgaaaatgaaaccgggttaaagg

SEQ ID NO: 3448 - DNA, 23 bp, Artificial Sequence
  HLA-A targeting gRNA
tgaaaccggctaaaggcgcctgg

SEQ ID NO: 3449 - DNA, 23 bp, Artificial Sequence
  HLA-A targeting gRNA
tgagagcctacctggagggccgg

SEQ ID NO: 3450 - DNA, 23 bp, Artificial Sequence
  HLA-A targeting gRNA
ggggagccgcgccgggaggaggg

SEQ ID NO: 3451 - DNA, 23 bp, Artificial Sequence
  HLA-A targeting gRNA
cgtgtcgtccacgtagcccacgg

SEQ ID NO: 3452 - DNA, 23 bp, Artificial Sequence
  HLA-A targeting gRNA
catgtcccggcccggccgcgggg

SEQ ID NO: 3453 - DNA, 23 bp, Artificial Sequence
  HLA-A targeting gRNA
tgagctaccagaaaggagccagg

SEQ ID NO: 3454 - DNA, 23 bp, Artificial Sequence
  HLA-A targeting gRNA
tgaggatggacaggacacctggg

SEQ ID NO: 3455 - DNA, 23 bp, Artificial Sequence
  HLA-A targeting gRNA
ccatgtcccggcccggccgcggg

SEQ ID NO: 3456 - DNA, 23 bp, Artificial Sequence
  HLA-A targeting gRNA
cccgcggccgggccgggacatgg

SEQ ID NO: 3457 - DNA, 23 bp, Artificial Sequence
  HLA-A targeting gRNA
tgaggccactctgaggtgctggg

SEQ ID NO: 3458 - DNA, 23 bp, Artificial Sequence
  HLA-A targeting gRNA
aggagcgcaggtcctcgttcagg

SEQ ID NO: 3459 - DNA, 23 bp, Artificial Sequence
  HLA-A targeting gRNA
ggagcgcaggtcctcgttcaggg

SEQ ID NO: 3460 - DNA, 23 bp, Artificial Sequence
  HLA-A targeting gRNA
tgagggagaagaatcctcctggg

SEQ ID NO: 3461 - DNA, 23 bp, Artificial Sequence
  HLA-A targeting gRNA
tgagtcatatgcgtcctgggggg

SEQ ID NO: 3462 - DNA, 23 bp, Artificial Sequence
  HLA-A targeting gRNA
tgaacgaggacctgcgctcctgg

SEQ ID NO: 3463 - DNA, 23 bp, Artificial Sequence
  HLA-A targeting gRNA
tgagtgtgaagcagagaacaggg

SEQ ID NO: 3464 - DNA, 23 bp, Artificial Sequence
  HLA-A targeting gRNA
tgagtgtgaagcagagaacgagg

SEQ ID NO: 3465 - DNA, 23 bp, Artificial Sequence
  HLA-A targeting gRNA
tgatcgcctgtagatctccgggg

SEQ ID NO: 3466 - DNA, 23 bp, Artificial Sequence
  HLA-A targeting gRNA
tgatggccatcctcggcgtctgg

SEQ ID NO: 3467 - DNA, 23 bp, Artificial Sequence
  HLA-A targeting gRNA
tgatgtatggctgccacgtgggg

SEQ ID NO: 3468 - DNA, 23 bp, Artificial Sequence
  HLA-A targeting gRNA
tgatgtgtgttgggtgttggggg

SEQ ID NO: 3469 - DNA, 23 bp, Artificial Sequence
  HLA-A targeting gRNA
tgccatgtccgccgcggtccagg

SEQ ID NO: 3470 - DNA, 23 bp, Artificial Sequence
  HLA-A targeting gRNA
tgcccggccccgaccaaccaggg

SEQ ID NO: 3471 - DNA, 23 bp, Artificial Sequence
  HLA-A targeting gRNA
tgccgccggtgtgtgtcaaaggg

SEQ ID NO: 3472 - DNA, 23 bp, Artificial Sequence
  HLA-A targeting gRNA
tgccgtcgtaagcgtcctgctgg

SEQ ID NO: 3473 - DNA, 23 bp, Artificial Sequence
  HLA-A targeting gRNA
tgccgtcgtaggcgacctgccgg

SEQ ID NO: 3474 - DNA, 23 bp, Artificial Sequence
  HLA-A targeting gRNA
tgccgtcgtaggcgtgctgccgg

SEQ ID NO: 3475 - DNA, 23 bp, Artificial Sequence
  HLA-A targeting gRNA
tgccgtcttaggcgtcctgccgg

SEQ ID NO: 3476 - DNA, 23 bp, Artificial Sequence
  HLA-A targeting gRNA
tgcctgtgtccaggctggtctgg

SEQ ID NO: 3477 - DNA, 23 bp, Artificial Sequence
  HLA-A targeting gRNA
tgccttcgtaggcgtcctgccgg

SEQ ID NO: 3478 - DNA, 23 bp, Artificial Sequence
  HLA-A targeting gRNA
tgcggagcccgtccacgcaccgg

SEQ ID NO: 3479 - DNA, 23 bp, Artificial Sequence
  HLA-A targeting gRNA
ggtggcctcatggtcagagatgg

SEQ ID NO: 3480 - DNA, 23 bp, Artificial Sequence
  HLA-A targeting gRNA
tgctgcagcgcacgggtaccagg

SEQ ID NO: 3481 - DNA, 23 bp, Artificial Sequence
  HLA-A targeting gRNA
tgcttcacactcaatatgtgtgg

SEQ ID NO: 3482 - DNA, 23 bp, Artificial Sequence
  HLA-A targeting gRNA
tgcttcccaggaatgagacaggg

SEQ ID NO: 3483 - DNA, 23 bp, Artificial Sequence
  HLA-A targeting gRNA
cagctgagagcctacctggaggg

SEQ ID NO: 3484 - DNA, 23 bp, Artificial Sequence
  HLA-A targeting gRNA
gcagctgagagcctacctggagg

SEQ ID NO: 3485 - DNA, 23 bp, Artificial Sequence
  HLA-A targeting gRNA
ggagcagctgagagcctacctgg

SEQ ID NO: 3486 - DNA, 23 bp, Artificial Sequence
  HLA-A targeting gRNA
tgcagacccagggcaggatcagg

SEQ ID NO: 3487 - DNA, 23 bp, Artificial Sequence
  HLA-A targeting gRNA
tggaaggtcccatcccctgcagg

SEQ ID NO: 3488 - DNA, 23 bp, Artificial Sequence
  HLA-A targeting gRNA
tggcctcatggtcagagatgggg

SEQ ID NO: 3489 - DNA, 23 bp, Artificial Sequence
  HLA-A targeting gRNA
gtggcctcatggtcagagatggg

SEQ ID NO: 3490 - DNA, 23 bp, Artificial Sequence
  HLA-A targeting gRNA
tggacgacacgcagttagtgcgg

SEQ ID NO: 3491 - DNA, 23 bp, Artificial Sequence
  HLA-A targeting gRNA
tggacggtgggctgggaagatgg

SEQ ID NO: 3492 - DNA, 23 bp, Artificial Sequence
  HLA-A targeting gRNA
atggtcagagatggggtggtggg

SEQ ID NO: 3493 - DNA, 23 bp, Artificial Sequence
  HLA-A targeting gRNA
tggagaaatacctcatggattgg

SEQ ID NO: 3494 - DNA, 23 bp, Artificial Sequence
  HLA-A targeting gRNA
catggtcagagatggggtggtgg

SEQ ID NO: 3495 - DNA, 23 bp, Artificial Sequence
  HLA-A targeting gRNA
ccaccccatctctgaccatgagg

SEQ ID NO: 3496 - DNA, 23 bp, Artificial Sequence
  HLA-A targeting gRNA
cctcatggtcagagatggggtgg

SEQ ID NO: 3497 - DNA, 23 bp, Artificial Sequence
  HLA-A targeting gRNA
tggagccgcgagccagaggatgg

SEQ ID NO: 3498 - DNA, 23 bp, Artificial Sequence
  HLA-A targeting gRNA
tggaggaagaagagctcaggtgg

SEQ ID NO: 3499 - DNA, 23 bp, Artificial Sequence
  HLA-A targeting gRNA
aggggtcgtgacctgcgccccgg

SEQ ID NO: 3500 - DNA, 23 bp, Artificial Sequence
  HLA-A targeting gRNA
ggggtcgtgacctgcgccccggg

SEQ ID NO: 3501 - DNA, 23 bp, Artificial Sequence
  HLA-A targeting gRNA
tggagggccggtgcgtggacggg

SEQ ID NO: 3502 - DNA, 23 bp, Artificial Sequence
  HLA-A targeting gRNA
tggagggcgagtgcgtggacggg

SEQ ID NO: 3503 - DNA, 23 bp, Artificial Sequence
  HLA-A targeting gRNA
tggagggcgagttcgtggagtgg

SEQ ID NO: 3504 - DNA, 23 bp, Artificial Sequence
  HLA-A targeting gRNA
tggatgtattgagcatgcaatgg

SEQ ID NO: 3505 - DNA, 23 bp, Artificial Sequence
  HLA-A targeting gRNA
tggccattttgaggatggacagg

SEQ ID NO: 3506 - DNA, 23 bp, Artificial Sequence
  HLA-A targeting gRNA
tggcccgtccgtaggggatgagg

SEQ ID NO: 3507 - DNA, 23 bp, Artificial Sequence
  HLA-A targeting gRNA
tggctcgcggctccatcctctgg

SEQ ID NO: 3508 - DNA, 23 bp, Artificial Sequence
  HLA-A targeting gRNA
tgggagcctggggcgagcagtgg

SEQ ID NO: 3509 - DNA, 23 bp, Artificial Sequence
  HLA-A targeting gRNA
tgggaggcggtccatgcggcggg

SEQ ID NO: 3510 - DNA, 23 bp, Artificial Sequence
  HLA-A targeting gRNA
tgggataaggagggagatggggg

SEQ ID NO: 3511 - DNA, 23 bp, Artificial Sequence
  HLA-A targeting gRNA
gtagaaatacctcatggagtggg

SEQ ID NO: 3512 - DNA, 23 bp, Artificial Sequence
  HLA-A targeting gRNA
tgtagaaatacctcatggagtgg

SEQ ID NO: 3513 - DNA, 23 bp, Artificial Sequence
  HLA-A targeting gRNA
tgggcggggctcgggggagctgg

SEQ ID NO: 3514 - DNA, 23 bp, Artificial Sequence
  HLA-A targeting gRNA
aaggagacgctgcagcgcgcggg

SEQ ID NO: 3515 - DNA, 23 bp, Artificial Sequence
  HLA-A targeting gRNA
gaaggagacgctgcagcgcgcgg

SEQ ID NO: 3516 - DNA, 23 bp, Artificial Sequence
  HLA-A targeting gRNA
cgggttggtcggggcggggcggg

SEQ ID NO: 3517 - DNA, 23 bp, Artificial Sequence
  HLA-A targeting gRNA
gggttggtcggggcggggcgggg

SEQ ID NO: 3518 - DNA, 23 bp, Artificial Sequence
  HLA-A targeting gRNA
tgggttaaggagggagatggggg

SEQ ID NO: 3519 - DNA, 23 bp, Artificial Sequence
  HLA-A targeting gRNA
cgctgcagcgcgcgggtaccagg

SEQ ID NO: 3520 - DNA, 23 bp, Artificial Sequence
  HLA-A targeting gRNA
tggtcatatgtgtcttggggggg

SEQ ID NO: 3521 - DNA, 23 bp, Artificial Sequence
  HLA-A targeting gRNA
gctgcagcgcgcgggtaccaggg

SEQ ID NO: 3522 - DNA, 23 bp, Artificial Sequence
  HLA-A targeting gRNA
ctgcagcgcgcgggtaccagggg

SEQ ID NO: 3523 - DNA, 23 bp, Artificial Sequence
  HLA-A targeting gRNA
tggtgagtcatatgcgtcctggg

SEQ ID NO: 3524 - DNA, 23 bp, Artificial Sequence
  HLA-A targeting gRNA
tggtgagtcatatgtgtcttggg

SEQ ID NO: 3525 - DNA, 23 bp, Artificial Sequence
  HLA-A targeting gRNA
tggtggtcatatgtgtcttgggg

SEQ ID NO: 3526 - DNA, 23 bp, Artificial Sequence
  HLA-A targeting gRNA
tggttggtcggggccgggcaggg

SEQ ID NO: 3527 - DNA, 23 bp, Artificial Sequence
  HLA-A targeting gRNA
tgtagcccacggcgatgaagcgg

SEQ ID NO: 3528 - DNA, 23 bp, Artificial Sequence
  HLA-A targeting gRNA
tgtcctgtccatcctcaaaatgg

SEQ ID NO: 3529 - DNA, 23 bp, Artificial Sequence
  HLA-A targeting gRNA
tgtcctgtgagctaccagaaagg

SEQ ID NO: 3530 - DNA, 23 bp, Artificial Sequence
  HLA-A targeting gRNA
tgtcttggggggggtctgacggg

SEQ ID NO: 3531 - DNA, 23 bp, Artificial Sequence
  HLA-A targeting gRNA
tgtgaatgcagacccagggcagg

SEQ ID NO: 3532 - DNA, 23 bp, Artificial Sequence
  HLA-A targeting gRNA
tgtgctctcttccccatcccagg

SEQ ID NO: 3533 - DNA, 23 bp, Artificial Sequence
  HLA-A targeting gRNA
ggagtgggagcctgggggcgagg

SEQ ID NO: 3534 - DNA, 23 bp, Artificial Sequence
  HLA-A targeting gRNA
tgtggagaccaagcctgcagggg

SEQ ID NO: 3535 - DNA, 23 bp, Artificial Sequence
  HLA-A targeting gRNA
tgtgggcatcattgctggcctgg

SEQ ID NO: 3536 - DNA, 23 bp, Artificial Sequence
  HLA-A targeting gRNA
tgtggtggtaccttctggaaagg

SEQ ID NO: 3537 - DNA, 23 bp, Artificial Sequence
  HLA-A targeting gRNA
aggggccggagtattgggaccgg

SEQ ID NO: 3538 - DNA, 23 bp, Artificial Sequence
  HLA-A targeting gRNA
ccaccacagctgcccacttctgg

SEQ ID NO: 3539 - DNA, 23 bp, Artificial Sequence
  HLA-A targeting gRNA
ccagaagtgggcagctgtggtgg

SEQ ID NO: 3540 - DNA, 23 bp, Artificial Sequence
  HLA-A targeting gRNA
ttaacccatctcagggtgagggg

SEQ ID NO: 3541 - DNA, 23 bp, Artificial Sequence
  HLA-A targeting gRNA
cttccagaagtgggcagctgtgg

SEQ ID NO: 3542 - DNA, 23 bp, Artificial Sequence
  HLA-A targeting gRNA
ggattacatcgccctgaacgagg

SEQ ID NO: 3543 - DNA, 23 bp, Artificial Sequence
  HLA-A targeting gRNA
agcccagggcccagcacctcagg

SEQ ID NO: 3544 - DNA, 23 bp, Artificial Sequence
  HLA-A targeting gRNA
gcccagggcccagcacctcaggg

SEQ ID NO: 3545 - DNA, 23 bp, Artificial Sequence
  HLA-A targeting gRNA
ttagaccgcggcggacatggcgg

SEQ ID NO: 3546 - DNA, 23 bp, Artificial Sequence
  HLA-A targeting gRNA
ttatcccatctcagggtgagggg

SEQ ID NO: 3547 - DNA, 23 bp, Artificial Sequence
  HLA-A targeting gRNA
ttcacactcaatatgtgtggggg

SEQ ID NO: 3548 - DNA, 23 bp, Artificial Sequence
  HLA-A targeting gRNA
cacagctgcccacttctggaagg

SEQ ID NO: 3549 - DNA, 23 bp, Artificial Sequence
  HLA-A targeting gRNA
ttcacattcgtgtcccggcccgg

SEQ ID NO: 3550 - DNA, 23 bp, Artificial Sequence
  HLA-A targeting gRNA
ctccgcagggtagaagcccaggg

SEQ ID NO: 3551 - DNA, 23 bp, Artificial Sequence
  HLA-A targeting gRNA
ttcatatcactcacagtgagggg

SEQ ID NO: 3552 - DNA, 23 bp, Artificial Sequence
  HLA-A targeting gRNA
ggccctgggcttctaccctgcgg

SEQ ID NO: 3553 - DNA, 23 bp, Artificial Sequence
  HLA-A targeting gRNA
tctccgcagggtagaagcccagg

SEQ ID NO: 3554 - DNA, 23 bp, Artificial Sequence
  HLA-A targeting gRNA
ttcccacagttagaaaaggaggg

SEQ ID NO: 3555 - DNA, 23 bp, Artificial Sequence
  HLA-A targeting gRNA
ttccctttgacacacaccggcgg

SEQ ID NO: 3556 - DNA, 23 bp, Artificial Sequence
  HLA-A targeting gRNA
ttcctctccctcaggagcagagg

SEQ ID NO: 3557 - DNA, 23 bp, Artificial Sequence
  HLA-A targeting gRNA
ctcatggagtgggagcctggggg

SEQ ID NO: 3558 - DNA, 23 bp, Artificial Sequence
  HLA-A targeting gRNA
accctgaggtgctgggccctggg

SEQ ID NO: 3559 - DNA, 23 bp, Artificial Sequence
  HLA-A targeting gRNA
caccctgaggtgctgggccctgg

SEQ ID NO: 3560 - DNA, 23 bp, Artificial Sequence
  HLA-A targeting gRNA
ttcgtgtcccggcccggccgcgg

SEQ ID NO: 3561 - DNA, 23 bp, Artificial Sequence
  HLA-A targeting gRNA
ttctcactccaattgggtgtcgg

SEQ ID NO: 3562 - DNA, 23 bp, Artificial Sequence
  HLA-A targeting gRNA
ttctcactcctattgggtgtcgg

SEQ ID NO: 3563 - DNA, 23 bp, Artificial Sequence
  HLA-A targeting gRNA
ttctctcggtcagtctgtgatgg

SEQ ID NO: 3564 - DNA, 23 bp, Artificial Sequence
  HLA-A targeting gRNA
ttcttctccctcaagaccagagg

SEQ ID NO: 3565 - DNA, 23 bp, Artificial Sequence
  HLA-A targeting gRNA
ttcttgtgggaggccagccccgg

SEQ ID NO: 3566 - DNA, 23 bp, Artificial Sequence
  HLA-A targeting gRNA
ttgaggatggacaggacacctgg

SEQ ID NO: 3567 - DNA, 23 bp, Artificial Sequence
  HLA-A targeting gRNA
ttgagggagaagaatcctcctgg

SEQ ID NO: 3568 - DNA, 23 bp, Artificial Sequence
  HLA-A targeting gRNA
ttgagtgtgaagcagagaacagg

SEQ ID NO: 3569 - DNA, 23 bp, Artificial Sequence
  HLA-A targeting gRNA
ttgcctttcagtcccacacaagg

SEQ ID NO: 3570 - DNA, 23 bp, Artificial Sequence
  HLA-A targeting gRNA
ttgggtgttggggggaacagtgg

SEQ ID NO: 3571 - DNA, 23 bp, Artificial Sequence
  HLA-A targeting gRNA
ttgggtgttgggtggaacagtgg

SEQ ID NO: 3572 - DNA, 23 bp, Artificial Sequence
  HLA-A targeting gRNA
ttgtctccctttcttgtgggagg

SEQ ID NO: 3573 - DNA, 23 bp, Artificial Sequence
  HLA-A targeting gRNA
ttgtggagaccaagcctgcaggg

SEQ ID NO: 3574 - DNA, 23 bp, Artificial Sequence
  HLA-A targeting gRNA
ttgtggttgggagcccatggggg

SEQ ID NO: 3575 - DNA, 23 bp, Artificial Sequence
  HLA-A targeting gRNA
ccccaggctcccactccatgagg

SEQ ID NO: 3576 - DNA, 23 bp, Artificial Sequence
  HLA-A targeting gRNA
cctcatggagtgggagcctgggg

SEQ ID NO: 3577 - DNA, 23 bp, Artificial Sequence
  HLA-A targeting gRNA
tacctcatggagtgggagcctgg

SEQ ID NO: 3578 - DNA, 23 bp, Artificial Sequence
  HLA-A targeting gRNA
acctcatggagtgggagcctggg

SEQ ID NO: 3579 - DNA, 23 bp, Artificial Sequence
  HLA-A targeting gRNA
tttccagagagtgactctgaggg

SEQ ID NO: 3580 - DNA, 23 bp, Artificial Sequence
  HLA-A targeting gRNA
tttcttcccacagttagaaaagg

SEQ ID NO: 3581 - DNA, 23 bp, Artificial Sequence
  HLA-A targeting gRNA
ttttcaagtcacaaagggaaggg

SEQ ID NO: 3582 - DNA, 23 bp, Artificial Sequence
  HLA-A targeting gRNA
tttttcaagtcacaaagggaagg

SEQ ID NO: 3583 - DNA, 23 bp, Artificial Sequence
  HLA-A targeting gRNA
aaaaggagggagctgctctcagg

SEQ ID NO: 3584 - DNA, 23 bp, Artificial Sequence
  HLA-A targeting gRNA
aaaatccccgcgggttgggcggg

SEQ ID NO: 3585 - DNA, 23 bp, Artificial Sequence
  HLA-A targeting gRNA
aaaatccccgcgggttggtcagg

SEQ ID NO: 3586 - DNA, 23 bp, Artificial Sequence
  HLA-A targeting gRNA
aaaatccccgcgggttggtcggg

SEQ ID NO: 3587 - DNA, 23 bp, Artificial Sequence
  HLA-A targeting gRNA
aaaatgccctatgaggggactgg

SEQ ID NO: 3588 - DNA, 23 bp, Artificial Sequence
  HLA-A targeting gRNA
aaaatgccctgtgaggggacagg

SEQ ID NO: 3589 - DNA, 23 bp, Artificial Sequence
  HLA-A targeting gRNA
aaaatgccctgtgaggggactgg

SEQ ID NO: 3590 - DNA, 23 bp, Artificial Sequence
  HLA-A targeting gRNA
aaaatgtcctgtgagggcactgg

SEQ ID NO: 3591 - DNA, 23 bp, Artificial Sequence
  HLA-A targeting gRNA
aaaatgtcctgtgaggggactgg

SEQ ID NO: 3592 - DNA, 23 bp, Artificial Sequence
  HLA-A targeting gRNA
aaacacaaggaaagcaagtgtgg

SEQ ID NO: 3593 - DNA, 23 bp, Artificial Sequence
  HLA-A targeting gRNA
aaacacagggaaagcagctgtgg

SEQ ID NO: 3594 - DNA, 23 bp, Artificial Sequence
  HLA-A targeting gRNA
aaacacgaggaaagcaagtgtgg

SEQ ID NO: 3595 - DNA, 23 bp, Artificial Sequence
  HLA-A targeting gRNA
aaacacggggaaagcagctgtgg

SEQ ID NO: 3596 - DNA, 23 bp, Artificial Sequence
  HLA-A targeting gRNA
aaacatggggaaagcagctgtgg

SEQ ID NO: 3597 - DNA, 23 bp, Artificial Sequence
  HLA-A targeting gRNA
aaacatggggaaagcagttgtgg

SEQ ID NO: 3598 - DNA, 23 bp, Artificial Sequence
  HLA-A targeting gRNA
aaacccctcaccctgagatgggg

SEQ ID NO: 3599 - DNA, 23 bp, Artificial Sequence
  HLA-A targeting gRNA
aaaccgggtaaacgcgcctgggg

SEQ ID NO: 3600 - DNA, 23 bp, Artificial Sequence
  HLA-A targeting gRNA
aaaccgggtaaaggcgactaggg

SEQ ID NO: 3601 - DNA, 23 bp, Artificial Sequence
  HLA-A targeting gRNA
aaaccgggtaaaggcgactgggg

SEQ ID NO: 3602 - DNA, 23 bp, Artificial Sequence
  HLA-A targeting gRNA
aaaccgggtaaaggcgcctgggg

SEQ ID NO: 3603 - DNA, 23 bp, Artificial Sequence
  HLA-A targeting gRNA
aaaccgggtaaaggtgactgggg

SEQ ID NO: 3604 - DNA, 23 bp, Artificial Sequence
  HLA-A targeting gRNA
aaaccgggtaaagtcgcctgggg

SEQ ID NO: 3605 - DNA, 23 bp, Artificial Sequence
  HLA-A targeting gRNA
aaactcaggggagtgggagtggg

SEQ ID NO: 3606 - DNA, 23 bp, Artificial Sequence
  HLA-A targeting gRNA
aaagaataggagattatcccagg

SEQ ID NO: 3607 - DNA, 23 bp, Artificial Sequence
  HLA-A targeting gRNA
aaagagacgctgcagcgcgcagg

SEQ ID NO: 3608 - DNA, 23 bp, Artificial Sequence
  HLA-A targeting gRNA
aaagcaggagcccttcagcaggg

SEQ ID NO: 3609 - DNA, 23 bp, Artificial Sequence
  HLA-A targeting gRNA
aaagcccctcaccctgagatggg

SEQ ID NO: 3610 - DNA, 23 bp, Artificial Sequence
  HLA-A targeting gRNA
aaagtcaccagtcacccacccgg

SEQ ID NO: 3611 - DNA, 23 bp, Artificial Sequence
  HLA-A targeting gRNA
aaagtccccacgcacccacccgg

SEQ ID NO: 3612 - DNA, 23 bp, Artificial Sequence
  HLA-A targeting gRNA
aaagtccccagtcacccacccgg

SEQ ID NO: 3613 - DNA, 23 bp, Artificial Sequence
  HLA-A targeting gRNA
aaagttcgagtctctgagcgggg

SEQ ID NO: 3614 - DNA, 23 bp, Artificial Sequence
  HLA-A targeting gRNA
aaagttcgagtctctgagtgggg

SEQ ID NO: 3615 - DNA, 23 bp, Artificial Sequence
  HLA-A targeting gRNA
aaagttctagtctctgagggagg

SEQ ID NO: 3616 - DNA, 23 bp, Artificial Sequence
  HLA-A targeting gRNA
aaatccccgcgggttgggcgggg

SEQ ID NO: 3617 - DNA, 23 bp, Artificial Sequence
  HLA-A targeting gRNA
aaatccccgcgggttggtcaggg

SEQ ID NO: 3618 - DNA, 23 bp, Artificial Sequence
  HLA-A targeting gRNA
aaatccccgcgggttggtcgggg

SEQ ID NO: 3619 - DNA, 23 bp, Artificial Sequence
  HLA-A targeting gRNA
aaatgatggcggcgggcgtgtgg

SEQ ID NO: 3620 - DNA, 23 bp, Artificial Sequence
  HLA-A targeting gRNA
aaatgccctatgaggggactggg

SEQ ID NO: 3621 - DNA, 23 bp, Artificial Sequence
  HLA-A targeting gRNA
aaatgccctgtgaggggacaggg

SEQ ID NO: 3622 - DNA, 23 bp, Artificial Sequence
  HLA-A targeting gRNA
aaatgccctgtgaggggactggg

SEQ ID NO: 3623 - DNA, 23 bp, Artificial Sequence
  HLA-A targeting gRNA
aaatgtcctgtgagggcactggg

SEQ ID NO: 3624 - DNA, 23 bp, Artificial Sequence
  HLA-A targeting gRNA
aaatgtcctgtgaggggactggg

SEQ ID NO: 3625 - DNA, 23 bp, Artificial Sequence
  HLA-A targeting gRNA
aacaatgcccacgatggggacgg

SEQ ID NO: 3626 - DNA, 23 bp, Artificial Sequence
  HLA-A targeting gRNA
aacaatgcccacgatggggatgg

SEQ ID NO: 3627 - DNA, 23 bp, Artificial Sequence
  HLA-A targeting gRNA
aacacaaggaaagcaagtgtggg

SEQ ID NO: 3628 - DNA, 23 bp, Artificial Sequence
  HLA-A targeting gRNA
aacacagggaaagcagctgtggg

SEQ ID NO: 3629 - DNA, 23 bp, Artificial Sequence
  HLA-A targeting gRNA
aacacgaggaaagcaagtgtggg

SEQ ID NO: 3630 - DNA, 23 bp, Artificial Sequence
  HLA-A targeting gRNA
aacacggggaaagcagctgtggg

SEQ ID NO: 3631 - DNA, 23 bp, Artificial Sequence
  HLA-A targeting gRNA
aacatggggaaagcagctgtggg

SEQ ID NO: 3632 - DNA, 23 bp, Artificial Sequence
  HLA-A targeting gRNA
aacatggggaaagcagttgtggg

SEQ ID NO: 3633 - DNA, 23 bp, Artificial Sequence
  HLA-A targeting gRNA
aacccagggcccagcacctcagg

SEQ ID NO: 3634 - DNA, 23 bp, Artificial Sequence
  HLA-A targeting gRNA
aaccccgcactcacaggcccagg

SEQ ID NO: 3635 - DNA, 23 bp, Artificial Sequence
  HLA-A targeting gRNA
aaccccgcactcaccggcccagg

SEQ ID NO: 3636 - DNA, 23 bp, Artificial Sequence
  HLA-A targeting gRNA
aaccccgcactcaccggtccagg

SEQ ID NO: 3637 - DNA, 23 bp, Artificial Sequence
  HLA-A targeting gRNA
aacccgacacccaatgggagtgg

SEQ ID NO: 3638 - DNA, 23 bp, Artificial Sequence
  HLA-A targeting gRNA
aacccgcccagaccctcgaccgg

SEQ ID NO: 3639 - DNA, 23 bp, Artificial Sequence
  HLA-A targeting gRNA
aacccgcccagaccctcggccgg

SEQ ID NO: 3640 - DNA, 23 bp, Artificial Sequence
  HLA-A targeting gRNA
aacccgcccgaccctcctcccgg

SEQ ID NO: 3641 - DNA, 23 bp, Artificial Sequence
  HLA-A targeting gRNA
aaccctcatcctgctgctctcgg

SEQ ID NO: 3642 - DNA, 23 bp, Artificial Sequence
  HLA-A targeting gRNA
aaccctcctcctgctgctctagg

SEQ ID NO: 3643 - DNA, 23 bp, Artificial Sequence
  HLA-A targeting gRNA
aaccctcctcctgctgctctcgg

SEQ ID NO: 3644 - DNA, 23 bp, Artificial Sequence
  HLA-A targeting gRNA
aaccctcctcctgctgctctggg

SEQ ID NO: 3645 - DNA, 23 bp, Artificial Sequence
  HLA-A targeting gRNA
aaccgtcctcctgctgctctcgg

SEQ ID NO: 3646 - DNA, 23 bp, Artificial Sequence
  HLA-A targeting gRNA
aaccgtcctcctgctgctctggg

SEQ ID NO: 3647 - DNA, 23 bp, Artificial Sequence
  HLA-A targeting gRNA
aacctcgcactcacaggcccagg

SEQ ID NO: 3648 - DNA, 23 bp, Artificial Sequence
  HLA-A targeting gRNA
aacgacgccgcgagtccgagagg

SEQ ID NO: 3649 - DNA, 23 bp, Artificial Sequence
  HLA-A targeting gRNA
aacgagaagaagaggaaaatggg

SEQ ID NO: 3650 - DNA, 23 bp, Artificial Sequence
  HLA-A targeting gRNA
aacgaggtgcccgcccggcgagg

SEQ ID NO: 3651 - DNA, 23 bp, Artificial Sequence
  HLA-A targeting gRNA
aacgatgcccaagttggggatgg

SEQ ID NO: 3652 - DNA, 23 bp, Artificial Sequence
  HLA-A targeting gRNA
aacgatgcccacgatggggatgg

SEQ ID NO: 3653 - DNA, 23 bp, Artificial Sequence
  HLA-A targeting gRNA
aacgatgcccatgatggggatgg

SEQ ID NO: 3654 - DNA, 23 bp, Artificial Sequence
  HLA-A targeting gRNA
aacgcgcctggggctctcgccgg

SEQ ID NO: 3655 - DNA, 23 bp, Artificial Sequence
  HLA-A targeting gRNA
aacggacaggacacctggggtgg

SEQ ID NO: 3656 - DNA, 23 bp, Artificial Sequence
  HLA-A targeting gRNA
aactcaggacacccagcttgtgg

SEQ ID NO: 3657 - DNA, 23 bp, Artificial Sequence
  HLA-A targeting gRNA
aactcaggacaccgagcttgtgg

SEQ ID NO: 3658 - DNA, 23 bp, Artificial Sequence
  HLA-A targeting gRNA
aactcaggacactgagcttgtgg

SEQ ID NO: 3659 - DNA, 23 bp, Artificial Sequence
  HLA-A targeting gRNA
aactcaggggagtgggagtgggg

SEQ ID NO: 3660 - DNA, 23 bp, Artificial Sequence
  HLA-A targeting gRNA
aactctcctcctgctgctctcgg

SEQ ID NO: 3661 - DNA, 23 bp, Artificial Sequence
  HLA-A targeting gRNA
aagaaaagtcatggttcccaagg

SEQ ID NO: 3662 - DNA, 23 bp, Artificial Sequence
  HLA-A targeting gRNA
aagaagacgctgcagcgcgcggg

SEQ ID NO: 3663 - DNA, 23 bp, Artificial Sequence
  HLA-A targeting gRNA
aagaaggacccgacacaagttgg

SEQ ID NO: 3664 - DNA, 23 bp, Artificial Sequence
  HLA-A targeting gRNA
aagaaggacccgacacaggttgg

SEQ ID NO: 3665 - DNA, 23 bp, Artificial Sequence
  HLA-A targeting gRNA
aagaaggacccgacataggttgg

SEQ ID NO: 3666 - DNA, 23 bp, Artificial Sequence
  HLA-A targeting gRNA
aagaaggacccgacgcaggttgg

SEQ ID NO: 3667 - DNA, 23 bp, Artificial Sequence
  HLA-A targeting gRNA
aagaaggacccgtcgcaggttgg

SEQ ID NO: 3668 - DNA, 23 bp, Artificial Sequence
  HLA-A targeting gRNA
aagacctggtcagagcccacagg

SEQ ID NO: 3669 - DNA, 23 bp, Artificial Sequence
  HLA-A targeting gRNA
aagacctggtcagagcccgcagg

SEQ ID NO: 3670 - DNA, 23 bp, Artificial Sequence
  HLA-A targeting gRNA
aagacggctccgggaaaggaagg

SEQ ID NO: 3671 - DNA, 23 bp, Artificial Sequence
  HLA-A targeting gRNA
aagacggctctgggaaaggaagg

SEQ ID NO: 3672 - DNA, 23 bp, Artificial Sequence
  HLA-A targeting gRNA
aagacggctctgggaaaggaggg

SEQ ID NO: 3673 - DNA, 23 bp, Artificial Sequence
  HLA-A targeting gRNA
aagagcccctcaccctgagctgg

SEQ ID NO: 3674 - DNA, 23 bp, Artificial Sequence
  HLA-A targeting gRNA
aagagctcaggtggaaaaggagg

SEQ ID NO: 3675 - DNA, 23 bp, Artificial Sequence
  HLA-A targeting gRNA
aagagtaagttctggcacacagg

SEQ ID NO: 3676 - DNA, 23 bp, Artificial Sequence
  HLA-A targeting gRNA
aagatggccctgggaaaggaggg

SEQ ID NO: 3677 - DNA, 23 bp, Artificial Sequence
  HLA-A targeting gRNA
aagatggctctgggaaaggaggg

SEQ ID NO: 3678 - DNA, 23 bp, Artificial Sequence
  HLA-A targeting gRNA
aagcggagctccccgcggccggg

SEQ ID NO: 3679 - DNA, 23 bp, Artificial Sequence
  HLA-A targeting gRNA
aagcggcctctgcggagaggagg

SEQ ID NO: 3680 - DNA, 23 bp, Artificial Sequence
  HLA-A targeting gRNA
aagcgggactctccgcggccggg

SEQ ID NO: 3681 - DNA, 23 bp, Artificial Sequence
  HLA-A targeting gRNA
aagcggggctccccacggccggg

SEQ ID NO: 3682 - DNA, 23 bp, Artificial Sequence
  HLA-A targeting gRNA
aagcggggctccccgcagccggg

SEQ ID NO: 3683 - DNA, 23 bp, Artificial Sequence
  HLA-A targeting gRNA
aagcggggctccccgcggccagg

SEQ ID NO: 3684 - DNA, 23 bp, Artificial Sequence
  HLA-A targeting gRNA
aagcggggctccccgctgccggg

SEQ ID NO: 3685 - DNA, 23 bp, Artificial Sequence
  HLA-A targeting gRNA
aagcggggctctccgcggccagg

SEQ ID NO: 3686 - DNA, 23 bp, Artificial Sequence
  HLA-A targeting gRNA
aagcggggctctccgcggccggg

SEQ ID NO: 3687 - DNA, 23 bp, Artificial Sequence
  HLA-A targeting gRNA
aagcggggctctccgcggcctgg

SEQ ID NO: 3688 - DNA, 23 bp, Artificial Sequence
  HLA-A targeting gRNA
aagcggtgctctccgcggccagg

SEQ ID NO: 3689 - DNA, 23 bp, Artificial Sequence
  HLA-A targeting gRNA
aaggaaacgctgcagcgcgcggg

SEQ ID NO: 3690 - DNA, 23 bp, Artificial Sequence
  HLA-A targeting gRNA
aaggacaagctggagcgcgctgg

SEQ ID NO: 3691 - DNA, 23 bp, Artificial Sequence
  HLA-A targeting gRNA
aaggacacgctggagcgcgcggg

SEQ ID NO: 3692 - DNA, 23 bp, Artificial Sequence
  HLA-A targeting gRNA
aaggagaccctgcagcgcgcggg

SEQ ID NO: 3693 - DNA, 23 bp, Artificial Sequence
  HLA-A targeting gRNA
aaggagacgctgcaacgcgcggg

SEQ ID NO: 3694 - DNA, 23 bp, Artificial Sequence
  HLA-A targeting gRNA
aaggagacgctgcagagcgcggg

SEQ ID NO: 3695 - DNA, 23 bp, Artificial Sequence
  HLA-A targeting gRNA
aaggagacgctgcagcacgcggg

SEQ ID NO: 3696 - DNA, 23 bp, Artificial Sequence
  HLA-A targeting gRNA
aaggagacgctgcagcgcgcagg

SEQ ID NO: 3697 - DNA, 23 bp, Artificial Sequence
  HLA-A targeting gRNA
aaggagacgctggagcgcgcggg

SEQ ID NO: 3698 - DNA, 23 bp, Artificial Sequence
  HLA-A targeting gRNA
aaggcacagactgaccgagtggg

SEQ ID NO: 3699 - DNA, 23 bp, Artificial Sequence
  HLA-A targeting gRNA
aaggcccaggcacagactgacgg

SEQ ID NO: 3700 - DNA, 23 bp, Artificial Sequence
  HLA-A targeting gRNA
aaggcctgagaggaaagtcacgg

SEQ ID NO: 3701 - DNA, 23 bp, Artificial Sequence
  HLA-A targeting gRNA
aaggcgactagggctctctccgg

SEQ ID NO: 3702 - DNA, 23 bp, Artificial Sequence
  HLA-A targeting gRNA
aaggcgactggggctctctccgg

SEQ ID NO: 3703 - DNA, 23 bp, Artificial Sequence
  HLA-A targeting gRNA
aaggcgcctggggctctcgccgg

SEQ ID NO: 3704 - DNA, 23 bp, Artificial Sequence
  HLA-A targeting gRNA
aaggctgctgcaggggtcaaagg

SEQ ID NO: 3705 - DNA, 23 bp, Artificial Sequence
  HLA-A targeting gRNA
aaggggagccgcgggcgccgtgg

SEQ ID NO: 3706 - DNA, 23 bp, Artificial Sequence
  HLA-A targeting gRNA
aaggggtgaagagcggggtctgg

SEQ ID NO: 3707 - DNA, 23 bp, Artificial Sequence
  HLA-A targeting gRNA
aaggggtgaggagtggggtctgg

SEQ ID NO: 3708 - DNA, 23 bp, Artificial Sequence
  HLA-A targeting gRNA
aaggggtgaggggtggggtctgg

SEQ ID NO: 3709 - DNA, 23 bp, Artificial Sequence
  HLA-A targeting gRNA
aaggggtggggagtggggtctgg

SEQ ID NO: 3710 - DNA, 23 bp, Artificial Sequence
  HLA-A targeting gRNA
aaggtgactggggctctctccgg

SEQ ID NO: 3711 - DNA, 23 bp, Artificial Sequence
  HLA-A targeting gRNA
aagtccctgaggaaatggagggg

SEQ ID NO: 3712 - DNA, 23 bp, Artificial Sequence
  HLA-A targeting gRNA
aagtccgagaggggagccccggg

SEQ ID NO: 3713 - DNA, 23 bp, Artificial Sequence
  HLA-A targeting gRNA
aagtcctggagcccttcagccgg

SEQ ID NO: 3714 - DNA, 23 bp, Artificial Sequence
  HLA-A targeting gRNA
aagtcctggagcccttcagctgg

SEQ ID NO: 3715 - DNA, 23 bp, Artificial Sequence
  HLA-A targeting gRNA
aagtccttgaggaaatggagggg

SEQ ID NO: 3716 - DNA, 23 bp, Artificial Sequence
  HLA-A targeting gRNA
aagtcgcctggggctctctgcgg

SEQ ID NO: 3717 - DNA, 23 bp, Artificial Sequence
  HLA-A targeting gRNA
aagtctctgaggaaatggagggg

SEQ ID NO: 3718 - DNA, 23 bp, Artificial Sequence
  HLA-A targeting gRNA
aagtgaaactcagggaagtgggg

SEQ ID NO: 3719 - DNA, 23 bp, Artificial Sequence
  HLA-A targeting gRNA
aagtgaaactcaggggagtgggg

SEQ ID NO: 3720 - DNA, 23 bp, Artificial Sequence
  HLA-A targeting gRNA
aagtgaaactcgtgggagtgggg

SEQ ID NO: 3721 - DNA, 23 bp, Artificial Sequence
  HLA-A targeting gRNA
aagtgaaactcttgggagtgggg

SEQ ID NO: 3722 - DNA, 23 bp, Artificial Sequence
  HLA-A targeting gRNA
aagtgatgccggtgggcgtgtgg

SEQ ID NO: 3723 - DNA, 23 bp, Artificial Sequence
  HLA-A targeting gRNA
aagtgatggcagtgggcgtgtgg

SEQ ID NO: 3724 - DNA, 23 bp, Artificial Sequence
  HLA-A targeting gRNA
aagtgatggcggcaggcgtgtgg

SEQ ID NO: 3725 - DNA, 23 bp, Artificial Sequence
  HLA-A targeting gRNA
aagtgatggcggcgggcgtgtgg

SEQ ID NO: 3726 - DNA, 23 bp, Artificial Sequence
  HLA-A targeting gRNA
aagtgatggcggtggccgtgtgg

SEQ ID NO: 3727 - DNA, 23 bp, Artificial Sequence
  HLA-A targeting gRNA
aagtgatggcggtgggcgtgtgg

SEQ ID NO: 3728 - DNA, 23 bp, Artificial Sequence
  HLA-A targeting gRNA
aagtgatgggggcgggagtgtgg

SEQ ID NO: 3729 - DNA, 23 bp, Artificial Sequence
  HLA-A targeting gRNA
aagtgatgggggtgggagtgtgg

SEQ ID NO: 3730 - DNA, 23 bp, Artificial Sequence
  HLA-A targeting gRNA
aagtgccatgttcagcacgaggg

SEQ ID NO: 3731 - DNA, 23 bp, Artificial Sequence
  HLA-A targeting gRNA
aagtggggctccccgcggccggg

SEQ ID NO: 3732 - DNA, 23 bp, Artificial Sequence
  HLA-A targeting gRNA
aagtggggctctccgcggccggg

SEQ ID NO: 3733 - DNA, 23 bp, Artificial Sequence
  HLA-A targeting gRNA
aagtggggctctccgcggctggg

SEQ ID NO: 3734 - DNA, 23 bp, Artificial Sequence
  HLA-A targeting gRNA
aagtggtgggggtgggagtgtgg

SEQ ID NO: 3735 - DNA, 23 bp, Artificial Sequence
  HLA-A targeting gRNA
aatacctggtcagagcccgcagg

SEQ ID NO: 3736 - DNA, 23 bp, Artificial Sequence
  HLA-A targeting gRNA
aatatgtatggctgcgacgtggg

SEQ ID NO: 3737 - DNA, 23 bp, Artificial Sequence
  HLA-A targeting gRNA
aatcagcgtctacgcagtcccgg

SEQ ID NO: 3738 - DNA, 23 bp, Artificial Sequence
  HLA-A targeting gRNA
aatcagcgtctccgcagtaccgg

SEQ ID NO: 3739 - DNA, 23 bp, Artificial Sequence
  HLA-A targeting gRNA
aatcagcgtctccgcagtccagg

SEQ ID NO: 3740 - DNA, 23 bp, Artificial Sequence
  HLA-A targeting gRNA
aatcagcgtctccgcagtcccgg

SEQ ID NO: 3741 - DNA, 23 bp, Artificial Sequence
  HLA-A targeting gRNA
aatccgacacccaatgggagtgg

SEQ ID NO: 3742 - DNA, 23 bp, Artificial Sequence
  HLA-A targeting gRNA
aatccgcccagaccctcgaccgg

SEQ ID NO: 3743 - DNA, 23 bp, Artificial Sequence
  HLA-A targeting gRNA
aatctgagccgcggtgtccgcgg

SEQ ID NO: 3744 - DNA, 23 bp, Artificial Sequence
  HLA-A targeting gRNA
aatgaataggagattatcccagg

SEQ ID NO: 3745 - DNA, 23 bp, Artificial Sequence
  HLA-A targeting gRNA
aatgcccacgatggggacagtgg

SEQ ID NO: 3746 - DNA, 23 bp, Artificial Sequence
  HLA-A targeting gRNA
aatgcccacgatggggacggtgg

SEQ ID NO: 3747 - DNA, 23 bp, Artificial Sequence
  HLA-A targeting gRNA
aatgcccacgatggggatggtgg

SEQ ID NO: 3748 - DNA, 23 bp, Artificial Sequence
  HLA-A targeting gRNA
aatggacaggacacctggggtgg

SEQ ID NO: 3749 - DNA, 23 bp, Artificial Sequence
  HLA-A targeting gRNA
aatggacaggacacctggtgtgg

SEQ ID NO: 3750 - DNA, 23 bp, Artificial Sequence
  HLA-A targeting gRNA
aatggacgggacacctggggtgg

SEQ ID NO: 3751 - DNA, 23 bp, Artificial Sequence
  HLA-A targeting gRNA
aatgggcaggacacctggggtgg

SEQ ID NO: 3752 - DNA, 23 bp, Artificial Sequence
  HLA-A targeting gRNA
aatggggaggcgcagcgttgggg

SEQ ID NO: 3753 - DNA, 23 bp, Artificial Sequence
  HLA-A targeting gRNA
aattcaggacactgagcttgtgg

SEQ ID NO: 3754 - DNA, 23 bp, Artificial Sequence
  HLA-A targeting gRNA
aattgtcctagacagcagagggg

SEQ ID NO: 3755 - DNA, 23 bp, Artificial Sequence
  HLA-A targeting gRNA
aattgtcctagagagaagagggg

SEQ ID NO: 3756 - DNA, 23 bp, Artificial Sequence
  HLA-A targeting gRNA
aattgtcctagagagcagacggg

SEQ ID NO: 3757 - DNA, 23 bp, Artificial Sequence
  HLA-A targeting gRNA
aattgtcctagagagcagagggg

SEQ ID NO: 3758 - DNA, 23 bp, Artificial Sequence
  HLA-A targeting gRNA
aattgtctagagagaagaggggg

SEQ ID NO: 3759 - DNA, 23 bp, Artificial Sequence
  HLA-A targeting gRNA
acacaggggctaacacagcctgg

SEQ ID NO: 3760 - DNA, 23 bp, Artificial Sequence
  HLA-A targeting gRNA
acacaggggctaacgcagactgg

SEQ ID NO: 3761 - DNA, 23 bp, Artificial Sequence
  HLA-A targeting gRNA
acacaggggctaacgcagcctgg

SEQ ID NO: 3762 - DNA, 23 bp, Artificial Sequence
  HLA-A targeting gRNA
acacaggggctaatgcagcctgg

SEQ ID NO: 3763 - DNA, 23 bp, Artificial Sequence
  HLA-A targeting gRNA
acacatgggccatcccagcctgg

SEQ ID NO: 3764 - DNA, 23 bp, Artificial Sequence
  HLA-A targeting gRNA
acacatgtgacaatgaaggacgg

SEQ ID NO: 3765 - DNA, 23 bp, Artificial Sequence
  HLA-A targeting gRNA
acacccagcttgtggagaccagg

SEQ ID NO: 3766 - DNA, 23 bp, Artificial Sequence
  HLA-A targeting gRNA
acaccgagcttgtggagaccagg

SEQ ID NO: 3767 - DNA, 23 bp, Artificial Sequence
  HLA-A targeting gRNA
acacctgggccatcccagcctgg

SEQ ID NO: 3768 - DNA, 23 bp, Artificial Sequence
  HLA-A targeting gRNA
acacgggccgcctcccacttggg

SEQ ID NO: 3769 - DNA, 23 bp, Artificial Sequence
  HLA-A targeting gRNA
acacgtgggccatcccagcctgg

SEQ ID NO: 3770 - DNA, 23 bp, Artificial Sequence
  HLA-A targeting gRNA
acactgacctggcagtgggatgg

SEQ ID NO: 3771 - DNA, 23 bp, Artificial Sequence
  HLA-A targeting gRNA
acactgacctggtagcgggatgg

SEQ ID NO: 3772 - DNA, 23 bp, Artificial Sequence
  HLA-A targeting gRNA
acactgagcttgtggagaccagg

SEQ ID NO: 3773 - DNA, 23 bp, Artificial Sequence
  HLA-A targeting gRNA
acactgatctggcagtgggatgg

SEQ ID NO: 3774 - DNA, 23 bp, Artificial Sequence
  HLA-A targeting gRNA
acagaacccaaacaccagcctgg

SEQ ID NO: 3775 - DNA, 23 bp, Artificial Sequence
  HLA-A targeting gRNA
acagaacccagacaccagcccgg

SEQ ID NO: 3776 - DNA, 23 bp, Artificial Sequence
  HLA-A targeting gRNA
acagaacccagacgccagcctgg

SEQ ID NO: 3777 - DNA, 23 bp, Artificial Sequence
  HLA-A targeting gRNA
acagaccttaggagagcagttgg

SEQ ID NO: 3778 - DNA, 23 bp, Artificial Sequence
  HLA-A targeting gRNA
acagaccttaggagggcagttgg

SEQ ID NO: 3779 - DNA, 23 bp, Artificial Sequence
  HLA-A targeting gRNA
acagcagagggggccctcagagg

SEQ ID NO: 3780 - DNA, 23 bp, Artificial Sequence
  HLA-A targeting gRNA
acagccacgccgcgagtccgagg

SEQ ID NO: 3781 - DNA, 23 bp, Artificial Sequence
  HLA-A targeting gRNA
acagcccctcgtgctgcacatgg

SEQ ID NO: 3782 - DNA, 23 bp, Artificial Sequence
  HLA-A targeting gRNA
acagcgacgccacgagtccgagg

SEQ ID NO: 3783 - DNA, 23 bp, Artificial Sequence
  HLA-A targeting gRNA
acagcgacgccgcgagtccgagg

SEQ ID NO: 3784 - DNA, 23 bp, Artificial Sequence
  HLA-A targeting gRNA
acagcgacgctgcgagtccgagg

SEQ ID NO: 3785 - DNA, 23 bp, Artificial Sequence
  HLA-A targeting gRNA
acagctgtggtggtgccttctgg

SEQ ID NO: 3786 - DNA, 23 bp, Artificial Sequence
  HLA-A targeting gRNA
acaggaacgcagacacattcagg

SEQ ID NO: 3787 - DNA, 23 bp, Artificial Sequence
  HLA-A targeting gRNA
acaggacatttgcttcccacagg

SEQ ID NO: 3788 - DNA, 23 bp, Artificial Sequence
  HLA-A targeting gRNA
acaggacattttcttcccacagg

SEQ ID NO: 3789 - DNA, 23 bp, Artificial Sequence
  HLA-A targeting gRNA
acaggcccaggtctcggtcaggg

SEQ ID NO: 3790 - DNA, 23 bp, Artificial Sequence
  HLA-A targeting gRNA
acagggacacagacacattcagg

SEQ ID NO: 3791 - DNA, 23 bp, Artificial Sequence
  HLA-A targeting gRNA
acagggacgcagacacattcagg

SEQ ID NO: 3792 - DNA, 23 bp, Artificial Sequence
  HLA-A targeting gRNA
acagggcattttcttcccacagg

SEQ ID NO: 3793 - DNA, 23 bp, Artificial Sequence
  HLA-A targeting gRNA
acaggggctaacgcagcctgggg

SEQ ID NO: 3794 - DNA, 23 bp, Artificial Sequence
  HLA-A targeting gRNA
acatctctgaggaaatggagggg

SEQ ID NO: 3795 - DNA, 23 bp, Artificial Sequence
  HLA-A targeting gRNA
acatgccaggtacagcatgaggg

SEQ ID NO: 3796 - DNA, 23 bp, Artificial Sequence
  HLA-A targeting gRNA
acatgccatgtacagcatgaggg

SEQ ID NO: 3797 - DNA, 23 bp, Artificial Sequence
  HLA-A targeting gRNA
accagcccaggtctcggtcaggg

SEQ ID NO: 3798 - DNA, 23 bp, Artificial Sequence
  HLA-A targeting gRNA
accagcggacgcaggcacctggg

SEQ ID NO: 3799 - DNA, 23 bp, Artificial Sequence
  HLA-A targeting gRNA
accagcggatgcaggcacctggg

SEQ ID NO: 3800 - DNA, 23 bp, Artificial Sequence
  HLA-A targeting gRNA
accagtacgcctacgacggcagg

SEQ ID NO: 3801 - DNA, 23 bp, Artificial Sequence
  HLA-A targeting gRNA
accagtcacccacccggactcgg

SEQ ID NO: 3802 - DNA, 23 bp, Artificial Sequence
  HLA-A targeting gRNA
acccaatgggagtgggaaatggg

SEQ ID NO: 3803 - DNA, 23 bp, Artificial Sequence
  HLA-A targeting gRNA
acccaatgggagtgggaagtggg

SEQ ID NO: 3804 - DNA, 23 bp, Artificial Sequence
  HLA-A targeting gRNA
acccaatgggagtgggaattggg

SEQ ID NO: 3805 - DNA, 23 bp, Artificial Sequence
  HLA-A targeting gRNA
acccagacaccagcggacgcagg

SEQ ID NO: 3806 - DNA, 23 bp, Artificial Sequence
  HLA-A targeting gRNA
acccagacaccagcggatgcagg

SEQ ID NO: 3807 - DNA, 23 bp, Artificial Sequence
  HLA-A targeting gRNA
acccagggcccagcacctcaggg

SEQ ID NO: 3808 - DNA, 23 bp, Artificial Sequence
  HLA-A targeting gRNA
accccaacaccataatatcaagg

SEQ ID NO: 3809 - DNA, 23 bp, Artificial Sequence
  HLA-A targeting gRNA
accccacgcacaggccctccagg

SEQ ID NO: 3810 - DNA, 23 bp, Artificial Sequence
  HLA-A targeting gRNA
acccgacacccaatgggagtggg

SEQ ID NO: 3811 - DNA, 23 bp, Artificial Sequence
  HLA-A targeting gRNA
acccgcccaggtctcggtcaggg

SEQ ID NO: 3812 - DNA, 23 bp, Artificial Sequence
  HLA-A targeting gRNA
acccgcggaggaggcgcccgtgg

SEQ ID NO: 3813 - DNA, 23 bp, Artificial Sequence
  HLA-A targeting gRNA
acccgggaagccgcgcagggagg

SEQ ID NO: 3814 - DNA, 23 bp, Artificial Sequence
  HLA-A targeting gRNA
acccggggagccgcgcagggagg

SEQ ID NO: 3815 - DNA, 23 bp, Artificial Sequence
  HLA-A targeting gRNA
acccggggagccgcgccgggagg

SEQ ID NO: 3816 - DNA, 23 bp, Artificial Sequence
  HLA-A targeting gRNA
acccggggagccgcgccggtagg

SEQ ID NO: 3817 - DNA, 23 bp, Artificial Sequence
  HLA-A targeting gRNA
acccggggagcggcgcagggagg

SEQ ID NO: 3818 - DNA, 23 bp, Artificial Sequence
  HLA-A targeting gRNA
accctcatcctgctgctctcggg

SEQ ID NO: 3819 - DNA, 23 bp, Artificial Sequence
  HLA-A targeting gRNA
accctcctcctgctgctctaggg

SEQ ID NO: 3820 - DNA, 23 bp, Artificial Sequence
  HLA-A targeting gRNA
accctcctcctgctgctctcggg

SEQ ID NO: 3821 - DNA, 23 bp, Artificial Sequence
  HLA-A targeting gRNA
accctcctcctgctgctctgggg

SEQ ID NO: 3822 - DNA, 23 bp, Artificial Sequence
  HLA-A targeting gRNA
accctgagatggagtaaggaggg

SEQ ID NO: 3823 - DNA, 23 bp, Artificial Sequence
  HLA-A targeting gRNA
accctgagctggggtaaggaggg

SEQ ID NO: 3824 - DNA, 23 bp, Artificial Sequence
  HLA-A targeting gRNA
accctgaggtgctgggccatggg

SEQ ID NO: 3825 - DNA, 23 bp, Artificial Sequence
  HLA-A targeting gRNA
accggaacacacagatcttcagg

SEQ ID NO: 3826 - DNA, 23 bp, Artificial Sequence
  HLA-A targeting gRNA
accggcccaggtctcgatcaggg

SEQ ID NO: 3827 - DNA, 23 bp, Artificial Sequence
  HLA-A targeting gRNA
accggcccaggtctcggtcaggg

SEQ ID NO: 3828 - DNA, 23 bp, Artificial Sequence
  HLA-A targeting gRNA
accgggctgaccacgggggcggg

SEQ ID NO: 3829 - DNA, 23 bp, Artificial Sequence
  HLA-A targeting gRNA
accggtcatacccgcggaggagg

SEQ ID NO: 3830 - DNA, 23 bp, Artificial Sequence
  HLA-A targeting gRNA
accggtccaggtctcgatcaggg

SEQ ID NO: 3831 - DNA, 23 bp, Artificial Sequence
  HLA-A targeting gRNA
accggtgagtgaccccggcccgg

SEQ ID NO: 3832 - DNA, 23 bp, Artificial Sequence
  HLA-A targeting gRNA
accgtcctcctgctgctctcggg

SEQ ID NO: 3833 - DNA, 23 bp, Artificial Sequence
  HLA-A targeting gRNA
accgtcctcctgctgctctgggg

SEQ ID NO: 3834 - DNA, 23 bp, Artificial Sequence
  HLA-A targeting gRNA
accgtgagtgaccccggcccggg

SEQ ID NO: 3835 - DNA, 23 bp, Artificial Sequence
  HLA-A targeting gRNA
accgtggtggttgtggtgttggg

SEQ ID NO: 3836 - DNA, 23 bp, Artificial Sequence
  HLA-A targeting gRNA
acctcaactgaaaatgaaaccgg

SEQ ID NO: 3837 - DNA, 23 bp, Artificial Sequence
  HLA-A targeting gRNA
acctcaaggagtgggagcctggg

SEQ ID NO: 3838 - DNA, 23 bp, Artificial Sequence
  HLA-A targeting gRNA
acctcatgaagtgggagcctggg

SEQ ID NO: 3839 - DNA, 23 bp, Artificial Sequence
  HLA-A targeting gRNA
acctcatggagagggagcctggg

SEQ ID NO: 3840 - DNA, 23 bp, Artificial Sequence
  HLA-A targeting gRNA
acctcatggagtggaagcctggg

SEQ ID NO: 3841 - DNA, 23 bp, Artificial Sequence
  HLA-A targeting gRNA
acctcatggagtgggaacctggg

SEQ ID NO: 3842 - DNA, 23 bp, Artificial Sequence
  HLA-A targeting gRNA
acctcatggagtgggagactggg

SEQ ID NO: 3843 - DNA, 23 bp, Artificial Sequence
  HLA-A targeting gRNA
acctcccggcgcggctccccggg

SEQ ID NO: 3844 - DNA, 23 bp, Artificial Sequence
  HLA-A targeting gRNA
acctccctgcgccgctccccggg

SEQ ID NO: 3845 - DNA, 23 bp, Artificial Sequence
  HLA-A targeting gRNA
acctccctgcgcggctccccggg

SEQ ID NO: 3846 - DNA, 23 bp, Artificial Sequence
  HLA-A targeting gRNA
acctcgatggttgtggtgttggg

SEQ ID NO: 3847 - DNA, 23 bp, Artificial Sequence
  HLA-A targeting gRNA
acctgagctcctggcggacacgg

SEQ ID NO: 3848 - DNA, 23 bp, Artificial Sequence
  HLA-A targeting gRNA
acctgaggagccgcgccgggagg

SEQ ID NO: 3849 - DNA, 23 bp, Artificial Sequence
  HLA-A targeting gRNA
acctgcgcggctactacaaccgg

SEQ ID NO: 3850 - DNA, 23 bp, Artificial Sequence
  HLA-A targeting gRNA
acctgcgctcctggaccgccggg

SEQ ID NO: 3851 - DNA, 23 bp, Artificial Sequence
  HLA-A targeting gRNA
acctgcgctcctggacgcggcgg

SEQ ID NO: 3852 - DNA, 23 bp, Artificial Sequence
  HLA-A targeting gRNA
acctggagggcctgtgcgtgggg

SEQ ID NO: 3853 - DNA, 23 bp, Artificial Sequence
  HLA-A targeting gRNA
acctggatgatgtgagaccctgg

SEQ ID NO: 3854 - DNA, 23 bp, Artificial Sequence
  HLA-A targeting gRNA
acctgggataatctattcattgg

SEQ ID NO: 3855 - DNA, 23 bp, Artificial Sequence
  HLA-A targeting gRNA
accttaatggttgtggtgttggg

SEQ ID NO: 3856 - DNA, 23 bp, Artificial Sequence
  HLA-A targeting gRNA
accttgatattatggtgttgggg

SEQ ID NO: 3857 - DNA, 23 bp, Artificial Sequence
  HLA-A targeting gRNA
accttgatgattatggtgttggg

SEQ ID NO: 3858 - DNA, 23 bp, Artificial Sequence
  HLA-A targeting gRNA
accttgatggttgtggtgttggg

SEQ ID NO: 3859 - DNA, 23 bp, Artificial Sequence
  HLA-A targeting gRNA
accttggggtggatctcagacgg

SEQ ID NO: 3860 - DNA, 23 bp, Artificial Sequence
  HLA-A targeting gRNA
accttggtggttgtggcgttggg

SEQ ID NO: 3861 - DNA, 23 bp, Artificial Sequence
  HLA-A targeting gRNA
accttggtggttgtggtgttggg

SEQ ID NO: 3862 - DNA, 23 bp, Artificial Sequence
  HLA-A targeting gRNA
acgaagtcccaggccccgggcgg

SEQ ID NO: 3863 - DNA, 23 bp, Artificial Sequence
  HLA-A targeting gRNA
acgaagtcccaggtcccggacgg

SEQ ID NO: 3864 - DNA, 23 bp, Artificial Sequence
  HLA-A targeting gRNA
acgaagtcccaggtcccgggcgg

SEQ ID NO: 3865 - DNA, 23 bp, Artificial Sequence
  HLA-A targeting gRNA
acgaagtcccatgtcccggacgg

SEQ ID NO: 3866 - DNA, 23 bp, Artificial Sequence
  HLA-A targeting gRNA
acgacgccgcgagtccgagaggg

SEQ ID NO: 3867 - DNA, 23 bp, Artificial Sequence
  HLA-A targeting gRNA
acgaggacctgagctcctggcgg

SEQ ID NO: 3868 - DNA, 23 bp, Artificial Sequence
  HLA-A targeting gRNA
acgaggtgcccgcccggcgaggg

SEQ ID NO: 3869 - DNA, 23 bp, Artificial Sequence
  HLA-A targeting gRNA
acgatgtacggctgcgacgtggg

SEQ ID NO: 3870 - DNA, 23 bp, Artificial Sequence
  HLA-A targeting gRNA
acgatgtatggctgcgacatggg

SEQ ID NO: 3871 - DNA, 23 bp, Artificial Sequence
  HLA-A targeting gRNA
acgatgtatggctgcgacctggg

SEQ ID NO: 3872 - DNA, 23 bp, Artificial Sequence
  HLA-A targeting gRNA
acgatgtatggctgcgacgtggg

SEQ ID NO: 3873 - DNA, 23 bp, Artificial Sequence
  HLA-A targeting gRNA
acgcgggtaccaggggcagtggg

SEQ ID NO: 3874 - DNA, 23 bp, Artificial Sequence
  HLA-A targeting gRNA
acgctgcagcgcgcgggtaccgg

SEQ ID NO: 3875 - DNA, 23 bp, Artificial Sequence
  HLA-A targeting gRNA
acggacaggacacctggggtggg

SEQ ID NO: 3876 - DNA, 23 bp, Artificial Sequence
  HLA-A targeting gRNA
acggccgggccgggacatggcgg

SEQ ID NO: 3877 - DNA, 23 bp, Artificial Sequence
  HLA-A targeting gRNA
acggcggtgtagatacctcatgg

SEQ ID NO: 3878 - DNA, 23 bp, Artificial Sequence
  HLA-A targeting gRNA
acgggctgaccacgggggcgggg

SEQ ID NO: 3879 - DNA, 23 bp, Artificial Sequence
  HLA-A targeting gRNA
acggggctgaccacgggggcggg

SEQ ID NO: 3880 - DNA, 23 bp, Artificial Sequence
  HLA-A targeting gRNA
acggggctgaccgcggggccggg

SEQ ID NO: 3881 - DNA, 23 bp, Artificial Sequence
  HLA-A targeting gRNA
acggggctgaccgcggggcctgg

SEQ ID NO: 3882 - DNA, 23 bp, Artificial Sequence
  HLA-A targeting gRNA
acggggctgaccgcgggggcggg

SEQ ID NO: 3883 - DNA, 23 bp, Artificial Sequence
  HLA-A targeting gRNA
acggggctggccgcggggccggg

SEQ ID NO: 3884 - DNA, 23 bp, Artificial Sequence
  HLA-A targeting gRNA
acggtgagtgaccccggcctggg

SEQ ID NO: 3885 - DNA, 23 bp, Artificial Sequence
  HLA-A targeting gRNA
acggtgcccaaggctgctgcagg

SEQ ID NO: 3886 - DNA, 23 bp, Artificial Sequence
  HLA-A targeting gRNA
acggtgctgaccgcggggccggg

SEQ ID NO: 3887 - DNA, 23 bp, Artificial Sequence
  HLA-A targeting gRNA
acggttcccaaggctgctgcagg

SEQ ID NO: 3888 - DNA, 23 bp, Artificial Sequence
  HLA-A targeting gRNA
acgtcatggagtgggagcctggg

SEQ ID NO: 3889 - DNA, 23 bp, Artificial Sequence
  HLA-A targeting gRNA
acgtctctgaggaaatggagggg

SEQ ID NO: 3890 - DNA, 23 bp, Artificial Sequence
  HLA-A targeting gRNA
acgtctctgaggaaatgtagggg

SEQ ID NO: 3891 - DNA, 23 bp, Artificial Sequence
  HLA-A targeting gRNA
acgtgccatatgcagcacgaggg

SEQ ID NO: 3892 - DNA, 23 bp, Artificial Sequence
  HLA-A targeting gRNA
acgtgccatgtgcagcacgaggg

SEQ ID NO: 3893 - DNA, 23 bp, Artificial Sequence
  HLA-A targeting gRNA
acgtgccatgtgcagcatgaggg

SEQ ID NO: 3894 - DNA, 23 bp, Artificial Sequence
  HLA-A targeting gRNA
acgtgccatgttcagcacgaggg

SEQ ID NO: 3895 - DNA, 23 bp, Artificial Sequence
  HLA-A targeting gRNA
acgtgcgtggagtggctccgcgg

SEQ ID NO: 3896 - DNA, 23 bp, Artificial Sequence
  HLA-A targeting gRNA
acgtgggacaggaggaattaggg

SEQ ID NO: 3897 - DNA, 23 bp, Artificial Sequence
  HLA-A targeting gRNA
acgtgggacaggaggaattatgg

SEQ ID NO: 3898 - DNA, 23 bp, Artificial Sequence
  HLA-A targeting gRNA
acgttggacaggaggaattatgg

SEQ ID NO: 3899 - DNA, 23 bp, Artificial Sequence
  HLA-A targeting gRNA
actacaaccagagcgaggccggg

SEQ ID NO: 3900 - DNA, 23 bp, Artificial Sequence
  HLA-A targeting gRNA
actagaactttccaaagaatagg

SEQ ID NO: 3901 - DNA, 23 bp, Artificial Sequence
  HLA-A targeting gRNA
actagaactttccaatgaatagg

SEQ ID NO: 3902 - DNA, 23 bp, Artificial Sequence
  HLA-A targeting gRNA
actagggctctctccggtcgagg

SEQ ID NO: 3903 - DNA, 23 bp, Artificial Sequence
  HLA-A targeting gRNA
actcatgaatgctggaatcaagg

SEQ ID NO: 3904 - DNA, 23 bp, Artificial Sequence
  HLA-A targeting gRNA
actccacacacaggccctccagg

SEQ ID NO: 3905 - DNA, 23 bp, Artificial Sequence
  HLA-A targeting gRNA
actccacacacgtgccctccagg

SEQ ID NO: 3906 - DNA, 23 bp, Artificial Sequence
  HLA-A targeting gRNA
actccacgaacgtgccctccagg

SEQ ID NO: 3907 - DNA, 23 bp, Artificial Sequence
  HLA-A targeting gRNA
actccacgcacagaccctccagg

SEQ ID NO: 3908 - DNA, 23 bp, Artificial Sequence
  HLA-A targeting gRNA
actccacgcacaggccctcccgg

SEQ ID NO: 3909 - DNA, 23 bp, Artificial Sequence
  HLA-A targeting gRNA
actccacgcacgtgcccaccagg

SEQ ID NO: 3910 - DNA, 23 bp, Artificial Sequence
  HLA-A targeting gRNA
actccacgcacgtgtcctccagg

SEQ ID NO: 3911 - DNA, 23 bp, Artificial Sequence
  HLA-A targeting gRNA
actccacgcacgttccctccagg

SEQ ID NO: 3912 - DNA, 23 bp, Artificial Sequence
  HLA-A targeting gRNA
actccacgcactcgccctccagg

SEQ ID NO: 3913 - DNA, 23 bp, Artificial Sequence
  HLA-A targeting gRNA
actccacgcacttgccctccagg

SEQ ID NO: 3914 - DNA, 23 bp, Artificial Sequence
  HLA-A targeting gRNA
actccacgcgcgtgccctccagg

SEQ ID NO: 3915 - DNA, 23 bp, Artificial Sequence
  HLA-A targeting gRNA
actccacgtacgtgccctccagg

SEQ ID NO: 3916 - DNA, 23 bp, Artificial Sequence
  HLA-A targeting gRNA
actccactcacgtgccctccagg

SEQ ID NO: 3917 - DNA, 23 bp, Artificial Sequence
  HLA-A targeting gRNA
actccatgcacgtgccctccagg

SEQ ID NO: 3918 - DNA, 23 bp, Artificial Sequence
  HLA-A targeting gRNA
actcctcatattatgctaacagg

SEQ ID NO: 3919 - DNA, 23 bp, Artificial Sequence
  HLA-A targeting gRNA
actcctccctgtcccctcacagg

SEQ ID NO: 3920 - DNA, 23 bp, Artificial Sequence
  HLA-A targeting gRNA
actcctcgcacaggccctccagg

SEQ ID NO: 3921 - DNA, 23 bp, Artificial Sequence
  HLA-A targeting gRNA
actcgaaacgtcccaatcaaagg

SEQ ID NO: 3922 - DNA, 23 bp, Artificial Sequence
  HLA-A targeting gRNA
actcgaactttccaatgaatagg

SEQ ID NO: 3923 - DNA, 23 bp, Artificial Sequence
  HLA-A targeting gRNA
actctcaggctgcgtgtaagtgg

SEQ ID NO: 3924 - DNA, 23 bp, Artificial Sequence
  HLA-A targeting gRNA
actctcctcctgctgctctcggg

SEQ ID NO: 3925 - DNA, 23 bp, Artificial Sequence
  HLA-A targeting gRNA
actgacctggcagtgggatgggg

SEQ ID NO: 3926 - DNA, 23 bp, Artificial Sequence
  HLA-A targeting gRNA
actgatcatacccgcggaggagg

SEQ ID NO: 3927 - DNA, 23 bp, Artificial Sequence
  HLA-A targeting gRNA
actgatctggcagtgggatgggg

SEQ ID NO: 3928 - DNA, 23 bp, Artificial Sequence
  HLA-A targeting gRNA
actggacatacccgcggaggagg

SEQ ID NO: 3929 - DNA, 23 bp, Artificial Sequence
  HLA-A targeting gRNA
actggccatacccgcggaggagg

SEQ ID NO: 3930 - DNA, 23 bp, Artificial Sequence
  HLA-A targeting gRNA
actgggctgaccacgggggcggg

SEQ ID NO: 3931 - DNA, 23 bp, Artificial Sequence
  HLA-A targeting gRNA
actgggctgaccgcgagggctgg

SEQ ID NO: 3932 - DNA, 23 bp, Artificial Sequence
  HLA-A targeting gRNA
actgggctgaccgcggggccggg

SEQ ID NO: 3933 - DNA, 23 bp, Artificial Sequence
  HLA-A targeting gRNA
actgggctgaccgcgggggcggg

SEQ ID NO: 3934 - DNA, 23 bp, Artificial Sequence
  HLA-A targeting gRNA
actggggaggcgccgcgttgagg

SEQ ID NO: 3935 - DNA, 23 bp, Artificial Sequence
  HLA-A targeting gRNA
actggggaggcgccgcgttgggg

SEQ ID NO: 3936 - DNA, 23 bp, Artificial Sequence
  HLA-A targeting gRNA
actggggctctctccggccgagg

SEQ ID NO: 3937 - DNA, 23 bp, Artificial Sequence
  HLA-A targeting gRNA
actggggctctctccggtcgagg

SEQ ID NO: 3938 - DNA, 23 bp, Artificial Sequence
  HLA-A targeting gRNA
actggtcatacccgcggaggagg

SEQ ID NO: 3939 - DNA, 23 bp, Artificial Sequence
  HLA-A targeting gRNA
actggtcatgcccgcggaggagg

SEQ ID NO: 3940 - DNA, 23 bp, Artificial Sequence
  HLA-A targeting gRNA
actggttatacccgcggaggagg

SEQ ID NO: 3941 - DNA, 23 bp, Artificial Sequence
  HLA-A targeting gRNA
actggttatacccgtggaggagg

SEQ ID NO: 3942 - DNA, 23 bp, Artificial Sequence
  HLA-A targeting gRNA
actggttatgcccacggaggagg

SEQ ID NO: 3943 - DNA, 23 bp, Artificial Sequence
  HLA-A targeting gRNA
actggttatgcccgcggaggagg

SEQ ID NO: 3944 - DNA, 23 bp, Artificial Sequence
  HLA-A targeting gRNA
acttcatggagtgggagcctggg

SEQ ID NO: 3945 - DNA, 23 bp, Artificial Sequence
  HLA-A targeting gRNA
acttcatggagtgggaggctggg

SEQ ID NO: 3946 - DNA, 23 bp, Artificial Sequence
  HLA-A targeting gRNA
acttctgctcccgatctgagtgg

SEQ ID NO: 3947 - DNA, 23 bp, Artificial Sequence
  HLA-A targeting gRNA
acttctgctcctgatctaagtgg

SEQ ID NO: 3948 - DNA, 23 bp, Artificial Sequence
  HLA-A targeting gRNA
acttctgctcctgatctgagtgg

SEQ ID NO: 3949 - DNA, 23 bp, Artificial Sequence
  HLA-A targeting gRNA
acttctgttcctgatctgagtgg

SEQ ID NO: 3950 - DNA, 23 bp, Artificial Sequence
  HLA-A targeting gRNA
acttcttctcccaacttgtgggg

SEQ ID NO: 3951 - DNA, 23 bp, Artificial Sequence
  HLA-A targeting gRNA
acttgtaaaggtgagattctggg

SEQ ID NO: 3952 - DNA, 23 bp, Artificial Sequence
  HLA-A targeting gRNA
acttgtggggtccttcttccagg

SEQ ID NO: 3953 - DNA, 23 bp, Artificial Sequence
  HLA-A targeting gRNA
actttacctccactcagatcagg

SEQ ID NO: 3954 - DNA, 23 bp, Artificial Sequence
  HLA-A targeting gRNA
actttacctccactcagatcggg

SEQ ID NO: 3955 - DNA, 23 bp, Artificial Sequence
  HLA-A targeting gRNA
actttacctccacttagatcagg

SEQ ID NO: 3956 - DNA, 23 bp, Artificial Sequence
  HLA-A targeting gRNA
actttacctctactcagatcagg

SEQ ID NO: 3957 - DNA, 23 bp, Artificial Sequence
  HLA-A targeting gRNA
agaacaaggcctgagaggaaagg

SEQ ID NO: 3958 - DNA, 23 bp, Artificial Sequence
  HLA-A targeting gRNA
agaacctggccccgcccccgtgg

SEQ ID NO: 3959 - DNA, 23 bp, Artificial Sequence
  HLA-A targeting gRNA
agaacctggccccggccccgcgg

SEQ ID NO: 3960 - DNA, 23 bp, Artificial Sequence
  HLA-A targeting gRNA
agaacgaggacctgcgctcctgg

SEQ ID NO: 3961 - DNA, 23 bp, Artificial Sequence
  HLA-A targeting gRNA
agaactacgactgcagacccagg

SEQ ID NO: 3962 - DNA, 23 bp, Artificial Sequence
  HLA-A targeting gRNA
agaactatgactgcagacccagg

SEQ ID NO: 3963 - DNA, 23 bp, Artificial Sequence
  HLA-A targeting gRNA
agaagccaatcagcgtcgccggg

SEQ ID NO: 3964 - DNA, 23 bp, Artificial Sequence
  HLA-A targeting gRNA
agaagccaatcagtgtcgccggg

SEQ ID NO: 3965 - DNA, 23 bp, Artificial Sequence
  HLA-A targeting gRNA
agaaggacccgacacaagttggg

SEQ ID NO: 3966 - DNA, 23 bp, Artificial Sequence
  HLA-A targeting gRNA
agaaggacccgacacaggttggg

SEQ ID NO: 3967 - DNA, 23 bp, Artificial Sequence
  HLA-A targeting gRNA
agaaggacccgacataggttggg

SEQ ID NO: 3968 - DNA, 23 bp, Artificial Sequence
  HLA-A targeting gRNA
agaaggacccgacgcaggttggg

SEQ ID NO: 3969 - DNA, 23 bp, Artificial Sequence
  HLA-A targeting gRNA
agaaggacccgtcgcaggttggg

SEQ ID NO: 3970 - DNA, 23 bp, Artificial Sequence
  HLA-A targeting gRNA
agaaggaggggccggagtattgg

SEQ ID NO: 3971 - DNA, 23 bp, Artificial Sequence
  HLA-A targeting gRNA
agaagtatgactacagacccagg

SEQ ID NO: 3972 - DNA, 23 bp, Artificial Sequence
  HLA-A targeting gRNA
agaagtcccaggtcccgggcggg

SEQ ID NO: 3973 - DNA, 23 bp, Artificial Sequence
  HLA-A targeting gRNA
agaagtgaaactcagggaagtgg

SEQ ID NO: 3974 - DNA, 23 bp, Artificial Sequence
  HLA-A targeting gRNA
agaagtgaaactcaggggagtgg

SEQ ID NO: 3975 - DNA, 23 bp, Artificial Sequence
  HLA-A targeting gRNA
agaagtgaaactcgtgggagtgg

SEQ ID NO: 3976 - DNA, 23 bp, Artificial Sequence
  HLA-A targeting gRNA
agaagtgaaactcttgggagtgg

SEQ ID NO: 3977 - DNA, 23 bp, Artificial Sequence
  HLA-A targeting gRNA
agacaccgagatgcgggtcacgg

SEQ ID NO: 3978 - DNA, 23 bp, Artificial Sequence
  HLA-A targeting gRNA
agacactgagagccccgtccggg

SEQ ID NO: 3979 - DNA, 23 bp, Artificial Sequence
  HLA-A targeting gRNA
agacactttgcatctctcttggg

SEQ ID NO: 3980 - DNA, 23 bp, Artificial Sequence
  HLA-A targeting gRNA
agacagaaccttccagaagtggg

SEQ ID NO: 3981 - DNA, 23 bp, Artificial Sequence
  HLA-A targeting gRNA
agacccagagagccccgcccggg

SEQ ID NO: 3982 - DNA, 23 bp, Artificial Sequence
  HLA-A targeting gRNA
agacccctgatcagtattccagg

SEQ ID NO: 3983 - DNA, 23 bp, Artificial Sequence
  HLA-A targeting gRNA
agaccctgagaaccccgcccggg

SEQ ID NO: 3984 - DNA, 23 bp, Artificial Sequence
  HLA-A targeting gRNA
agaccctgagagccccgcccggg

SEQ ID NO: 3985 - DNA, 23 bp, Artificial Sequence
  HLA-A targeting gRNA
agaccctgagagccccgtccggg

SEQ ID NO: 3986 - DNA, 23 bp, Artificial Sequence
  HLA-A targeting gRNA
agaccctggcccagccctcgcgg

SEQ ID NO: 3987 - DNA, 23 bp, Artificial Sequence
  HLA-A targeting gRNA
agaccctggcccaggccccgcgg

SEQ ID NO: 3988 - DNA, 23 bp, Artificial Sequence
  HLA-A targeting gRNA
agaccctggccccgcccccgcgg

SEQ ID NO: 3989 - DNA, 23 bp, Artificial Sequence
  HLA-A targeting gRNA
agaccctggccccgcccccgtgg

SEQ ID NO: 3990 - DNA, 23 bp, Artificial Sequence
  HLA-A targeting gRNA
agaccctggccccggccccgcgg

SEQ ID NO: 3991 - DNA, 23 bp, Artificial Sequence
  HLA-A targeting gRNA
agaccctggcctaggccccgcgg

SEQ ID NO: 3992 - DNA, 23 bp, Artificial Sequence
  HLA-A targeting gRNA
agacctggaccggtgagtgcggg

SEQ ID NO: 3993 - DNA, 23 bp, Artificial Sequence
  HLA-A targeting gRNA
agacctgggccggtgagtgcggg

SEQ ID NO: 3994 - DNA, 23 bp, Artificial Sequence
  HLA-A targeting gRNA
agacctgggcctgtgagtgcggg

SEQ ID NO: 3995 - DNA, 23 bp, Artificial Sequence
  HLA-A targeting gRNA
agacctgggctggtgagtgcggg

SEQ ID NO: 3996 - DNA, 23 bp, Artificial Sequence
  HLA-A targeting gRNA
agacgaagcggggctctccgcgg

SEQ ID NO: 3997 - DNA, 23 bp, Artificial Sequence
  HLA-A targeting gRNA
agacgccaagatgctggtcatgg

SEQ ID NO: 3998 - DNA, 23 bp, Artificial Sequence
  HLA-A targeting gRNA
agacgccgagatgcgggtcacgg

SEQ ID NO: 3999 - DNA, 23 bp, Artificial Sequence
  HLA-A targeting gRNA
agacgccgagatgcgggtcatgg

SEQ ID NO: 4000 - DNA, 23 bp, Artificial Sequence
  HLA-A targeting gRNA
agacgccgagatgctggtcatgg

SEQ ID NO: 4001 - DNA, 23 bp, Artificial Sequence
  HLA-A targeting gRNA
agacggatgtatcaccttaatgg

SEQ ID NO: 4002 - DNA, 23 bp, Artificial Sequence
  HLA-A targeting gRNA
agacggctccgggaaaggaaggg

SEQ ID NO: 4003 - DNA, 23 bp, Artificial Sequence
  HLA-A targeting gRNA
agacggctctgggaaaggaaggg

SEQ ID NO: 4004 - DNA, 23 bp, Artificial Sequence
  HLA-A targeting gRNA
agacggctctgggaaaggagggg

SEQ ID NO: 4005 - DNA, 23 bp, Artificial Sequence
  HLA-A targeting gRNA
agactgaccgaatgaacctgcgg

SEQ ID NO: 4006 - DNA, 23 bp, Artificial Sequence
  HLA-A targeting gRNA
agactgaccgagaggacctgcgg

SEQ ID NO: 4007 - DNA, 23 bp, Artificial Sequence
  HLA-A targeting gRNA
agactgaccgagtgaacctgcgg

SEQ ID NO: 4008 - DNA, 23 bp, Artificial Sequence
  HLA-A targeting gRNA
agactgaccgagtgagcctgcgg

SEQ ID NO: 4009 - DNA, 23 bp, Artificial Sequence
  HLA-A targeting gRNA
agactgaccgagtgggcctgcgg

SEQ ID NO: 4010 - DNA, 23 bp, Artificial Sequence
  HLA-A targeting gRNA
agactgacggagagagcctgcgg

SEQ ID NO: 4011 - DNA, 23 bp, Artificial Sequence
  HLA-A targeting gRNA
agacttaacgagagagcctgcgg

SEQ ID NO: 4012 - DNA, 23 bp, Artificial Sequence
  HLA-A targeting gRNA
agacttaccgagagaacctgagg

SEQ ID NO: 4013 - DNA, 23 bp, Artificial Sequence
  HLA-A targeting gRNA
agacttaccgagagaacctgcgg

SEQ ID NO: 4014 - DNA, 23 bp, Artificial Sequence
  HLA-A targeting gRNA
agacttaccgagagagcctgcgg

SEQ ID NO: 4015 - DNA, 23 bp, Artificial Sequence
  HLA-A targeting gRNA
agacttaccgagaggacctgcgg

SEQ ID NO: 4016 - DNA, 23 bp, Artificial Sequence
  HLA-A targeting gRNA
agagaaagcagaagtccttctgg

SEQ ID NO: 4017 - DNA, 23 bp, Artificial Sequence
  HLA-A targeting gRNA
agagaacccagacgccagcctgg

SEQ ID NO: 4018 - DNA, 23 bp, Artificial Sequence
  HLA-A targeting gRNA
agagaagagggggccctcagagg

SEQ ID NO: 4019 - DNA, 23 bp, Artificial Sequence
  HLA-A targeting gRNA
agagagccccgcccgggacctgg

SEQ ID NO: 4020 - DNA, 23 bp, Artificial Sequence
  HLA-A targeting gRNA
agagaggggaccgcaggcggggg

SEQ ID NO: 4021 - DNA, 23 bp, Artificial Sequence
  HLA-A targeting gRNA
agagcaccgcttcatctcagtgg

SEQ ID NO: 4022 - DNA, 23 bp, Artificial Sequence
  HLA-A targeting gRNA
agagcagacggggccctcagagg

SEQ ID NO: 4023 - DNA, 23 bp, Artificial Sequence
  HLA-A targeting gRNA
agagcagagatacacatgccagg

SEQ ID NO: 4024 - DNA, 23 bp, Artificial Sequence
  HLA-A targeting gRNA
agagcagagggggccctcagagg

SEQ ID NO: 4025 - DNA, 23 bp, Artificial Sequence
  HLA-A targeting gRNA
agagcagcaggaggacggttcgg

SEQ ID NO: 4026 - DNA, 23 bp, Artificial Sequence
  HLA-A targeting gRNA
agagcagcaggaggagagttcgg

SEQ ID NO: 4027 - DNA, 23 bp, Artificial Sequence
  HLA-A targeting gRNA
agagcagcaggaggagggctcgg

SEQ ID NO: 4028 - DNA, 23 bp, Artificial Sequence
  HLA-A targeting gRNA
agagcagcaggaggagggcttgg

SEQ ID NO: 4029 - DNA, 23 bp, Artificial Sequence
  HLA-A targeting gRNA
agagcagcaggaggagggttcgg

SEQ ID NO: 4030 - DNA, 23 bp, Artificial Sequence
  HLA-A targeting gRNA
agagcagcaggatgagggttcgg

SEQ ID NO: 4031 - DNA, 23 bp, Artificial Sequence
  HLA-A targeting gRNA
agagccccaaacactgagtgtgg

SEQ ID NO: 4032 - DNA, 23 bp, Artificial Sequence
  HLA-A targeting gRNA
agagccccacttcatcgcagtgg

SEQ ID NO: 4033 - DNA, 23 bp, Artificial Sequence
  HLA-A targeting gRNA
agagccccgcttcatctcagtgg

SEQ ID NO: 4034 - DNA, 23 bp, Artificial Sequence
  HLA-A targeting gRNA
agagccccgcttcgtctcagtgg

SEQ ID NO: 4035 - DNA, 23 bp, Artificial Sequence
  HLA-A targeting gRNA
agagcccctcaccctgagatggg

SEQ ID NO: 4036 - DNA, 23 bp, Artificial Sequence
  HLA-A targeting gRNA
agagcccctcaccctgagctggg

SEQ ID NO: 4037 - DNA, 23 bp, Artificial Sequence
  HLA-A targeting gRNA
agagccctgggcactgtcgctgg

SEQ ID NO: 4038 - DNA, 23 bp, Artificial Sequence
  HLA-A targeting gRNA
agagccctgggcactgttgctgg

SEQ ID NO: 4039 - DNA, 23 bp, Artificial Sequence
  HLA-A targeting gRNA
agagctcaggtggaaaaggaggg

SEQ ID NO: 4040 - DNA, 23 bp, Artificial Sequence
  HLA-A targeting gRNA
agaggaacgaggtgcccgcccgg

SEQ ID NO: 4041 - DNA, 23 bp, Artificial Sequence
  HLA-A targeting gRNA
agaggagccgcgggcgccgtggg

SEQ ID NO: 4042 - DNA, 23 bp, Artificial Sequence
  HLA-A targeting gRNA
agaggagcgaggggcccgcccgg

SEQ ID NO: 4043 - DNA, 23 bp, Artificial Sequence
  HLA-A targeting gRNA
agaggagcgaggggccctcccgg

SEQ ID NO: 4044 - DNA, 23 bp, Artificial Sequence
  HLA-A targeting gRNA
agaggagggaggggccctcccgg

SEQ ID NO: 4045 - DNA, 23 bp, Artificial Sequence
  HLA-A targeting gRNA
agaggcccttgaagtcacaaagg

SEQ ID NO: 4046 - DNA, 23 bp, Artificial Sequence
  HLA-A targeting gRNA
agaggccgagatgcgggtcatgg

SEQ ID NO: 4047 - DNA, 23 bp, Artificial Sequence
  HLA-A targeting gRNA
agaggctcttgaagtcacaaagg

SEQ ID NO: 4048 - DNA, 23 bp, Artificial Sequence
  HLA-A targeting gRNA
agagtaagtgctagcacacaggg

SEQ ID NO: 4049 - DNA, 23 bp, Artificial Sequence
  HLA-A targeting gRNA
agagtaagttctggcacacaggg

SEQ ID NO: 4050 - DNA, 23 bp, Artificial Sequence
  HLA-A targeting gRNA
agagtcccgcttcatctcagtgg

SEQ ID NO: 4051 - DNA, 23 bp, Artificial Sequence
  HLA-A targeting gRNA
agagtgggcaggggggtggtggg

SEQ ID NO: 4052 - DNA, 23 bp, Artificial Sequence
  HLA-A targeting gRNA
agagtgggcggggggggggtggg

SEQ ID NO: 4053 - DNA, 23 bp, Artificial Sequence
  HLA-A targeting gRNA
agagtgggcgggggggggtgggg

SEQ ID NO: 4054 - DNA, 23 bp, Artificial Sequence
  HLA-A targeting gRNA
agagtgggcggggggggtggtgg

SEQ ID NO: 4055 - DNA, 23 bp, Artificial Sequence
  HLA-A targeting gRNA
agagtgtgagaccctggccccgg

SEQ ID NO: 4056 - DNA, 23 bp, Artificial Sequence
  HLA-A targeting gRNA
agatagaaccttccagaagtggg

SEQ ID NO: 4057 - DNA, 23 bp, Artificial Sequence
  HLA-A targeting gRNA
agatcacactgacctggcagtgg

SEQ ID NO: 4058 - DNA, 23 bp, Artificial Sequence
  HLA-A targeting gRNA
agatcacactgacctggtagcgg

SEQ ID NO: 4059 - DNA, 23 bp, Artificial Sequence
  HLA-A targeting gRNA
agatcacactgatctggcagtgg

SEQ ID NO: 4060 - DNA, 23 bp, Artificial Sequence
  HLA-A targeting gRNA
agatcagtgtgatctccgcaggg

SEQ ID NO: 4061 - DNA, 23 bp, Artificial Sequence
  HLA-A targeting gRNA
agatccgcccccgaggccgcggg

SEQ ID NO: 4062 - DNA, 23 bp, Artificial Sequence
  HLA-A targeting gRNA
agatccgccccctgaggccgcgg

SEQ ID NO: 4063 - DNA, 23 bp, Artificial Sequence
  HLA-A targeting gRNA
agatctacaggagatagggaagg

SEQ ID NO: 4064 - DNA, 23 bp, Artificial Sequence
  HLA-A targeting gRNA
agatctacaggagatggggaagg

SEQ ID NO: 4065 - DNA, 23 bp, Artificial Sequence
  HLA-A targeting gRNA
agatctacgggagatggggaagg

SEQ ID NO: 4066 - DNA, 23 bp, Artificial Sequence
  HLA-A targeting gRNA
agatctataggagatggggaagg

SEQ ID NO: 4067 - DNA, 23 bp, Artificial Sequence
  HLA-A targeting gRNA
agatgaagcgggactctccgcgg

SEQ ID NO: 4068 - DNA, 23 bp, Artificial Sequence
  HLA-A targeting gRNA
agatgaagcggggctccccgcgg

SEQ ID NO: 4069 - DNA, 23 bp, Artificial Sequence
  HLA-A targeting gRNA
agatgaagcggggctctccgcgg

SEQ ID NO: 4070 - DNA, 23 bp, Artificial Sequence
  HLA-A targeting gRNA
agatgaagcggtgctctccgcgg

SEQ ID NO: 4071 - DNA, 23 bp, Artificial Sequence
  HLA-A targeting gRNA
agatggaaccttccagaagtggg

SEQ ID NO: 4072 - DNA, 23 bp, Artificial Sequence
  HLA-A targeting gRNA
agatggccctgggaaaggagggg

SEQ ID NO: 4073 - DNA, 23 bp, Artificial Sequence
  HLA-A targeting gRNA
agatggctctgggaaaggagggg

SEQ ID NO: 4074 - DNA, 23 bp, Artificial Sequence
  HLA-A targeting gRNA
agattacatcgccctgaacgagg

SEQ ID NO: 4075 - DNA, 23 bp, Artificial Sequence
  HLA-A targeting gRNA
agattcttggggtctagagtggg

SEQ ID NO: 4076 - DNA, 23 bp, Artificial Sequence
  HLA-A targeting gRNA
agcaagaggggccggagtattgg

SEQ ID NO: 4077 - DNA, 23 bp, Artificial Sequence
  HLA-A targeting gRNA
agcaaggggaccgcaggcggggg

SEQ ID NO: 4078 - DNA, 23 bp, Artificial Sequence
  HLA-A targeting gRNA
agcacacagggtcccaggctggg

SEQ ID NO: 4079 - DNA, 23 bp, Artificial Sequence
  HLA-A targeting gRNA
agcacagggcccagcacctcagg

SEQ ID NO: 4080 - DNA, 23 bp, Artificial Sequence
  HLA-A targeting gRNA
agcacctcagggtgacctcatgg

SEQ ID NO: 4081 - DNA, 23 bp, Artificial Sequence
  HLA-A targeting gRNA
agcagcaggaggacggttcgggg

SEQ ID NO: 4082 - DNA, 23 bp, Artificial Sequence
  HLA-A targeting gRNA
agcagcaggaggagagttcgggg

SEQ ID NO: 4083 - DNA, 23 bp, Artificial Sequence
  HLA-A targeting gRNA
agcagcaggaggagggctcgggg

SEQ ID NO: 4084 - DNA, 23 bp, Artificial Sequence
  HLA-A targeting gRNA
agcagcaggaggagggcttgggg

SEQ ID NO: 4085 - DNA, 23 bp, Artificial Sequence
  HLA-A targeting gRNA
agcagcaggaggagggttcgggg

SEQ ID NO: 4086 - DNA, 23 bp, Artificial Sequence
  HLA-A targeting gRNA
agcagcaggatgagggttcaggg

SEQ ID NO: 4087 - DNA, 23 bp, Artificial Sequence
  HLA-A targeting gRNA
agcagcaggatgagggttcgggg

SEQ ID NO: 4088 - DNA, 23 bp, Artificial Sequence
  HLA-A targeting gRNA
agcaggaggggccagagtattgg

SEQ ID NO: 4089 - DNA, 23 bp, Artificial Sequence
  HLA-A targeting gRNA
agcaggaggggccggaatattgg

SEQ ID NO: 4090 - DNA, 23 bp, Artificial Sequence
  HLA-A targeting gRNA
agcaggaggggccggagcattgg

SEQ ID NO: 4091 - DNA, 23 bp, Artificial Sequence
  HLA-A targeting gRNA
agcaggaggggccggagtactgg

SEQ ID NO: 4092 - DNA, 23 bp, Artificial Sequence
  HLA-A targeting gRNA
agcaggaggggccggagtgttgg

SEQ ID NO: 4093 - DNA, 23 bp, Artificial Sequence
  HLA-A targeting gRNA
agcaggaggggctggagtattgg

SEQ ID NO: 4094 - DNA, 23 bp, Artificial Sequence
  HLA-A targeting gRNA
agcaggaggtgccggaggattgg

SEQ ID NO: 4095 - DNA, 23 bp, Artificial Sequence
  HLA-A targeting gRNA
agcatgtacggctgcgacctggg

SEQ ID NO: 4096 - DNA, 23 bp, Artificial Sequence
  HLA-A targeting gRNA
agcatgtacggctgcgacgtggg

SEQ ID NO: 4097 - DNA, 23 bp, Artificial Sequence
  HLA-A targeting gRNA
agcatgtatggctgcgacgtggg

SEQ ID NO: 4098 - DNA, 23 bp, Artificial Sequence
  HLA-A targeting gRNA
agcattcatgagtcaggggaagg

SEQ ID NO: 4099 - DNA, 23 bp, Artificial Sequence
  HLA-A targeting gRNA
agcattcatgagtcgggggaagg

SEQ ID NO: 4100 - DNA, 23 bp, Artificial Sequence
  HLA-A targeting gRNA
agcattcgtgagtcaggggaagg

SEQ ID NO: 4101 - DNA, 23 bp, Artificial Sequence
  HLA-A targeting gRNA
agccactccacaggtatctgcgg

SEQ ID NO: 4102 - DNA, 23 bp, Artificial Sequence
  HLA-A targeting gRNA
agccatggatagagcaggagggg

SEQ ID NO: 4103 - DNA, 23 bp, Artificial Sequence
  HLA-A targeting gRNA
agcccatggcccagcacctcagg

SEQ ID NO: 4104 - DNA, 23 bp, Artificial Sequence
  HLA-A targeting gRNA
agccccaaacactgagtgtgggg

SEQ ID NO: 4105 - DNA, 23 bp, Artificial Sequence
  HLA-A targeting gRNA
agcccctcctgctctatccatgg

SEQ ID NO: 4106 - DNA, 23 bp, Artificial Sequence
  HLA-A targeting gRNA
agccctcctcctgctgctctcgg

SEQ ID NO: 4107 - DNA, 23 bp, Artificial Sequence
  HLA-A targeting gRNA
agccgcctcccacttgcgctggg

SEQ ID NO: 4108 - DNA, 23 bp, Artificial Sequence
  HLA-A targeting gRNA
agccgcgcagggaggagggtcgg

SEQ ID NO: 4109 - DNA, 23 bp, Artificial Sequence
  HLA-A targeting gRNA
agccgcgcagggaggtgggtcgg

SEQ ID NO: 4110 - DNA, 23 bp, Artificial Sequence
  HLA-A targeting gRNA
agccgcgccgggaggtgggtcgg

SEQ ID NO: 4111 - DNA, 23 bp, Artificial Sequence
  HLA-A targeting gRNA
agccgcgccggtaggagggtcgg

SEQ ID NO: 4112 - DNA, 23 bp, Artificial Sequence
  HLA-A targeting gRNA
agccgtggatggagcaggagggg

SEQ ID NO: 4113 - DNA, 23 bp, Artificial Sequence
  HLA-A targeting gRNA
agccgtgggtggagcaggagggg

SEQ ID NO: 4114 - DNA, 23 bp, Artificial Sequence
  HLA-A targeting gRNA
agcgaccccgcgagtccgagagg

SEQ ID NO: 4115 - DNA, 23 bp, Artificial Sequence
  HLA-A targeting gRNA
agcgacgccgcaagtccgagagg

SEQ ID NO: 4116 - DNA, 23 bp, Artificial Sequence
  HLA-A targeting gRNA
agcgacgccgcgagtccaagagg

SEQ ID NO: 4117 - DNA, 23 bp, Artificial Sequence
  HLA-A targeting gRNA
agcgacgccgcgagtccgagagg

SEQ ID NO: 4118 - DNA, 23 bp, Artificial Sequence
  HLA-A targeting gRNA
agcgacgccgcgagtccgagggg

SEQ ID NO: 4119 - DNA, 23 bp, Artificial Sequence
  HLA-A targeting gRNA
agcgactccgcgagtccaagagg

SEQ ID NO: 4120 - DNA, 23 bp, Artificial Sequence
  HLA-A targeting gRNA
agcgaggggaccgcaggcggggg

SEQ ID NO: 4121 - DNA, 23 bp, Artificial Sequence
  HLA-A targeting gRNA
agcgaggggcccgcccggcgagg

SEQ ID NO: 4122 - DNA, 23 bp, Artificial Sequence
  HLA-A targeting gRNA
agcgaggggccctcccggcgagg

SEQ ID NO: 4123 - DNA, 23 bp, Artificial Sequence
  HLA-A targeting gRNA
agcgcaagtgggaggcggcccgg

SEQ ID NO: 4124 - DNA, 23 bp, Artificial Sequence
  HLA-A targeting gRNA
agcgcgggtaccaggggcagtgg

SEQ ID NO: 4125 - DNA, 23 bp, Artificial Sequence
  HLA-A targeting gRNA
agcggcctctgcggagaggaggg

SEQ ID NO: 4126 - DNA, 23 bp, Artificial Sequence
  HLA-A targeting gRNA
agcggcgcagggaggagggtcgg

SEQ ID NO: 4127 - DNA, 23 bp, Artificial Sequence
  HLA-A targeting gRNA
agcggcgcagggaggtgggtcgg

SEQ ID NO: 4128 - DNA, 23 bp, Artificial Sequence
  HLA-A targeting gRNA
agcggtgtagaaatacctcatgg

SEQ ID NO: 4129 - DNA, 23 bp, Artificial Sequence
  HLA-A targeting gRNA
agcggtgtagaaatacttcatgg

SEQ ID NO: 4130 - DNA, 23 bp, Artificial Sequence
  HLA-A targeting gRNA
agctacgccgcgagtccaagagg

SEQ ID NO: 4131 - DNA, 23 bp, Artificial Sequence
  HLA-A targeting gRNA
agctcaggtagggaaggggtggg

SEQ ID NO: 4132 - DNA, 23 bp, Artificial Sequence
  HLA-A targeting gRNA
agctgaagtggtcgggggtgggg

SEQ ID NO: 4133 - DNA, 23 bp, Artificial Sequence
  HLA-A targeting gRNA
agctgaagtggtctggggtgggg

SEQ ID NO: 4134 - DNA, 23 bp, Artificial Sequence
  HLA-A targeting gRNA
agctgccgcagtggtcaaagtgg

SEQ ID NO: 4135 - DNA, 23 bp, Artificial Sequence
  HLA-A targeting gRNA
agctgccgcagtggtcgaagtgg

SEQ ID NO: 4136 - DNA, 23 bp, Artificial Sequence
  HLA-A targeting gRNA
agctgctgcagtggtcaaagtgg

SEQ ID NO: 4137 - DNA, 23 bp, Artificial Sequence
  HLA-A targeting gRNA
agctggagcgcgctggtaccagg

SEQ ID NO: 4138 - DNA, 23 bp, Artificial Sequence
  HLA-A targeting gRNA
agctggggtaaggaggggaatgg

SEQ ID NO: 4139 - DNA, 23 bp, Artificial Sequence
  HLA-A targeting gRNA
agctgtcctaggagctatggtgg

SEQ ID NO: 4140 - DNA, 23 bp, Artificial Sequence
  HLA-A targeting gRNA
agctgtcctaggagctgtgatgg

SEQ ID NO: 4141 - DNA, 23 bp, Artificial Sequence
  HLA-A targeting gRNA
agctgtcctaggagctgtggtgg

SEQ ID NO: 4142 - DNA, 23 bp, Artificial Sequence
  HLA-A targeting gRNA
agcttgtacggctgcgacgtggg

SEQ ID NO: 4143 - DNA, 23 bp, Artificial Sequence
  HLA-A targeting gRNA
aggaaaagtcacggtgcccaagg

SEQ ID NO: 4144 - DNA, 23 bp, Artificial Sequence
  HLA-A targeting gRNA
aggaaaagtcacggttcccaagg

SEQ ID NO: 4145 - DNA, 23 bp, Artificial Sequence
  HLA-A targeting gRNA
aggaaaagtcatggttcccaagg

SEQ ID NO: 4146 - DNA, 23 bp, Artificial Sequence
  HLA-A targeting gRNA
aggaaagcaagtgtgggtcctgg

SEQ ID NO: 4147 - DNA, 23 bp, Artificial Sequence
  HLA-A targeting gRNA
aggaaaggtcacggttcccaagg

SEQ ID NO: 4148 - DNA, 23 bp, Artificial Sequence
  HLA-A targeting gRNA
aggaacgcagatcctcgttcagg

SEQ ID NO: 4149 - DNA, 23 bp, Artificial Sequence
  HLA-A targeting gRNA
aggaagagctcaggtagggaagg

SEQ ID NO: 4150 - DNA, 23 bp, Artificial Sequence
  HLA-A targeting gRNA
aggaagagctcaggtggaaaagg

SEQ ID NO: 4151 - DNA, 23 bp, Artificial Sequence
  HLA-A targeting gRNA
aggaagagttcaggtagggaagg

SEQ ID NO: 4152 - DNA, 23 bp, Artificial Sequence
  HLA-A targeting gRNA
aggaagagttctggtagggaagg

SEQ ID NO: 4153 - DNA, 23 bp, Artificial Sequence
  HLA-A targeting gRNA
aggacacctggggtagggaaggg

SEQ ID NO: 4154 - DNA, 23 bp, Artificial Sequence
  HLA-A targeting gRNA
aggacacctggggtggggaaggg

SEQ ID NO: 4155 - DNA, 23 bp, Artificial Sequence
  HLA-A targeting gRNA
aggacacctggtgtggggaaggg

SEQ ID NO: 4156 - DNA, 23 bp, Artificial Sequence
  HLA-A targeting gRNA
aggacccgggaagccgcgcaggg

SEQ ID NO: 4157 - DNA, 23 bp, Artificial Sequence
  HLA-A targeting gRNA
aggacccggggagccgcgcaggg

SEQ ID NO: 4158 - DNA, 23 bp, Artificial Sequence
  HLA-A targeting gRNA
aggacccggggagccgcgccggg

SEQ ID NO: 4159 - DNA, 23 bp, Artificial Sequence
  HLA-A targeting gRNA
aggacccggggagcggcgcaggg

SEQ ID NO: 4160 - DNA, 23 bp, Artificial Sequence
  HLA-A targeting gRNA
aggacctgaggagccgcgccggg

SEQ ID NO: 4161 - DNA, 23 bp, Artificial Sequence
  HLA-A targeting gRNA
aggacctgcgctcctggacgcgg

SEQ ID NO: 4162 - DNA, 23 bp, Artificial Sequence
  HLA-A targeting gRNA
aggacctggtcagagcccacagg

SEQ ID NO: 4163 - DNA, 23 bp, Artificial Sequence
  HLA-A targeting gRNA
aggacctggtcagagcccgcagg

SEQ ID NO: 4164 - DNA, 23 bp, Artificial Sequence
  HLA-A targeting gRNA
aggacctggtcagagccctcagg

SEQ ID NO: 4165 - DNA, 23 bp, Artificial Sequence
  HLA-A targeting gRNA
aggacgaagtcccaggccccggg

SEQ ID NO: 4166 - DNA, 23 bp, Artificial Sequence
  HLA-A targeting gRNA
aggacgaagtcccaggtcccggg

SEQ ID NO: 4167 - DNA, 23 bp, Artificial Sequence
  HLA-A targeting gRNA
aggagacccgggccgtacgtcgg

SEQ ID NO: 4168 - DNA, 23 bp, Artificial Sequence
  HLA-A targeting gRNA
aggagactctgagtccgggtggg

SEQ ID NO: 4169 - DNA, 23 bp, Artificial Sequence
  HLA-A targeting gRNA
aggagagaggggaccgcaggcgg

SEQ ID NO: 4170 - DNA, 23 bp, Artificial Sequence
  HLA-A targeting gRNA
aggagattctgagtccgggtggg

SEQ ID NO: 4171 - DNA, 23 bp, Artificial Sequence
  HLA-A targeting gRNA
aggagattttgagtccgggtggg

SEQ ID NO: 4172 - DNA, 23 bp, Artificial Sequence
  HLA-A targeting gRNA
aggagcaaggggaccgcaggcgg

SEQ ID NO: 4173 - DNA, 23 bp, Artificial Sequence
  HLA-A targeting gRNA
aggagccctgcaccctgagatgg

SEQ ID NO: 4174 - DNA, 23 bp, Artificial Sequence
  HLA-A targeting gRNA
aggagcccttcagcagggtcagg

SEQ ID NO: 4175 - DNA, 23 bp, Artificial Sequence
  HLA-A targeting gRNA
aggagcgaggggaccgcaggcgg

SEQ ID NO: 4176 - DNA, 23 bp, Artificial Sequence
  HLA-A targeting gRNA
aggagcgcagatcctcgttcagg

SEQ ID NO: 4177 - DNA, 23 bp, Artificial Sequence
  HLA-A targeting gRNA
aggagcgcaggtcctcattcagg

SEQ ID NO: 4178 - DNA, 23 bp, Artificial Sequence
  HLA-A targeting gRNA
aggagcgcaggtcctcgtccagg

SEQ ID NO: 4179 - DNA, 23 bp, Artificial Sequence
  HLA-A targeting gRNA
aggagcgcaggtcctcgttctgg

SEQ ID NO: 4180 - DNA, 23 bp, Artificial Sequence
  HLA-A targeting gRNA
aggagctcaggtcctcgttcagg

SEQ ID NO: 4181 - DNA, 23 bp, Artificial Sequence
  HLA-A targeting gRNA
aggagcttaggtcctcgttcagg

SEQ ID NO: 4182 - DNA, 23 bp, Artificial Sequence
  HLA-A targeting gRNA
aggaggcgcccgtcgggcccagg

SEQ ID NO: 4183 - DNA, 23 bp, Artificial Sequence
  HLA-A targeting gRNA
aggaggcgcccgtcgggccccgg

SEQ ID NO: 4184 - DNA, 23 bp, Artificial Sequence
  HLA-A targeting gRNA
aggagggcaggtcctcgttcagg

SEQ ID NO: 4185 - DNA, 23 bp, Artificial Sequence
  HLA-A targeting gRNA
aggagtactggttatgcccgcgg

SEQ ID NO: 4186 - DNA, 23 bp, Artificial Sequence
  HLA-A targeting gRNA
aggatgtaaggctgcgacgtggg

SEQ ID NO: 4187 - DNA, 23 bp, Artificial Sequence
  HLA-A targeting gRNA
aggatgtacggctgcgacctggg

SEQ ID NO: 4188 - DNA, 23 bp, Artificial Sequence
  HLA-A targeting gRNA
aggatgtacggctgcgacgtggg

SEQ ID NO: 4189 - DNA, 23 bp, Artificial Sequence
  HLA-A targeting gRNA
aggatgtacggctgggacctggg

SEQ ID NO: 4190 - DNA, 23 bp, Artificial Sequence
  HLA-A targeting gRNA
aggatgtatggctgcgacctggg

SEQ ID NO: 4191 - DNA, 23 bp, Artificial Sequence
  HLA-A targeting gRNA
aggatgtctggctgcgacccggg

SEQ ID NO: 4192 - DNA, 23 bp, Artificial Sequence
  HLA-A targeting gRNA
aggatgtctggctgcgacctggg

SEQ ID NO: 4193 - DNA, 23 bp, Artificial Sequence
  HLA-A targeting gRNA
aggatgtctggctgcgacgtggg

SEQ ID NO: 4194 - DNA, 23 bp, Artificial Sequence
  HLA-A targeting gRNA
aggatgtttggctgcgacctggg

SEQ ID NO: 4195 - DNA, 23 bp, Artificial Sequence
  HLA-A targeting gRNA
aggcaaactggttatgcccgcgg

SEQ ID NO: 4196 - DNA, 23 bp, Artificial Sequence
  HLA-A targeting gRNA
aggcaggatcaggaaacacgagg

SEQ ID NO: 4197 - DNA, 23 bp, Artificial Sequence
  HLA-A targeting gRNA
aggcagggaacacttctacctgg

SEQ ID NO: 4198 - DNA, 23 bp, Artificial Sequence
  HLA-A targeting gRNA
aggcagggccatgcaatcttagg

SEQ ID NO: 4199 - DNA, 23 bp, Artificial Sequence
  HLA-A targeting gRNA
aggcagggccatgcgatcttagg

SEQ ID NO: 4200 - DNA, 23 bp, Artificial Sequence
  HLA-A targeting gRNA
aggcagggccatgtgatcttagg

SEQ ID NO: 4201 - DNA, 23 bp, Artificial Sequence
  HLA-A targeting gRNA
aggcagggccatgtgattttagg

SEQ ID NO: 4202 - DNA, 23 bp, Artificial Sequence
  HLA-A targeting gRNA
aggcatactgctcatacccgcgg

SEQ ID NO: 4203 - DNA, 23 bp, Artificial Sequence
  HLA-A targeting gRNA
aggccaaaatccccgcgggttgg

SEQ ID NO: 4204 - DNA, 23 bp, Artificial Sequence
  HLA-A targeting gRNA
aggccatcccgggagatctacgg

SEQ ID NO: 4205 - DNA, 23 bp, Artificial Sequence
  HLA-A targeting gRNA
aggccatgccgggagatctacgg

SEQ ID NO: 4206 - DNA, 23 bp, Artificial Sequence
  HLA-A targeting gRNA
aggccccgggcggggctctcagg

SEQ ID NO: 4207 - DNA, 23 bp, Artificial Sequence
  HLA-A targeting gRNA
aggcccttgaagtcacaaagggg

SEQ ID NO: 4208 - DNA, 23 bp, Artificial Sequence
  HLA-A targeting gRNA
aggccgcctcccacttgcgctgg

SEQ ID NO: 4209 - DNA, 23 bp, Artificial Sequence
  HLA-A targeting gRNA
aggcctgagaagaaaagtcatgg

SEQ ID NO: 4210 - DNA, 23 bp, Artificial Sequence
  HLA-A targeting gRNA
aggcctgagaggaaaagtcatgg

SEQ ID NO: 4211 - DNA, 23 bp, Artificial Sequence
  HLA-A targeting gRNA
aggcctgagaggaaaggtcacgg

SEQ ID NO: 4212 - DNA, 23 bp, Artificial Sequence
  HLA-A targeting gRNA
aggcgaactggtcatacccgcgg

SEQ ID NO: 4213 - DNA, 23 bp, Artificial Sequence
  HLA-A targeting gRNA
aggcgaactggtcatgcccgcgg

SEQ ID NO: 4214 - DNA, 23 bp, Artificial Sequence
  HLA-A targeting gRNA
aggcgaactggttatacccgcgg

SEQ ID NO: 4215 - DNA, 23 bp, Artificial Sequence
  HLA-A targeting gRNA
aggcgaactggttatacccgtgg

SEQ ID NO: 4216 - DNA, 23 bp, Artificial Sequence
  HLA-A targeting gRNA
aggcgaactggttatgcccgcgg

SEQ ID NO: 4217 - DNA, 23 bp, Artificial Sequence
  HLA-A targeting gRNA
aggcgacccgggccgtccgtggg

SEQ ID NO: 4218 - DNA, 23 bp, Artificial Sequence
  HLA-A targeting gRNA
aggcgctttgcatctctcatagg

SEQ ID NO: 4219 - DNA, 23 bp, Artificial Sequence
  HLA-A targeting gRNA
aggcgctttgcatctctcatggg

SEQ ID NO: 4220 - DNA, 23 bp, Artificial Sequence
  HLA-A targeting gRNA
aggcgctttgcatctttcatggg

SEQ ID NO: 4221 - DNA, 23 bp, Artificial Sequence
  HLA-A targeting gRNA
aggcggaccggtcatacccgcgg

SEQ ID NO: 4222 - DNA, 23 bp, Artificial Sequence
  HLA-A targeting gRNA
aggcggactgatcatacccgcgg

SEQ ID NO: 4223 - DNA, 23 bp, Artificial Sequence
  HLA-A targeting gRNA
aggcggactggccatacccgcgg

SEQ ID NO: 4224 - DNA, 23 bp, Artificial Sequence
  HLA-A targeting gRNA
aggcggactggtcatacccgcgg

SEQ ID NO: 4225 - DNA, 23 bp, Artificial Sequence
  HLA-A targeting gRNA
aggcggactggtcatgcccgcgg

SEQ ID NO: 4226 - DNA, 23 bp, Artificial Sequence
  HLA-A targeting gRNA
aggcggggcacacttctacctgg

SEQ ID NO: 4227 - DNA, 23 bp, Artificial Sequence
  HLA-A targeting gRNA
aggcgggggcgcaggacccgggg

SEQ ID NO: 4228 - DNA, 23 bp, Artificial Sequence
  HLA-A targeting gRNA
aggcgggggcgcaggacctgagg

SEQ ID NO: 4229 - DNA, 23 bp, Artificial Sequence
  HLA-A targeting gRNA
aggcgggggctcaggacccgggg

SEQ ID NO: 4230 - DNA, 23 bp, Artificial Sequence
  HLA-A targeting gRNA
aggcgtactggacatacccgcgg

SEQ ID NO: 4231 - DNA, 23 bp, Artificial Sequence
  HLA-A targeting gRNA
aggcgtactggtcatacccgcgg

SEQ ID NO: 4232 - DNA, 23 bp, Artificial Sequence
  HLA-A targeting gRNA
aggcgtactggtcatgcccgcgg

SEQ ID NO: 4233 - DNA, 23 bp, Artificial Sequence
  HLA-A targeting gRNA
aggcgtactggttatacccgcgg

SEQ ID NO: 4234 - DNA, 23 bp, Artificial Sequence
  HLA-A targeting gRNA
aggcgtactggttatgcccgcgg

SEQ ID NO: 4235 - DNA, 23 bp, Artificial Sequence
  HLA-A targeting gRNA
aggcgtcctggtcatacccgcgg

SEQ ID NO: 4236 - DNA, 23 bp, Artificial Sequence
  HLA-A targeting gRNA
aggcgtcctggtggtacccgcgg

SEQ ID NO: 4237 - DNA, 23 bp, Artificial Sequence
  HLA-A targeting gRNA
aggcgtcctggttatgcccgcgg

SEQ ID NO: 4238 - DNA, 23 bp, Artificial Sequence
  HLA-A targeting gRNA
aggctaactggtcatgcccgcgg

SEQ ID NO: 4239 - DNA, 23 bp, Artificial Sequence
  HLA-A targeting gRNA
aggctaactggttatacccgcgg

SEQ ID NO: 4240 - DNA, 23 bp, Artificial Sequence
  HLA-A targeting gRNA
aggctaactggttatgcccacgg

SEQ ID NO: 4241 - DNA, 23 bp, Artificial Sequence
  HLA-A targeting gRNA
aggctaactggttatgcccgcgg

SEQ ID NO: 4242 - DNA, 23 bp, Artificial Sequence
  HLA-A targeting gRNA
aggctcttgaagtcacaaagggg

SEQ ID NO: 4243 - DNA, 23 bp, Artificial Sequence
  HLA-A targeting gRNA
aggctgaccgagagagcctgcgg

SEQ ID NO: 4244 - DNA, 23 bp, Artificial Sequence
  HLA-A targeting gRNA
aggctgaccgagtgaacctgcgg

SEQ ID NO: 4245 - DNA, 23 bp, Artificial Sequence
  HLA-A targeting gRNA
aggctgaccgagtgagcctgcgg

SEQ ID NO: 4246 - DNA, 23 bp, Artificial Sequence
  HLA-A targeting gRNA
aggctgcatgtaagtgatggcgg

SEQ ID NO: 4247 - DNA, 23 bp, Artificial Sequence
  HLA-A targeting gRNA
aggctgcattagcccctgtgtgg

SEQ ID NO: 4248 - DNA, 23 bp, Artificial Sequence
  HLA-A targeting gRNA
aggctgcgtgtaaatgatggcgg

SEQ ID NO: 4249 - DNA, 23 bp, Artificial Sequence
  HLA-A targeting gRNA
aggctgcgtgtaagtgatgccgg

SEQ ID NO: 4250 - DNA, 23 bp, Artificial Sequence
  HLA-A targeting gRNA
aggctgcgtgtaagtgatggcgg

SEQ ID NO: 4251 - DNA, 23 bp, Artificial Sequence
  HLA-A targeting gRNA
aggctgcgtgtaagtgatggggg

SEQ ID NO: 4252 - DNA, 23 bp, Artificial Sequence
  HLA-A targeting gRNA
aggctgcgtgtaagtggtggggg

SEQ ID NO: 4253 - DNA, 23 bp, Artificial Sequence
  HLA-A targeting gRNA
aggctgcgttagcccctgtgagg

SEQ ID NO: 4254 - DNA, 23 bp, Artificial Sequence
  HLA-A targeting gRNA
aggctgcgttagcccctgtgtgg

SEQ ID NO: 4255 - DNA, 23 bp, Artificial Sequence
  HLA-A targeting gRNA
aggctgctgacctttctctcagg

SEQ ID NO: 4256 - DNA, 23 bp, Artificial Sequence
  HLA-A targeting gRNA
aggctgctgacttttctctcagg

SEQ ID NO: 4257 - DNA, 23 bp, Artificial Sequence
  HLA-A targeting gRNA
aggctgctgcaggggtcaaaggg

SEQ ID NO: 4258 - DNA, 23 bp, Artificial Sequence
  HLA-A targeting gRNA
aggctgggatggcccacgtgtgg

SEQ ID NO: 4259 - DNA, 23 bp, Artificial Sequence
  HLA-A targeting gRNA
aggctgggatggcccaggtgtgg

SEQ ID NO: 4260 - DNA, 23 bp, Artificial Sequence
  HLA-A targeting gRNA
aggctgggatggcccatgtgtgg

SEQ ID NO: 4261 - DNA, 23 bp, Artificial Sequence
  HLA-A targeting gRNA
aggctgtgttagcccctgtgtgg

SEQ ID NO: 4262 - DNA, 23 bp, Artificial Sequence
  HLA-A targeting gRNA
agggaaaaggcctaggtaatggg

SEQ ID NO: 4263 - DNA, 23 bp, Artificial Sequence
  HLA-A targeting gRNA
agggaaaaggcctgggtaatggg

SEQ ID NO: 4264 - DNA, 23 bp, Artificial Sequence
  HLA-A targeting gRNA
agggaaagcagaagtccttctgg

SEQ ID NO: 4265 - DNA, 23 bp, Artificial Sequence
  HLA-A targeting gRNA
agggaaagcaggagcccttctgg

SEQ ID NO: 4266 - DNA, 23 bp, Artificial Sequence
  HLA-A targeting gRNA
agggagcctgggggcgaggaggg

SEQ ID NO: 4267 - DNA, 23 bp, Artificial Sequence
  HLA-A targeting gRNA
agggaggcggatctcggacccgg

SEQ ID NO: 4268 - DNA, 23 bp, Artificial Sequence
  HLA-A targeting gRNA
agggaggggccctcccggcgagg

SEQ ID NO: 4269 - DNA, 23 bp, Artificial Sequence
  HLA-A targeting gRNA
agggcaggatcaggaaacacagg

SEQ ID NO: 4270 - DNA, 23 bp, Artificial Sequence
  HLA-A targeting gRNA
agggcaggatcaggaaacacggg

SEQ ID NO: 4271 - DNA, 23 bp, Artificial Sequence
  HLA-A targeting gRNA
agggcaggatcaggaaacatggg

SEQ ID NO: 4272 - DNA, 23 bp, Artificial Sequence
  HLA-A targeting gRNA
agggcgcaggacccggggagcgg

SEQ ID NO: 4273 - DNA, 23 bp, Artificial Sequence
  HLA-A targeting gRNA
agggcggggcggggctcgggggg

SEQ ID NO: 4274 - DNA, 23 bp, Artificial Sequence
  HLA-A targeting gRNA
agggctgaggcttggaggtcagg

SEQ ID NO: 4275 - DNA, 23 bp, Artificial Sequence
  HLA-A targeting gRNA
agggctgaggcttgggggtcagg

SEQ ID NO: 4276 - DNA, 23 bp, Artificial Sequence
  HLA-A targeting gRNA
agggctgaggcttgggtgtaagg

SEQ ID NO: 4277 - DNA, 23 bp, Artificial Sequence
  HLA-A targeting gRNA
aggggaaaggcctgggtaatggg

SEQ ID NO: 4278 - DNA, 23 bp, Artificial Sequence
  HLA-A targeting gRNA
aggggagccccgggcgccgtggg

SEQ ID NO: 4279 - DNA, 23 bp, Artificial Sequence
  HLA-A targeting gRNA
aggggagccgcaggcgccgtggg

SEQ ID NO: 4280 - DNA, 23 bp, Artificial Sequence
  HLA-A targeting gRNA
aggggagccgcgggagccgtggg

SEQ ID NO: 4281 - DNA, 23 bp, Artificial Sequence
  HLA-A targeting gRNA
aggggagccgcgggcgccgtggg

SEQ ID NO: 4282 - DNA, 23 bp, Artificial Sequence
  HLA-A targeting gRNA
aggggccagagtattgggaccgg

SEQ ID NO: 4283 - DNA, 23 bp, Artificial Sequence
  HLA-A targeting gRNA
aggggccccgaccctgctgaagg

SEQ ID NO: 4284 - DNA, 23 bp, Artificial Sequence
  HLA-A targeting gRNA
aggggccctgaccctgctgaagg

SEQ ID NO: 4285 - DNA, 23 bp, Artificial Sequence
  HLA-A targeting gRNA
aggggccggaatattgggaccgg

SEQ ID NO: 4286 - DNA, 23 bp, Artificial Sequence
  HLA-A targeting gRNA
aggggccggaatattgggacggg

SEQ ID NO: 4287 - DNA, 23 bp, Artificial Sequence
  HLA-A targeting gRNA
aggggccggagcattgggaccgg

SEQ ID NO: 4288 - DNA, 23 bp, Artificial Sequence
  HLA-A targeting gRNA
aggggccggagtactgggaccgg

SEQ ID NO: 4289 - DNA, 23 bp, Artificial Sequence
  HLA-A targeting gRNA
aggggccggagtattaggaccgg

SEQ ID NO: 4290 - DNA, 23 bp, Artificial Sequence
  HLA-A targeting gRNA
aggggccggagtgttgggaccgg

SEQ ID NO: 4291 - DNA, 23 bp, Artificial Sequence
  HLA-A targeting gRNA
aggggctggagtattgggaccgg

SEQ ID NO: 4292 - DNA, 23 bp, Artificial Sequence
  HLA-A targeting gRNA
agggggaaaggcctgggtaatgg

SEQ ID NO: 4293 - DNA, 23 bp, Artificial Sequence
  HLA-A targeting gRNA
aggggggcggatctcggacccgg

SEQ ID NO: 4294 - DNA, 23 bp, Artificial Sequence
  HLA-A targeting gRNA
aggggggtggatctcggacccgg

SEQ ID NO: 4295 - DNA, 23 bp, Artificial Sequence
  HLA-A targeting gRNA
aggggggtggtggggcagagggg

SEQ ID NO: 4296 - DNA, 23 bp, Artificial Sequence
  HLA-A targeting gRNA
agggggtcggatctcggacccgg

SEQ ID NO: 4297 - DNA, 23 bp, Artificial Sequence
  HLA-A targeting gRNA
aggggtcacagtggacacaaggg

SEQ ID NO: 4298 - DNA, 23 bp, Artificial Sequence
  HLA-A targeting gRNA
aggggtcacagtggacacggggg

SEQ ID NO: 4299 - DNA, 23 bp, Artificial Sequence
  HLA-A targeting gRNA
aggggtcacggtggacacggggg

SEQ ID NO: 4300 - DNA, 23 bp, Artificial Sequence
  HLA-A targeting gRNA
aggggtcatatctcttctcaggg

SEQ ID NO: 4301 - DNA, 23 bp, Artificial Sequence
  HLA-A targeting gRNA
aggggtcatatctgttctcaggg

SEQ ID NO: 4302 - DNA, 23 bp, Artificial Sequence
  HLA-A targeting gRNA
aggggtcatgtgtcttctcaggg

SEQ ID NO: 4303 - DNA, 23 bp, Artificial Sequence
  HLA-A targeting gRNA
aggggtcctgaccctgctgaagg

SEQ ID NO: 4304 - DNA, 23 bp, Artificial Sequence
  HLA-A targeting gRNA
aggggtcgggacctgcgccccgg

SEQ ID NO: 4305 - DNA, 23 bp, Artificial Sequence
  HLA-A targeting gRNA
aggggtgaagagcggggtctggg

SEQ ID NO: 4306 - DNA, 23 bp, Artificial Sequence
  HLA-A targeting gRNA
aggggtgaggagtggggtctggg

SEQ ID NO: 4307 - DNA, 23 bp, Artificial Sequence
  HLA-A targeting gRNA
aggggtgaggggtggggtctggg

SEQ ID NO: 4308 - DNA, 23 bp, Artificial Sequence
  HLA-A targeting gRNA
aggggtgatgtgtcttctcaggg

SEQ ID NO: 4309 - DNA, 23 bp, Artificial Sequence
  HLA-A targeting gRNA
aggggtggggagtggggtctggg

SEQ ID NO: 4310 - DNA, 23 bp, Artificial Sequence
  HLA-A targeting gRNA
agggtatgagaccctggccccgg

SEQ ID NO: 4311 - DNA, 23 bp, Artificial Sequence
  HLA-A targeting gRNA
agggtgtgagaccctggcccagg

SEQ ID NO: 4312 - DNA, 23 bp, Artificial Sequence
  HLA-A targeting gRNA
agggtgtgagaccctggccccgg

SEQ ID NO: 4313 - DNA, 23 bp, Artificial Sequence
  HLA-A targeting gRNA
agggtgtgagaccctggcctagg

SEQ ID NO: 4314 - DNA, 23 bp, Artificial Sequence
  HLA-A targeting gRNA
aggtatctgcggtgccctccagg

SEQ ID NO: 4315 - DNA, 23 bp, Artificial Sequence
  HLA-A targeting gRNA
aggtcaaaatccccgcgggttgg

SEQ ID NO: 4316 - DNA, 23 bp, Artificial Sequence
  HLA-A targeting gRNA
aggtcagggctgaggcttggggg

SEQ ID NO: 4317 - DNA, 23 bp, Artificial Sequence
  HLA-A targeting gRNA
aggtcagtgtgatctccccaggg

SEQ ID NO: 4318 - DNA, 23 bp, Artificial Sequence
  HLA-A targeting gRNA
aggtcagtgtgatctccgtaggg

SEQ ID NO: 4319 - DNA, 23 bp, Artificial Sequence
  HLA-A targeting gRNA
aggtcccggacggggctctcagg

SEQ ID NO: 4320 - DNA, 23 bp, Artificial Sequence
  HLA-A targeting gRNA
aggtcccgggcggggctctcagg

SEQ ID NO: 4321 - DNA, 23 bp, Artificial Sequence
  HLA-A targeting gRNA
aggtcccgggcggggctctctgg

SEQ ID NO: 4322 - DNA, 23 bp, Artificial Sequence
  HLA-A targeting gRNA
aggtcccgggcggggttctcagg

SEQ ID NO: 4323 - DNA, 23 bp, Artificial Sequence
  HLA-A targeting gRNA
aggtcctgcgcccccgcctgcgg

SEQ ID NO: 4324 - DNA, 23 bp, Artificial Sequence
  HLA-A targeting gRNA
aggtgccggaggattgggaccgg

SEQ ID NO: 4325 - DNA, 23 bp, Artificial Sequence
  HLA-A targeting gRNA
aggtggggcacacttctacctgg

SEQ ID NO: 4326 - DNA, 23 bp, Artificial Sequence
  HLA-A targeting gRNA
aggttgcgtgtaagtgatggcgg

SEQ ID NO: 4327 - DNA, 23 bp, Artificial Sequence
  HLA-A targeting gRNA
agtactggttatgcccgcggagg

SEQ ID NO: 4328 - DNA, 23 bp, Artificial Sequence
  HLA-A targeting gRNA
agtagaacaaaaacaggacctgg

SEQ ID NO: 4329 - DNA, 23 bp, Artificial Sequence
  HLA-A targeting gRNA
agtagaaccaaaacaggacctgg

SEQ ID NO: 4330 - DNA, 23 bp, Artificial Sequence
  HLA-A targeting gRNA
agtagccaagcaggttccgcagg

SEQ ID NO: 4331 - DNA, 23 bp, Artificial Sequence
  HLA-A targeting gRNA
agtagccgcgcaggatccgcagg

SEQ ID NO: 4332 - DNA, 23 bp, Artificial Sequence
  HLA-A targeting gRNA
agtagccgcgcagggtccgcagg

SEQ ID NO: 4333 - DNA, 23 bp, Artificial Sequence
  HLA-A targeting gRNA
agtagccgcgcaggttccgcagg

SEQ ID NO: 4334 - DNA, 23 bp, Artificial Sequence
  HLA-A targeting gRNA
agtagccgcgcaggtttcgcagg

SEQ ID NO: 4335 - DNA, 23 bp, Artificial Sequence
  HLA-A targeting gRNA
agtagccgcgcagttgccgcagg

SEQ ID NO: 4336 - DNA, 23 bp, Artificial Sequence
  HLA-A targeting gRNA
agtagccgcgcagtttccgcagg

SEQ ID NO: 4337 - DNA, 23 bp, Artificial Sequence
  HLA-A targeting gRNA
agtagcggagcagggtccgcagg

SEQ ID NO: 4338 - DNA, 23 bp, Artificial Sequence
  HLA-A targeting gRNA
agtagcggagcgcgatcctcagg

SEQ ID NO: 4339 - DNA, 23 bp, Artificial Sequence
  HLA-A targeting gRNA
agtagcggagcgcggtgcgcagg

SEQ ID NO: 4340 - DNA, 23 bp, Artificial Sequence
  HLA-A targeting gRNA
agtagctgcgcaggttccgcagg

SEQ ID NO: 4341 - DNA, 23 bp, Artificial Sequence
  HLA-A targeting gRNA
agtattgggaccgggagacacgg

SEQ ID NO: 4342 - DNA, 23 bp, Artificial Sequence
  HLA-A targeting gRNA
agtcagggccatgcgatcttagg

SEQ ID NO: 4343 - DNA, 23 bp, Artificial Sequence
  HLA-A targeting gRNA
agtccctagaatactgatcaggg

SEQ ID NO: 4344 - DNA, 23 bp, Artificial Sequence
  HLA-A targeting gRNA
agtccctaggatagtgatcaggg

SEQ ID NO: 4345 - DNA, 23 bp, Artificial Sequence
  HLA-A targeting gRNA
agtccctataatactgatcaggg

SEQ ID NO: 4346 - DNA, 23 bp, Artificial Sequence
  HLA-A targeting gRNA
agtccctggaatactgatcaggg

SEQ ID NO: 4347 - DNA, 23 bp, Artificial Sequence
  HLA-A targeting gRNA
agtccgagaaggggagccgcggg

SEQ ID NO: 4348 - DNA, 23 bp, Artificial Sequence
  HLA-A targeting gRNA
agtcctggagcccttcagccagg

SEQ ID NO: 4349 - DNA, 23 bp, Artificial Sequence
  HLA-A targeting gRNA
agtcctggagcccttcagccggg

SEQ ID NO: 4350 - DNA, 23 bp, Artificial Sequence
  HLA-A targeting gRNA
agtcctggagcccttcagctggg

SEQ ID NO: 4351 - DNA, 23 bp, Artificial Sequence
  HLA-A targeting gRNA
agtgccatgttcagcacgagggg

SEQ ID NO: 4352 - DNA, 23 bp, Artificial Sequence
  HLA-A targeting gRNA
agtgcgggtcggcagggaaatgg

SEQ ID NO: 4353 - DNA, 23 bp, Artificial Sequence
  HLA-A targeting gRNA
agtgcgggtcgggagggaaatgg

SEQ ID NO: 4354 - DNA, 23 bp, Artificial Sequence
  HLA-A targeting gRNA
agtggccctgaccgagacctggg

SEQ ID NO: 4355 - DNA, 23 bp, Artificial Sequence
  HLA-A targeting gRNA
agtggccgcgcaggttccgcagg

SEQ ID NO: 4356 - DNA, 23 bp, Artificial Sequence
  HLA-A targeting gRNA
agtggccgcgcagtttccgcagg

SEQ ID NO: 4357 - DNA, 23 bp, Artificial Sequence
  HLA-A targeting gRNA
agtggctccgcagatacctgggg

SEQ ID NO: 4358 - DNA, 23 bp, Artificial Sequence
  HLA-A targeting gRNA
agtgggagcctggggcaaggagg

SEQ ID NO: 4359 - DNA, 23 bp, Artificial Sequence
  HLA-A targeting gRNA
agtgggcgggggggcggggaggg

SEQ ID NO: 4360 - DNA, 23 bp, Artificial Sequence
  HLA-A targeting gRNA
agtgggcggggggggcggggagg

SEQ ID NO: 4361 - DNA, 23 bp, Artificial Sequence
  HLA-A targeting gRNA
agtgggcggggggggtggggtgg

SEQ ID NO: 4362 - DNA, 23 bp, Artificial Sequence
  HLA-A targeting gRNA
agtgggcggggggggtggtgggg

SEQ ID NO: 4363 - DNA, 23 bp, Artificial Sequence
  HLA-A targeting gRNA
agtgggtggggtggcaggtctgg

SEQ ID NO: 4364 - DNA, 23 bp, Artificial Sequence
  HLA-A targeting gRNA
agtgggtggggtggcgggtctgg

SEQ ID NO: 4365 - DNA, 23 bp, Artificial Sequence
  HLA-A targeting gRNA
agtggtcaaagtggtcaaagggg

SEQ ID NO: 4366 - DNA, 23 bp, Artificial Sequence
  HLA-A targeting gRNA
agtggtcgaagtggtcaaagggg

SEQ ID NO: 4367 - DNA, 23 bp, Artificial Sequence
  HLA-A targeting gRNA
agtggtcgggggtggggcagagg

SEQ ID NO: 4368 - DNA, 23 bp, Artificial Sequence
  HLA-A targeting gRNA
agtggtctggggtggggcagagg

SEQ ID NO: 4369 - DNA, 23 bp, Artificial Sequence
  HLA-A targeting gRNA
agtgtgccccacctcgttactgg

SEQ ID NO: 4370 - DNA, 23 bp, Artificial Sequence
  HLA-A targeting gRNA
agtgtgccccgccttgttactgg

SEQ ID NO: 4371 - DNA, 23 bp, Artificial Sequence
  HLA-A targeting gRNA
agtgttccctgcatcattactgg

SEQ ID NO: 4372 - DNA, 23 bp, Artificial Sequence
  HLA-A targeting gRNA
agtgttccctgcctcattactgg

SEQ ID NO: 4373 - DNA, 23 bp, Artificial Sequence
  HLA-A targeting gRNA
agttgaggccaaaatccccgcgg

SEQ ID NO: 4374 - DNA, 23 bp, Artificial Sequence
  HLA-A targeting gRNA
agttgaggtcaaaatccccgcgg

SEQ ID NO: 4375 - DNA, 23 bp, Artificial Sequence
  HLA-A targeting gRNA
agttgtggtcatcggagctgtgg

SEQ ID NO: 4376 - DNA, 23 bp, Artificial Sequence
  HLA-A targeting gRNA
agtttaggccaaaatccccgcgg

SEQ ID NO: 4377 - DNA, 23 bp, Artificial Sequence
  HLA-A targeting gRNA
atacataggaggaagagctcagg

SEQ ID NO: 4378 - DNA, 23 bp, Artificial Sequence
  HLA-A targeting gRNA
atacttctggaaattccttttgg

SEQ ID NO: 4379 - DNA, 23 bp, Artificial Sequence
  HLA-A targeting gRNA
atacttctggaaattctttttgg

SEQ ID NO: 4380 - DNA, 23 bp, Artificial Sequence
  HLA-A targeting gRNA
atagcccacggtgatgaagcggg

SEQ ID NO: 4381 - DNA, 23 bp, Artificial Sequence
  HLA-A targeting gRNA
ataggaggaagagctcaggtagg

SEQ ID NO: 4382 - DNA, 23 bp, Artificial Sequence
  HLA-A targeting gRNA
atagggacgtttcgaatgtgtgg

SEQ ID NO: 4383 - DNA, 23 bp, Artificial Sequence
  HLA-A targeting gRNA
atagggcattttcttcccacagg

SEQ ID NO: 4384 - DNA, 23 bp, Artificial Sequence
  HLA-A targeting gRNA
atagttctggaaacttctcttgg

SEQ ID NO: 4385 - DNA, 23 bp, Artificial Sequence
  HLA-A targeting gRNA
atatgtatggctgcgacgtgggg

SEQ ID NO: 4386 - DNA, 23 bp, Artificial Sequence
  HLA-A targeting gRNA
atccaatacccaatgggagtggg

SEQ ID NO: 4387 - DNA, 23 bp, Artificial Sequence
  HLA-A targeting gRNA
atccacccccctgaggccgcggg

SEQ ID NO: 4388 - DNA, 23 bp, Artificial Sequence
  HLA-A targeting gRNA
atccgacacccaatgggagtggg

SEQ ID NO: 4389 - DNA, 23 bp, Artificial Sequence
  HLA-A targeting gRNA
atccgaccccctgaggccgcggg

SEQ ID NO: 4390 - DNA, 23 bp, Artificial Sequence
  HLA-A targeting gRNA
atccgcccccctgaggccgcggg

SEQ ID NO: 4391 - DNA, 23 bp, Artificial Sequence
  HLA-A targeting gRNA
atccgcctccctgaggccgcggg

SEQ ID NO: 4392 - DNA, 23 bp, Artificial Sequence
  HLA-A targeting gRNA
atcctctggatgtgagaccctgg

SEQ ID NO: 4393 - DNA, 23 bp, Artificial Sequence
  HLA-A targeting gRNA
atctcagacccggagactcgggg

SEQ ID NO: 4394 - DNA, 23 bp, Artificial Sequence
  HLA-A targeting gRNA
atctcagaccgggagactcgggg

SEQ ID NO: 4395 - DNA, 23 bp, Artificial Sequence
  HLA-A targeting gRNA
atctcagaccgggagacttgggg

SEQ ID NO: 4396 - DNA, 23 bp, Artificial Sequence
  HLA-A targeting gRNA
atctcagacggggagactcgggg

SEQ ID NO: 4397 - DNA, 23 bp, Artificial Sequence
  HLA-A targeting gRNA
atctcagacggggagactctagg

SEQ ID NO: 4398 - DNA, 23 bp, Artificial Sequence
  HLA-A targeting gRNA
atctcagacggggagactctggg

SEQ ID NO: 4399 - DNA, 23 bp, Artificial Sequence
  HLA-A targeting gRNA
atctcagtgggctacgtggacgg

SEQ ID NO: 4400 - DNA, 23 bp, Artificial Sequence
  HLA-A targeting gRNA
atctcctgcgggctctgaccagg

SEQ ID NO: 4401 - DNA, 23 bp, Artificial Sequence
  HLA-A targeting gRNA
atctcctgtgggctctgaccagg

SEQ ID NO: 4402 - DNA, 23 bp, Artificial Sequence
  HLA-A targeting gRNA
atctcggacccggagactcgggg

SEQ ID NO: 4403 - DNA, 23 bp, Artificial Sequence
  HLA-A targeting gRNA
atctcggaccctgagactcgggg

SEQ ID NO: 4404 - DNA, 23 bp, Artificial Sequence
  HLA-A targeting gRNA
atctcggacctagagactcgagg

SEQ ID NO: 4405 - DNA, 23 bp, Artificial Sequence
  HLA-A targeting gRNA
atctgcggtgccctccaggtagg

SEQ ID NO: 4406 - DNA, 23 bp, Artificial Sequence
  HLA-A targeting gRNA
atgaacctgcggaaactgcgcgg

SEQ ID NO: 4407 - DNA, 23 bp, Artificial Sequence
  HLA-A targeting gRNA
atgacccgcatctcggcctctgg

SEQ ID NO: 4408 - DNA, 23 bp, Artificial Sequence
  HLA-A targeting gRNA
atgacccgcatctcggcgtctgg

SEQ ID NO: 4409 - DNA, 23 bp, Artificial Sequence
  HLA-A targeting gRNA
atgaggggcttcggtaaggaggg

SEQ ID NO: 4410 - DNA, 23 bp, Artificial Sequence
  HLA-A targeting gRNA
atgaggtcaccctgaggtgctgg

SEQ ID NO: 4411 - DNA, 23 bp, Artificial Sequence
  HLA-A targeting gRNA
atgatgtgagaccctggccccgg

SEQ ID NO: 4412 - DNA, 23 bp, Artificial Sequence
  HLA-A targeting gRNA
atgcagggaacacttctacctgg

SEQ ID NO: 4413 - DNA, 23 bp, Artificial Sequence
  HLA-A targeting gRNA
atgcccaagttggggatggtggg

SEQ ID NO: 4414 - DNA, 23 bp, Artificial Sequence
  HLA-A targeting gRNA
atgcccatgatggggatggtagg

SEQ ID NO: 4415 - DNA, 23 bp, Artificial Sequence
  HLA-A targeting gRNA
atgcccatgatggggatggtggg

SEQ ID NO: 4416 - DNA, 23 bp, Artificial Sequence
  HLA-A targeting gRNA
atggacaggacacctggggtagg

SEQ ID NO: 4417 - DNA, 23 bp, Artificial Sequence
  HLA-A targeting gRNA
atggacaggacacctggggtggg

SEQ ID NO: 4418 - DNA, 23 bp, Artificial Sequence
  HLA-A targeting gRNA
atggacaggacacctggtgtggg

SEQ ID NO: 4419 - DNA, 23 bp, Artificial Sequence
  HLA-A targeting gRNA
atggacgggacacctggggtggg

SEQ ID NO: 4420 - DNA, 23 bp, Artificial Sequence
  HLA-A targeting gRNA
atggaggggaagacagtccctgg

SEQ ID NO: 4421 - DNA, 23 bp, Artificial Sequence
  HLA-A targeting gRNA
atggagtaaggagggggatgagg

SEQ ID NO: 4422 - DNA, 23 bp, Artificial Sequence
  HLA-A targeting gRNA
atggatagagcaagaggggccgg

SEQ ID NO: 4423 - DNA, 23 bp, Artificial Sequence
  HLA-A targeting gRNA
atggatagagcaggaggggccgg

SEQ ID NO: 4424 - DNA, 23 bp, Artificial Sequence
  HLA-A targeting gRNA
atggatagagcaggaggggctgg

SEQ ID NO: 4425 - DNA, 23 bp, Artificial Sequence
  HLA-A targeting gRNA
atggatagagcaggaggtgccgg

SEQ ID NO: 4426 - DNA, 23 bp, Artificial Sequence
  HLA-A targeting gRNA
atggctcccatctcagggtgagg

SEQ ID NO: 4427 - DNA, 23 bp, Artificial Sequence
  HLA-A targeting gRNA
atgggaggcggcccgtgtggcgg

SEQ ID NO: 4428 - DNA, 23 bp, Artificial Sequence
  HLA-A targeting gRNA
atgggcaggacacctggggtggg

SEQ ID NO: 4429 - DNA, 23 bp, Artificial Sequence
  HLA-A targeting gRNA
atggggtaaggagggggatgagg

SEQ ID NO: 4430 - DNA, 23 bp, Artificial Sequence
  HLA-A targeting gRNA
atggtcagagacgagatggtggg

SEQ ID NO: 4431 - DNA, 23 bp, Artificial Sequence
  HLA-A targeting gRNA
atggtcagagacgggatggtggg

SEQ ID NO: 4432 - DNA, 23 bp, Artificial Sequence
  HLA-A targeting gRNA
atggtcagagacggggtggtggg

SEQ ID NO: 4433 - DNA, 23 bp, Artificial Sequence
  HLA-A targeting gRNA
atggtcagagagggggtggtggg

SEQ ID NO: 4434 - DNA, 23 bp, Artificial Sequence
  HLA-A targeting gRNA
atggtcagagatgggatggtggg

SEQ ID NO: 4435 - DNA, 23 bp, Artificial Sequence
  HLA-A targeting gRNA
atggtgtgagaacctggccccgg

SEQ ID NO: 4436 - DNA, 23 bp, Artificial Sequence
  HLA-A targeting gRNA
atggtgtgagaccctggccccgg

SEQ ID NO: 4437 - DNA, 23 bp, Artificial Sequence
  HLA-A targeting gRNA
atggttcccaaggctgctgcagg

SEQ ID NO: 4438 - DNA, 23 bp, Artificial Sequence
  HLA-A targeting gRNA
atgtaatcccttgccgtcgtagg

SEQ ID NO: 4439 - DNA, 23 bp, Artificial Sequence
  HLA-A targeting gRNA
atgtacagcatgaggggcttcgg

SEQ ID NO: 4440 - DNA, 23 bp, Artificial Sequence
  HLA-A targeting gRNA
atgtatcaccgtggtggttgtgg

SEQ ID NO: 4441 - DNA, 23 bp, Artificial Sequence
  HLA-A targeting gRNA
atgtatcacctcgatggttgtgg

SEQ ID NO: 4442 - DNA, 23 bp, Artificial Sequence
  HLA-A targeting gRNA
atgtatcaccttaatggttgtgg

SEQ ID NO: 4443 - DNA, 23 bp, Artificial Sequence
  HLA-A targeting gRNA
atgtatcaccttgatgattatgg

SEQ ID NO: 4444 - DNA, 23 bp, Artificial Sequence
  HLA-A targeting gRNA
atgtatcaccttgatggttgtgg

SEQ ID NO: 4445 - DNA, 23 bp, Artificial Sequence
  HLA-A targeting gRNA
atgtatcaccttggtggttgtgg

SEQ ID NO: 4446 - DNA, 23 bp, Artificial Sequence
  HLA-A targeting gRNA
atgtatcgccttgatggttgtgg

SEQ ID NO: 4447 - DNA, 23 bp, Artificial Sequence
  HLA-A targeting gRNA
atgtcccggacggggctctcagg

SEQ ID NO: 4448 - DNA, 23 bp, Artificial Sequence
  HLA-A targeting gRNA
atgtgggacaagaggaattatgg

SEQ ID NO: 4449 - DNA, 23 bp, Artificial Sequence
  HLA-A targeting gRNA
atgtgtaggaggaagagctcagg

SEQ ID NO: 4450 - DNA, 23 bp, Artificial Sequence
  HLA-A targeting gRNA
atgtgtaggaggaagagttcagg

SEQ ID NO: 4451 - DNA, 23 bp, Artificial Sequence
  HLA-A targeting gRNA
atgtgtaggaggaagagttctgg

SEQ ID NO: 4452 - DNA, 23 bp, Artificial Sequence
  HLA-A targeting gRNA
attaaggaatgacgtctctgagg

SEQ ID NO: 4453 - DNA, 23 bp, Artificial Sequence
  HLA-A targeting gRNA
attaagggatgaagtccctgagg

SEQ ID NO: 4454 - DNA, 23 bp, Artificial Sequence
  HLA-A targeting gRNA
attaagggatgaagtccttgagg

SEQ ID NO: 4455 - DNA, 23 bp, Artificial Sequence
  HLA-A targeting gRNA
attaagggatgaagtctctgagg

SEQ ID NO: 4456 - DNA, 23 bp, Artificial Sequence
  HLA-A targeting gRNA
attaagggatgacatctctgagg

SEQ ID NO: 4457 - DNA, 23 bp, Artificial Sequence
  HLA-A targeting gRNA
attaagggatgacgtctctgagg

SEQ ID NO: 4458 - DNA, 23 bp, Artificial Sequence
  HLA-A targeting gRNA
attaagggatggcgtctctgagg

SEQ ID NO: 4459 - DNA, 23 bp, Artificial Sequence
  HLA-A targeting gRNA
attccagcatcatgagtcagggg

SEQ ID NO: 4460 - DNA, 23 bp, Artificial Sequence
  HLA-A targeting gRNA
attccagcattcatgagtcaggg

SEQ ID NO: 4461 - DNA, 23 bp, Artificial Sequence
  HLA-A targeting gRNA
attccagcattcatgagtcgggg

SEQ ID NO: 4462 - DNA, 23 bp, Artificial Sequence
  HLA-A targeting gRNA
attccagcattcgtgagtcaggg

SEQ ID NO: 4463 - DNA, 23 bp, Artificial Sequence
  HLA-A targeting gRNA
attcgaaacgtcccaatcaaagg

SEQ ID NO: 4464 - DNA, 23 bp, Artificial Sequence
  HLA-A targeting gRNA
attcgaaacgtccctatcaaagg

SEQ ID NO: 4465 - DNA, 23 bp, Artificial Sequence
  HLA-A targeting gRNA
attctgggagctgaagtggtcgg

SEQ ID NO: 4466 - DNA, 23 bp, Artificial Sequence
  HLA-A targeting gRNA
attgggacgtttcgaatgtgtgg

SEQ ID NO: 4467 - DNA, 23 bp, Artificial Sequence
  HLA-A targeting gRNA
attgggacgtttcgagtgtgtgg

SEQ ID NO: 4468 - DNA, 23 bp, Artificial Sequence
  HLA-A targeting gRNA
attgggatgttacgcgtgtgtgg

SEQ ID NO: 4469 - DNA, 23 bp, Artificial Sequence
  HLA-A targeting gRNA
attgggatgtttcgcgtgtgtgg

SEQ ID NO: 4470 - DNA, 23 bp, Artificial Sequence
  HLA-A targeting gRNA
attggggaggcgcagcattgggg

SEQ ID NO: 4471 - DNA, 23 bp, Artificial Sequence
  HLA-A targeting gRNA
attggggaggcgcagcgttgggg

SEQ ID NO: 4472 - DNA, 23 bp, Artificial Sequence
  HLA-A targeting gRNA
attggggaggcgccgcgttgggg

SEQ ID NO: 4473 - DNA, 23 bp, Artificial Sequence
  HLA-A targeting gRNA
attgtcctagacagcagaggggg

SEQ ID NO: 4474 - DNA, 23 bp, Artificial Sequence
  HLA-A targeting gRNA
attgtcctagagagaagaggggg

SEQ ID NO: 4475 - DNA, 23 bp, Artificial Sequence
  HLA-A targeting gRNA
attgtcctagagagcagacgggg

SEQ ID NO: 4476 - DNA, 23 bp, Artificial Sequence
  HLA-A targeting gRNA
attgtcctagagagcagaggggg

SEQ ID NO: 4477 - DNA, 23 bp, Artificial Sequence
  HLA-A targeting gRNA
atttcagcattcatgagtcaggg

SEQ ID NO: 4478 - DNA, 23 bp, Artificial Sequence
  HLA-A targeting gRNA
atttccacaccgccatgtcccgg

SEQ ID NO: 4479 - DNA, 23 bp, Artificial Sequence
  HLA-A targeting gRNA
atttccacacctccgtgtcccgg

SEQ ID NO: 4480 - DNA, 23 bp, Artificial Sequence
  HLA-A targeting gRNA
atttcgacaccgccacgtcccgg

SEQ ID NO: 4481 - DNA, 23 bp, Artificial Sequence
  HLA-A targeting gRNA
atttcgacaccgccatgtcccgg

SEQ ID NO: 4482 - DNA, 23 bp, Artificial Sequence
  HLA-A targeting gRNA
atttcgacaccgccgtgtcccgg

SEQ ID NO: 4483 - DNA, 23 bp, Artificial Sequence
  HLA-A targeting gRNA
atttcgacaccgccgtgtcctgg

SEQ ID NO: 4484 - DNA, 23 bp, Artificial Sequence
  HLA-A targeting gRNA
atttctacaccgccatgacccgg

SEQ ID NO: 4485 - DNA, 23 bp, Artificial Sequence
  HLA-A targeting gRNA
atttctacaccgccatgtcccgg

SEQ ID NO: 4486 - DNA, 23 bp, Artificial Sequence
  HLA-A targeting gRNA
atttctacaccgccgtgtcccgg

SEQ ID NO: 4487 - DNA, 23 bp, Artificial Sequence
  HLA-A targeting gRNA
atttctacaccgccgtgtccggg

SEQ ID NO: 4488 - DNA, 23 bp, Artificial Sequence
  HLA-A targeting gRNA
atttctacaccgctatgtcccgg

SEQ ID NO: 4489 - DNA, 23 bp, Artificial Sequence
  HLA-A targeting gRNA
atttctacaccgctgtgtcccgg

SEQ ID NO: 4490 - DNA, 23 bp, Artificial Sequence
  HLA-A targeting gRNA
atttctccacatccgtgtcctgg

SEQ ID NO: 4491 - DNA, 23 bp, Artificial Sequence
  HLA-A targeting gRNA
atttcttcacatccgtgtcctgg

SEQ ID NO: 4492 - DNA, 23 bp, Artificial Sequence
  HLA-A targeting gRNA
caaaatccccgcgggttgggcgg

SEQ ID NO: 4493 - DNA, 23 bp, Artificial Sequence
  HLA-A targeting gRNA
caaaatccccgcgggttggtcgg

SEQ ID NO: 4494 - DNA, 23 bp, Artificial Sequence
  HLA-A targeting gRNA
caaacccctcaccctgagatggg

SEQ ID NO: 4495 - DNA, 23 bp, Artificial Sequence
  HLA-A targeting gRNA
caaactggttatgcccgcggagg

SEQ ID NO: 4496 - DNA, 23 bp, Artificial Sequence
  HLA-A targeting gRNA
caaagcccctcaccctgagatgg

SEQ ID NO: 4497 - DNA, 23 bp, Artificial Sequence
  HLA-A targeting gRNA
caaatgggaggcggcccgtgtgg

SEQ ID NO: 4498 - DNA, 23 bp, Artificial Sequence
  HLA-A targeting gRNA
caaatgtcctgtgagggcactgg

SEQ ID NO: 4499 - DNA, 23 bp, Artificial Sequence
  HLA-A targeting gRNA
caacacacagacttaccgagagg

SEQ ID NO: 4500 - DNA, 23 bp, Artificial Sequence
  HLA-A targeting gRNA
caacagccaccacagctcctagg

SEQ ID NO: 4501 - DNA, 23 bp, Artificial Sequence
  HLA-A targeting gRNA
caacagccaccatagctcctagg

SEQ ID NO: 4502 - DNA, 23 bp, Artificial Sequence
  HLA-A targeting gRNA
caacagccatcacagctcctagg

SEQ ID NO: 4503 - DNA, 23 bp, Artificial Sequence
  HLA-A targeting gRNA
caacagtcatgaacaaattctgg

SEQ ID NO: 4504 - DNA, 23 bp, Artificial Sequence
  HLA-A targeting gRNA
caacgagaagaagaggaaaatgg

SEQ ID NO: 4505 - DNA, 23 bp, Artificial Sequence
  HLA-A targeting gRNA
caacggagagcctacctggaggg

SEQ ID NO: 4506 - DNA, 23 bp, Artificial Sequence
  HLA-A targeting gRNA
caagagcccgcaggagacgtggg

SEQ ID NO: 4507 - DNA, 23 bp, Artificial Sequence
  HLA-A targeting gRNA
caagctcagtgtcctgaatttgg

SEQ ID NO: 4508 - DNA, 23 bp, Artificial Sequence
  HLA-A targeting gRNA
caagctcagtgtcctgagtttgg

SEQ ID NO: 4509 - DNA, 23 bp, Artificial Sequence
  HLA-A targeting gRNA
caagctcggtgtcctgagtttgg

SEQ ID NO: 4510 - DNA, 23 bp, Artificial Sequence
  HLA-A targeting gRNA
caagctcggtgtcctgggtctgg

SEQ ID NO: 4511 - DNA, 23 bp, Artificial Sequence
  HLA-A targeting gRNA
caagctgggtgtcctgagtttgg

SEQ ID NO: 4512 - DNA, 23 bp, Artificial Sequence
  HLA-A targeting gRNA
caaggacagctaggacaaccagg

SEQ ID NO: 4513 - DNA, 23 bp, Artificial Sequence
  HLA-A targeting gRNA
caaggcacagactgaccgagagg

SEQ ID NO: 4514 - DNA, 23 bp, Artificial Sequence
  HLA-A targeting gRNA
caaggcacagactgaccgagtgg

SEQ ID NO: 4515 - DNA, 23 bp, Artificial Sequence
  HLA-A targeting gRNA
caagggccgtgtctgcactgggg

SEQ ID NO: 4516 - DNA, 23 bp, Artificial Sequence
  HLA-A targeting gRNA
caagggccgtgtctgcattgggg

SEQ ID NO: 4517 - DNA, 23 bp, Artificial Sequence
  HLA-A targeting gRNA
caagtccgagaggggagccccgg

SEQ ID NO: 4518 - DNA, 23 bp, Artificial Sequence
  HLA-A targeting gRNA
caagtgccatgttcagcacgagg

SEQ ID NO: 4519 - DNA, 23 bp, Artificial Sequence
  HLA-A targeting gRNA
caagtgggaggcagcccgtgagg

SEQ ID NO: 4520 - DNA, 23 bp, Artificial Sequence
  HLA-A targeting gRNA
caagtgggaggcggcccgggtgg

SEQ ID NO: 4521 - DNA, 23 bp, Artificial Sequence
  HLA-A targeting gRNA
caagtgggaggcggcccgtacgg

SEQ ID NO: 4522 - DNA, 23 bp, Artificial Sequence
  HLA-A targeting gRNA
caagtgggaggcggcccgtatgg

SEQ ID NO: 4523 - DNA, 23 bp, Artificial Sequence
  HLA-A targeting gRNA
caagtgggaggcggcccgtgagg

SEQ ID NO: 4524 - DNA, 23 bp, Artificial Sequence
  HLA-A targeting gRNA
caagtgggaggcggcccgtgcgg

SEQ ID NO: 4525 - DNA, 23 bp, Artificial Sequence
  HLA-A targeting gRNA
caagtgggaggcggccggtgagg

SEQ ID NO: 4526 - DNA, 23 bp, Artificial Sequence
  HLA-A targeting gRNA
caagtgggaggcggcctgtgagg

SEQ ID NO: 4527 - DNA, 23 bp, Artificial Sequence
  HLA-A targeting gRNA
caagtgggaggcggctcgtgagg

SEQ ID NO: 4528 - DNA, 23 bp, Artificial Sequence
  HLA-A targeting gRNA
caagtgtgagaccctggcccagg

SEQ ID NO: 4529 - DNA, 23 bp, Artificial Sequence
  HLA-A targeting gRNA
caagtgtgagaccctggccccgg

SEQ ID NO: 4530 - DNA, 23 bp, Artificial Sequence
  HLA-A targeting gRNA
caagttggaggcggcccgtgagg

SEQ ID NO: 4531 - DNA, 23 bp, Artificial Sequence
  HLA-A targeting gRNA
caagttggaggcggcccgtgcgg

SEQ ID NO: 4532 - DNA, 23 bp, Artificial Sequence
  HLA-A targeting gRNA
caagttggaggcggcccgtgggg

SEQ ID NO: 4533 - DNA, 23 bp, Artificial Sequence
  HLA-A targeting gRNA
caagttggaggcggcccgtgtgg

SEQ ID NO: 4534 - DNA, 23 bp, Artificial Sequence
  HLA-A targeting gRNA
caagttggggatggtgggctggg

SEQ ID NO: 4535 - DNA, 23 bp, Artificial Sequence
  HLA-A targeting gRNA
caatagtcatgaacaaattcagg

SEQ ID NO: 4536 - DNA, 23 bp, Artificial Sequence
  HLA-A targeting gRNA
caatccaccgtccccatcgtggg

SEQ ID NO: 4537 - DNA, 23 bp, Artificial Sequence
  HLA-A targeting gRNA
caatgaagcggggctccccgcgg

SEQ ID NO: 4538 - DNA, 23 bp, Artificial Sequence
  HLA-A targeting gRNA
caatggggaggcgcagcgttggg

SEQ ID NO: 4539 - DNA, 23 bp, Artificial Sequence
  HLA-A targeting gRNA
cacacacaggccctccaggtagg

SEQ ID NO: 4540 - DNA, 23 bp, Artificial Sequence
  HLA-A targeting gRNA
cacacacgtgccctccaggtagg

SEQ ID NO: 4541 - DNA, 23 bp, Artificial Sequence
  HLA-A targeting gRNA
cacacagatctacaaggcccagg

SEQ ID NO: 4542 - DNA, 23 bp, Artificial Sequence
  HLA-A targeting gRNA
cacacagatctgcaaggccaagg

SEQ ID NO: 4543 - DNA, 23 bp, Artificial Sequence
  HLA-A targeting gRNA
cacaccatccagaggatgtacgg

SEQ ID NO: 4544 - DNA, 23 bp, Artificial Sequence
  HLA-A targeting gRNA
cacaccatccagaggatgtctgg

SEQ ID NO: 4545 - DNA, 23 bp, Artificial Sequence
  HLA-A targeting gRNA
cacacccgccagaggatgtacgg

SEQ ID NO: 4546 - DNA, 23 bp, Artificial Sequence
  HLA-A targeting gRNA
cacaccctccagaatatgtatgg

SEQ ID NO: 4547 - DNA, 23 bp, Artificial Sequence
  HLA-A targeting gRNA
cacaccctccagacgatgtacgg

SEQ ID NO: 4548 - DNA, 23 bp, Artificial Sequence
  HLA-A targeting gRNA
cacaccctccagagcatgtacgg

SEQ ID NO: 4549 - DNA, 23 bp, Artificial Sequence
  HLA-A targeting gRNA
cacaccctccagagcatgtatgg

SEQ ID NO: 4550 - DNA, 23 bp, Artificial Sequence
  HLA-A targeting gRNA
cacaccctccagagcttgtacgg

SEQ ID NO: 4551 - DNA, 23 bp, Artificial Sequence
  HLA-A targeting gRNA
cacaccctccagaggatgtacgg

SEQ ID NO: 4552 - DNA, 23 bp, Artificial Sequence
  HLA-A targeting gRNA
cacaccctccagaggatgtctgg

SEQ ID NO: 4553 - DNA, 23 bp, Artificial Sequence
  HLA-A targeting gRNA
cacaccctccagaggatgtttgg

SEQ ID NO: 4554 - DNA, 23 bp, Artificial Sequence
  HLA-A targeting gRNA
cacaccctccagcggatgtatgg

SEQ ID NO: 4555 - DNA, 23 bp, Artificial Sequence
  HLA-A targeting gRNA
cacaccctccagtggatgtacgg

SEQ ID NO: 4556 - DNA, 23 bp, Artificial Sequence
  HLA-A targeting gRNA
cacaccctccagtggatgtatgg

SEQ ID NO: 4557 - DNA, 23 bp, Artificial Sequence
  HLA-A targeting gRNA
cacaccctccagtggatgtgtgg

SEQ ID NO: 4558 - DNA, 23 bp, Artificial Sequence
  HLA-A targeting gRNA
cacaccctccagtggatgtttgg

SEQ ID NO: 4559 - DNA, 23 bp, Artificial Sequence
  HLA-A targeting gRNA
cacaccgccatgtcccggcccgg

SEQ ID NO: 4560 - DNA, 23 bp, Artificial Sequence
  HLA-A targeting gRNA
cacacctccgtgtcccggcccgg

SEQ ID NO: 4561 - DNA, 23 bp, Artificial Sequence
  HLA-A targeting gRNA
cacacctccgtgtcccggcctgg

SEQ ID NO: 4562 - DNA, 23 bp, Artificial Sequence
  HLA-A targeting gRNA
cacaccttccagaggatgtatgg

SEQ ID NO: 4563 - DNA, 23 bp, Artificial Sequence
  HLA-A targeting gRNA
cacacgggccgcctcccacttgg

SEQ ID NO: 4564 - DNA, 23 bp, Artificial Sequence
  HLA-A targeting gRNA
cacactctccagagcatgtacgg

SEQ ID NO: 4565 - DNA, 23 bp, Artificial Sequence
  HLA-A targeting gRNA
cacacttggcagacgatgtacgg

SEQ ID NO: 4566 - DNA, 23 bp, Artificial Sequence
  HLA-A targeting gRNA
cacacttggcagacgatgtatgg

SEQ ID NO: 4567 - DNA, 23 bp, Artificial Sequence
  HLA-A targeting gRNA
cacacttggcagaggatgtatgg

SEQ ID NO: 4568 - DNA, 23 bp, Artificial Sequence
  HLA-A targeting gRNA
cacagctgtccacttctggaagg

SEQ ID NO: 4569 - DNA, 23 bp, Artificial Sequence
  HLA-A targeting gRNA
cacaggagacgtgggacaggagg

SEQ ID NO: 4570 - DNA, 23 bp, Artificial Sequence
  HLA-A targeting gRNA
cacaggagatgtgggacaagagg

SEQ ID NO: 4571 - DNA, 23 bp, Artificial Sequence
  HLA-A targeting gRNA
cacaggcccaggtctcggtcagg

SEQ ID NO: 4572 - DNA, 23 bp, Artificial Sequence
  HLA-A targeting gRNA
cacaggggctaacacagcctggg

SEQ ID NO: 4573 - DNA, 23 bp, Artificial Sequence
  HLA-A targeting gRNA
cacaggggctaacgcagactggg

SEQ ID NO: 4574 - DNA, 23 bp, Artificial Sequence
  HLA-A targeting gRNA
cacaggggctaacgcagcctggg

SEQ ID NO: 4575 - DNA, 23 bp, Artificial Sequence
  HLA-A targeting gRNA
cacaggggctaatgcagcctggg

SEQ ID NO: 4576 - DNA, 23 bp, Artificial Sequence
  HLA-A targeting gRNA
cacagggtcccaggctgggatgg

SEQ ID NO: 4577 - DNA, 23 bp, Artificial Sequence
  HLA-A targeting gRNA
cacatcatccagaggatgtaagg

SEQ ID NO: 4578 - DNA, 23 bp, Artificial Sequence
  HLA-A targeting gRNA
cacatcatccagaggatgtacgg

SEQ ID NO: 4579 - DNA, 23 bp, Artificial Sequence
  HLA-A targeting gRNA
cacatcatccagaggatgtatgg

SEQ ID NO: 4580 - DNA, 23 bp, Artificial Sequence
  HLA-A targeting gRNA
cacatcatccaggtgatgtatgg

SEQ ID NO: 4581 - DNA, 23 bp, Artificial Sequence
  HLA-A targeting gRNA
cacatcatccggaggatgtatgg

SEQ ID NO: 4582 - DNA, 23 bp, Artificial Sequence
  HLA-A targeting gRNA
cacatcctccagaggatgtatgg

SEQ ID NO: 4583 - DNA, 23 bp, Artificial Sequence
  HLA-A targeting gRNA
cacatgccaggtacagcatgagg

SEQ ID NO: 4584 - DNA, 23 bp, Artificial Sequence
  HLA-A targeting gRNA
cacatgccatgtacagcatgagg

SEQ ID NO: 4585 - DNA, 23 bp, Artificial Sequence
  HLA-A targeting gRNA
cacatgggccatcccagcctggg

SEQ ID NO: 4586 - DNA, 23 bp, Artificial Sequence
  HLA-A targeting gRNA
caccagcccaggtctcggtcagg

SEQ ID NO: 4587 - DNA, 23 bp, Artificial Sequence
  HLA-A targeting gRNA
caccagcggacgcaggcacctgg

SEQ ID NO: 4588 - DNA, 23 bp, Artificial Sequence
  HLA-A targeting gRNA
caccagcggatgcaggcacctgg

SEQ ID NO: 4589 - DNA, 23 bp, Artificial Sequence
  HLA-A targeting gRNA
cacccaatgggagtgggaaatgg

SEQ ID NO: 4590 - DNA, 23 bp, Artificial Sequence
  HLA-A targeting gRNA
cacccaatgggagtgggaagtgg

SEQ ID NO: 4591 - DNA, 23 bp, Artificial Sequence
  HLA-A targeting gRNA
cacccaatgggagtgggaattgg

SEQ ID NO: 4592 - DNA, 23 bp, Artificial Sequence
  HLA-A targeting gRNA
cacccagcacaagttggaggcgg

SEQ ID NO: 4593 - DNA, 23 bp, Artificial Sequence
  HLA-A targeting gRNA
cacccagcccaagtgggaggcgg

SEQ ID NO: 4594 - DNA, 23 bp, Artificial Sequence
  HLA-A targeting gRNA
cacccagcccaagttggaggcgg

SEQ ID NO: 4595 - DNA, 23 bp, Artificial Sequence
  HLA-A targeting gRNA
cacccagcgcaaatgggaggcgg

SEQ ID NO: 4596 - DNA, 23 bp, Artificial Sequence
  HLA-A targeting gRNA
cacccagcgcaagttggaggcgg

SEQ ID NO: 4597 - DNA, 23 bp, Artificial Sequence
  HLA-A targeting gRNA
cacccagcgtaagtgggaggcgg

SEQ ID NO: 4598 - DNA, 23 bp, Artificial Sequence
  HLA-A targeting gRNA
cacccagctcaagtgggaggcgg

SEQ ID NO: 4599 - DNA, 23 bp, Artificial Sequence
  HLA-A targeting gRNA
cacccgacacccaatgggagtgg

SEQ ID NO: 4600 - DNA, 23 bp, Artificial Sequence
  HLA-A targeting gRNA
cacccgcccaggtctcggtcagg

SEQ ID NO: 4601 - DNA, 23 bp, Artificial Sequence
  HLA-A targeting gRNA
caccctgagatggagtaaggagg

SEQ ID NO: 4602 - DNA, 23 bp, Artificial Sequence
  HLA-A targeting gRNA
caccctgagctggggtaaggagg

SEQ ID NO: 4603 - DNA, 23 bp, Artificial Sequence
  HLA-A targeting gRNA
caccctgaggtgctgggccatgg

SEQ ID NO: 4604 - DNA, 23 bp, Artificial Sequence
  HLA-A targeting gRNA
caccgcagatacctgtggagtgg

SEQ ID NO: 4605 - DNA, 23 bp, Artificial Sequence
  HLA-A targeting gRNA
caccggcccaggtctcgatcagg

SEQ ID NO: 4606 - DNA, 23 bp, Artificial Sequence
  HLA-A targeting gRNA
caccggcccaggtctcggtcagg

SEQ ID NO: 4607 - DNA, 23 bp, Artificial Sequence
  HLA-A targeting gRNA
caccggtccaggtctcgatcagg

SEQ ID NO: 4608 - DNA, 23 bp, Artificial Sequence
  HLA-A targeting gRNA
caccgtagctgtggtcgctgtgg

SEQ ID NO: 4609 - DNA, 23 bp, Artificial Sequence
  HLA-A targeting gRNA
caccgtggtggttgtggtgttgg

SEQ ID NO: 4610 - DNA, 23 bp, Artificial Sequence
  HLA-A targeting gRNA
cacctcatggagtgggagcctgg

SEQ ID NO: 4611 - DNA, 23 bp, Artificial Sequence
  HLA-A targeting gRNA
cacctcccggcgcggctccccgg

SEQ ID NO: 4612 - DNA, 23 bp, Artificial Sequence
  HLA-A targeting gRNA
cacctccctgcgccgctccccgg

SEQ ID NO: 4613 - DNA, 23 bp, Artificial Sequence
  HLA-A targeting gRNA
cacctccctgcgcggctccccgg

SEQ ID NO: 4614 - DNA, 23 bp, Artificial Sequence
  HLA-A targeting gRNA
cacctcgatggttgtggtgttgg

SEQ ID NO: 4615 - DNA, 23 bp, Artificial Sequence
  HLA-A targeting gRNA
cacctcgttcctctccgcagagg

SEQ ID NO: 4616 - DNA, 23 bp, Artificial Sequence
  HLA-A targeting gRNA
cacctgggccatcccagcctggg

SEQ ID NO: 4617 - DNA, 23 bp, Artificial Sequence
  HLA-A targeting gRNA
caccttaatggttgtggtgttgg

SEQ ID NO: 4618 - DNA, 23 bp, Artificial Sequence
  HLA-A targeting gRNA
caccttcccctcctttcccaggg

SEQ ID NO: 4619 - DNA, 23 bp, Artificial Sequence
  HLA-A targeting gRNA
caccttgatattatggtgttggg

SEQ ID NO: 4620 - DNA, 23 bp, Artificial Sequence
  HLA-A targeting gRNA
caccttgatgattatggtgttgg

SEQ ID NO: 4621 - DNA, 23 bp, Artificial Sequence
  HLA-A targeting gRNA
caccttgatggttgtggtgttgg

SEQ ID NO: 4622 - DNA, 23 bp, Artificial Sequence
  HLA-A targeting gRNA
caccttggtggttgtggcgttgg

SEQ ID NO: 4623 - DNA, 23 bp, Artificial Sequence
  HLA-A targeting gRNA
caccttggtggttgtggtgttgg

SEQ ID NO: 4624 - DNA, 23 bp, Artificial Sequence
  HLA-A targeting gRNA
cacgaacgtgccctccaggtagg

SEQ ID NO: 4625 - DNA, 23 bp, Artificial Sequence
  HLA-A targeting gRNA
cacgagaagaagaggaaaatggg

SEQ ID NO: 4626 - DNA, 23 bp, Artificial Sequence
  HLA-A targeting gRNA
cacgagaagaggaggaaaatggg

SEQ ID NO: 4627 - DNA, 23 bp, Artificial Sequence
  HLA-A targeting gRNA
cacgaggaagggaggaaaatggg

SEQ ID NO: 4628 - DNA, 23 bp, Artificial Sequence
  HLA-A targeting gRNA
cacgaggaggggaggaaaatggg

SEQ ID NO: 4629 - DNA, 23 bp, Artificial Sequence
  HLA-A targeting gRNA
cacgatggggacagtggactggg

SEQ ID NO: 4630 - DNA, 23 bp, Artificial Sequence
  HLA-A targeting gRNA
cacgatggggacggtggactggg

SEQ ID NO: 4631 - DNA, 23 bp, Artificial Sequence
  HLA-A targeting gRNA
cacgatggggacggtggattggg

SEQ ID NO: 4632 - DNA, 23 bp, Artificial Sequence
  HLA-A targeting gRNA
cacgatggggatggtggactggg

SEQ ID NO: 4633 - DNA, 23 bp, Artificial Sequence
  HLA-A targeting gRNA
cacgcacagaccctccaggtagg

SEQ ID NO: 4634 - DNA, 23 bp, Artificial Sequence
  HLA-A targeting gRNA
cacgcacaggccctcccggtagg

SEQ ID NO: 4635 - DNA, 23 bp, Artificial Sequence
  HLA-A targeting gRNA
cacgcacgtgcccaccaggtagg

SEQ ID NO: 4636 - DNA, 23 bp, Artificial Sequence
  HLA-A targeting gRNA
cacgcacgtgccctccaggtggg

SEQ ID NO: 4637 - DNA, 23 bp, Artificial Sequence
  HLA-A targeting gRNA
cacgcacgtgtcctccaggtagg

SEQ ID NO: 4638 - DNA, 23 bp, Artificial Sequence
  HLA-A targeting gRNA
cacgcacgttccctccaggtagg

SEQ ID NO: 4639 - DNA, 23 bp, Artificial Sequence
  HLA-A targeting gRNA
cacgcactcgccctccaggcagg

SEQ ID NO: 4640 - DNA, 23 bp, Artificial Sequence
  HLA-A targeting gRNA
cacgcacttgccctccaggtagg

SEQ ID NO: 4641 - DNA, 23 bp, Artificial Sequence
  HLA-A targeting gRNA
cacgcgcgtgccctccaggtagg

SEQ ID NO: 4642 - DNA, 23 bp, Artificial Sequence
  HLA-A targeting gRNA
cacgcgggtaccaggggcagtgg

SEQ ID NO: 4643 - DNA, 23 bp, Artificial Sequence
  HLA-A targeting gRNA
cacgtacgtgccctccaggtagg

SEQ ID NO: 4644 - DNA, 23 bp, Artificial Sequence
  HLA-A targeting gRNA
cacgtcccggcccggccgcgggg

SEQ ID NO: 4645 - DNA, 23 bp, Artificial Sequence
  HLA-A targeting gRNA
cacgtgccatatgcagcacgagg

SEQ ID NO: 4646 - DNA, 23 bp, Artificial Sequence
  HLA-A targeting gRNA
cacgtgccatgtgcagcacgagg

SEQ ID NO: 4647 - DNA, 23 bp, Artificial Sequence
  HLA-A targeting gRNA
cacgtgccatgtgcagcatgagg

SEQ ID NO: 4648 - DNA, 23 bp, Artificial Sequence
  HLA-A targeting gRNA
cacgtgccatgttcagcacgagg

SEQ ID NO: 4649 - DNA, 23 bp, Artificial Sequence
  HLA-A targeting gRNA
cacgtgggccatcccagcctggg

SEQ ID NO: 4650 - DNA, 23 bp, Artificial Sequence
  HLA-A targeting gRNA
cactacaaccagagcgaggccgg

SEQ ID NO: 4651 - DNA, 23 bp, Artificial Sequence
  HLA-A targeting gRNA
cactcacgtgccctccaggtagg

SEQ ID NO: 4652 - DNA, 23 bp, Artificial Sequence
  HLA-A targeting gRNA
cactcagcgcaagttggaggcgg

SEQ ID NO: 4653 - DNA, 23 bp, Artificial Sequence
  HLA-A targeting gRNA
cactcggtcagtctgtgcctggg

SEQ ID NO: 4654 - DNA, 23 bp, Artificial Sequence
  HLA-A targeting gRNA
cactcggtcagtctgtgccttgg

SEQ ID NO: 4655 - DNA, 23 bp, Artificial Sequence
  HLA-A targeting gRNA
cactgacctggcagtgggatggg

SEQ ID NO: 4656 - DNA, 23 bp, Artificial Sequence
  HLA-A targeting gRNA
cactgatctggcagtgggatggg

SEQ ID NO: 4657 - DNA, 23 bp, Artificial Sequence
  HLA-A targeting gRNA
cactggagggtgtgagaccctgg

SEQ ID NO: 4658 - DNA, 23 bp, Artificial Sequence
  HLA-A targeting gRNA
cactgggagtttcaagccccagg

SEQ ID NO: 4659 - DNA, 23 bp, Artificial Sequence
  HLA-A targeting gRNA
cactggggaggcgccgcgttggg

SEQ ID NO: 4660 - DNA, 23 bp, Artificial Sequence
  HLA-A targeting gRNA
cactgggggtttcaagccccagg

SEQ ID NO: 4661 - DNA, 23 bp, Artificial Sequence
  HLA-A targeting gRNA
cacttctcccaacctgcgtcggg

SEQ ID NO: 4662 - DNA, 23 bp, Artificial Sequence
  HLA-A targeting gRNA
cacttcttctcccaacttgtggg

SEQ ID NO: 4663 - DNA, 23 bp, Artificial Sequence
  HLA-A targeting gRNA
cacttgtaaaggtgagattctgg

SEQ ID NO: 4664 - DNA, 23 bp, Artificial Sequence
  HLA-A targeting gRNA
cactttacctccactcagatcgg

SEQ ID NO: 4665 - DNA, 23 bp, Artificial Sequence
  HLA-A targeting gRNA
cagaaacgatgcccaagttgggg

SEQ ID NO: 4666 - DNA, 23 bp, Artificial Sequence
  HLA-A targeting gRNA
cagacacctgaagaatgggaagg

SEQ ID NO: 4667 - DNA, 23 bp, Artificial Sequence
  HLA-A targeting gRNA
cagacacctggagaacaggaagg

SEQ ID NO: 4668 - DNA, 23 bp, Artificial Sequence
  HLA-A targeting gRNA
cagacactttgcatctctcttgg

SEQ ID NO: 4669 - DNA, 23 bp, Artificial Sequence
  HLA-A targeting gRNA
cagacgccagcctggacacaggg

SEQ ID NO: 4670 - DNA, 23 bp, Artificial Sequence
  HLA-A targeting gRNA
cagagcccctcaccctgagatgg

SEQ ID NO: 4671 - DNA, 23 bp, Artificial Sequence
  HLA-A targeting gRNA
cagagtaagtgctagcacacagg

SEQ ID NO: 4672 - DNA, 23 bp, Artificial Sequence
  HLA-A targeting gRNA
cagagtaagtgctggcacacagg

SEQ ID NO: 4673 - DNA, 23 bp, Artificial Sequence
  HLA-A targeting gRNA
cagatacctgaagaaagggaagg

SEQ ID NO: 4674 - DNA, 23 bp, Artificial Sequence
  HLA-A targeting gRNA
cagatacctgaagaatgggaagg

SEQ ID NO: 4675 - DNA, 23 bp, Artificial Sequence
  HLA-A targeting gRNA
cagatacctggagaaagggaagg

SEQ ID NO: 4676 - DNA, 23 bp, Artificial Sequence
  HLA-A targeting gRNA
cagatacctggagaaccggaagg

SEQ ID NO: 4677 - DNA, 23 bp, Artificial Sequence
  HLA-A targeting gRNA
cagatacctggagaatgggaagg

SEQ ID NO: 4678 - DNA, 23 bp, Artificial Sequence
  HLA-A targeting gRNA
cagatatctggagaacgggaagg

SEQ ID NO: 4679 - DNA, 23 bp, Artificial Sequence
  HLA-A targeting gRNA
cagatcagtgtgatctccgcagg

SEQ ID NO: 4680 - DNA, 23 bp, Artificial Sequence
  HLA-A targeting gRNA
cagcaacaatgcccacgatgggg

SEQ ID NO: 4681 - DNA, 23 bp, Artificial Sequence
  HLA-A targeting gRNA
cagcaacgatgcccacgatgggg

SEQ ID NO: 4682 - DNA, 23 bp, Artificial Sequence
  HLA-A targeting gRNA
cagcaacgatgcccatgatgggg

SEQ ID NO: 4683 - DNA, 23 bp, Artificial Sequence
  HLA-A targeting gRNA
cagcagcgaccacagctcctagg

SEQ ID NO: 4684 - DNA, 23 bp, Artificial Sequence
  HLA-A targeting gRNA
cagcatcatgagtcaggggaagg

SEQ ID NO: 4685 - DNA, 23 bp, Artificial Sequence
  HLA-A targeting gRNA
cagcatgaggggcttcggtaagg

SEQ ID NO: 4686 - DNA, 23 bp, Artificial Sequence
  HLA-A targeting gRNA
cagcccaccatccccaacttggg

SEQ ID NO: 4687 - DNA, 23 bp, Artificial Sequence
  HLA-A targeting gRNA
cagcccaccatccccatcatggg

SEQ ID NO: 4688 - DNA, 23 bp, Artificial Sequence
  HLA-A targeting gRNA
cagcccggacgcaggcacctggg

SEQ ID NO: 4689 - DNA, 23 bp, Artificial Sequence
  HLA-A targeting gRNA
cagcctaccatccccatcatggg

SEQ ID NO: 4690 - DNA, 23 bp, Artificial Sequence
  HLA-A targeting gRNA
cagcctggacacagggacctggg

SEQ ID NO: 4691 - DNA, 23 bp, Artificial Sequence
  HLA-A targeting gRNA
cagcctggacgcaggcacctggg

SEQ ID NO: 4692 - DNA, 23 bp, Artificial Sequence
  HLA-A targeting gRNA
cagcgacgccgcgagtccgaggg

SEQ ID NO: 4693 - DNA, 23 bp, Artificial Sequence
  HLA-A targeting gRNA
cagcgcaagtgggaggcggccgg

SEQ ID NO: 4694 - DNA, 23 bp, Artificial Sequence
  HLA-A targeting gRNA
cagcggagaacctacctggaggg

SEQ ID NO: 4695 - DNA, 23 bp, Artificial Sequence
  HLA-A targeting gRNA
cagcggagagcctacctggaggg

SEQ ID NO: 4696 - DNA, 23 bp, Artificial Sequence
  HLA-A targeting gRNA
cagctaagagcctacctggaggg

SEQ ID NO: 4697 - DNA, 23 bp, Artificial Sequence
  HLA-A targeting gRNA
cagctactacaaccagagcgagg

SEQ ID NO: 4698 - DNA, 23 bp, Artificial Sequence
  HLA-A targeting gRNA
cagctgagaacctacctggaggg

SEQ ID NO: 4699 - DNA, 23 bp, Artificial Sequence
  HLA-A targeting gRNA
cagctgagagcctaccgggaggg

SEQ ID NO: 4700 - DNA, 23 bp, Artificial Sequence
  HLA-A targeting gRNA
cagctgagagcctacctggtggg

SEQ ID NO: 4701 - DNA, 23 bp, Artificial Sequence
  HLA-A targeting gRNA
cagctgagagcctgcctggaggg

SEQ ID NO: 4702 - DNA, 23 bp, Artificial Sequence
  HLA-A targeting gRNA
caggaagaaggacccgacgcagg

SEQ ID NO: 4703 - DNA, 23 bp, Artificial Sequence
  HLA-A targeting gRNA
caggaagaaggacccgtcgcagg

SEQ ID NO: 4704 - DNA, 23 bp, Artificial Sequence
  HLA-A targeting gRNA
caggacacctggggtagggaagg

SEQ ID NO: 4705 - DNA, 23 bp, Artificial Sequence
  HLA-A targeting gRNA
caggacacctggggtggggaagg

SEQ ID NO: 4706 - DNA, 23 bp, Artificial Sequence
  HLA-A targeting gRNA
caggacacctggtgtggggaagg

SEQ ID NO: 4707 - DNA, 23 bp, Artificial Sequence
  HLA-A targeting gRNA
caggacagagcctacctggaggg

SEQ ID NO: 4708 - DNA, 23 bp, Artificial Sequence
  HLA-A targeting gRNA
caggacccgggaagccgcgcagg

SEQ ID NO: 4709 - DNA, 23 bp, Artificial Sequence
  HLA-A targeting gRNA
caggacccggggagccgcgcagg

SEQ ID NO: 4710 - DNA, 23 bp, Artificial Sequence
  HLA-A targeting gRNA
caggacccggggagccgcgccgg

SEQ ID NO: 4711 - DNA, 23 bp, Artificial Sequence
  HLA-A targeting gRNA
caggacccggggagcggcgcagg

SEQ ID NO: 4712 - DNA, 23 bp, Artificial Sequence
  HLA-A targeting gRNA
caggacctgaggagccgcgccgg

SEQ ID NO: 4713 - DNA, 23 bp, Artificial Sequence
  HLA-A targeting gRNA
caggacgaagtcccaggccccgg

SEQ ID NO: 4714 - DNA, 23 bp, Artificial Sequence
  HLA-A targeting gRNA
caggacgaagtcccaggtcccgg

SEQ ID NO: 4715 - DNA, 23 bp, Artificial Sequence
  HLA-A targeting gRNA
caggacgaagtcccatgtcccgg

SEQ ID NO: 4716 - DNA, 23 bp, Artificial Sequence
  HLA-A targeting gRNA
caggccgggacacggaggtgtgg

SEQ ID NO: 4717 - DNA, 23 bp, Artificial Sequence
  HLA-A targeting gRNA
caggcgctttgcatctctcatgg

SEQ ID NO: 4718 - DNA, 23 bp, Artificial Sequence
  HLA-A targeting gRNA
caggcgctttgcatctttcatgg

SEQ ID NO: 4719 - DNA, 23 bp, Artificial Sequence
  HLA-A targeting gRNA
caggcgggggcgcaggacccggg

SEQ ID NO: 4720 - DNA, 23 bp, Artificial Sequence
  HLA-A targeting gRNA
caggcgggggctcaggacccggg

SEQ ID NO: 4721 - DNA, 23 bp, Artificial Sequence
  HLA-A targeting gRNA
caggctgcgtgtaagtgatgggg

SEQ ID NO: 4722 - DNA, 23 bp, Artificial Sequence
  HLA-A targeting gRNA
caggctgcgtgtaagtggtgggg

SEQ ID NO: 4723 - DNA, 23 bp, Artificial Sequence
  HLA-A targeting gRNA
cagggcaggatcaggaaacacgg

SEQ ID NO: 4724 - DNA, 23 bp, Artificial Sequence
  HLA-A targeting gRNA
cagggcaggatcaggaaacatgg

SEQ ID NO: 4725 - DNA, 23 bp, Artificial Sequence
  HLA-A targeting gRNA
cagggcggggcggggctcggggg

SEQ ID NO: 4726 - DNA, 23 bp, Artificial Sequence
  HLA-A targeting gRNA
cagggggcggatctcggacccgg

SEQ ID NO: 4727 - DNA, 23 bp, Artificial Sequence
  HLA-A targeting gRNA
caggggggtggtggggcagaggg

SEQ ID NO: 4728 - DNA, 23 bp, Artificial Sequence
  HLA-A targeting gRNA
cagggtctcacaccatccagagg

SEQ ID NO: 4729 - DNA, 23 bp, Artificial Sequence
  HLA-A targeting gRNA
cagggtctcacacccgccagagg

SEQ ID NO: 4730 - DNA, 23 bp, Artificial Sequence
  HLA-A targeting gRNA
cagggtctcacaccctccagagg

SEQ ID NO: 4731 - DNA, 23 bp, Artificial Sequence
  HLA-A targeting gRNA
cagggtctcacaccctccagcgg

SEQ ID NO: 4732 - DNA, 23 bp, Artificial Sequence
  HLA-A targeting gRNA
cagggtctcacaccctccagtgg

SEQ ID NO: 4733 - DNA, 23 bp, Artificial Sequence
  HLA-A targeting gRNA
cagggtctcacaccttccagagg

SEQ ID NO: 4734 - DNA, 23 bp, Artificial Sequence
  HLA-A targeting gRNA
cagggtctcacacttggcagagg

SEQ ID NO: 4735 - DNA, 23 bp, Artificial Sequence
  HLA-A targeting gRNA
cagggtctcacatcatccagagg

SEQ ID NO: 4736 - DNA, 23 bp, Artificial Sequence
  HLA-A targeting gRNA
cagggtctcacatcatccggagg

SEQ ID NO: 4737 - DNA, 23 bp, Artificial Sequence
  HLA-A targeting gRNA
cagggtctcacatcctccagagg

SEQ ID NO: 4738 - DNA, 23 bp, Artificial Sequence
  HLA-A targeting gRNA
cagggtctcataccctccagagg

SEQ ID NO: 4739 - DNA, 23 bp, Artificial Sequence
  HLA-A targeting gRNA
caggtaggctctcagctgctcgg

SEQ ID NO: 4740 - DNA, 23 bp, Artificial Sequence
  HLA-A targeting gRNA
caggtcagggctgaggcttgggg

SEQ ID NO: 4741 - DNA, 23 bp, Artificial Sequence
  HLA-A targeting gRNA
caggtcagtgtgatctccccagg

SEQ ID NO: 4742 - DNA, 23 bp, Artificial Sequence
  HLA-A targeting gRNA
caggtcagtgtgatctccgtagg

SEQ ID NO: 4743 - DNA, 23 bp, Artificial Sequence
  HLA-A targeting gRNA
caggtgtcccgtccattctcagg

SEQ ID NO: 4744 - DNA, 23 bp, Artificial Sequence
  HLA-A targeting gRNA
caggtgtcctgcccattctcagg

SEQ ID NO: 4745 - DNA, 23 bp, Artificial Sequence
  HLA-A targeting gRNA
caggtgtcctgtccattctcagg

SEQ ID NO: 4746 - DNA, 23 bp, Artificial Sequence
  HLA-A targeting gRNA
caggtgtcctgtccgttctcagg

SEQ ID NO: 4747 - DNA, 23 bp, Artificial Sequence
  HLA-A targeting gRNA
cagtccaccatccccatcgtggg

SEQ ID NO: 4748 - DNA, 23 bp, Artificial Sequence
  HLA-A targeting gRNA
cagtccaccgtccccatcgtggg

SEQ ID NO: 4749 - DNA, 23 bp, Artificial Sequence
  HLA-A targeting gRNA
cagtccactgtccccatcgtggg

SEQ ID NO: 4750 - DNA, 23 bp, Artificial Sequence
  HLA-A targeting gRNA
cagtccctagaatactgatcagg

SEQ ID NO: 4751 - DNA, 23 bp, Artificial Sequence
  HLA-A targeting gRNA
cagtccctaggatagtgatcagg

SEQ ID NO: 4752 - DNA, 23 bp, Artificial Sequence
  HLA-A targeting gRNA
cagtccctataatactgatcagg

SEQ ID NO: 4753 - DNA, 23 bp, Artificial Sequence
  HLA-A targeting gRNA
cagtccctggaatactgatcagg

SEQ ID NO: 4754 - DNA, 23 bp, Artificial Sequence
  HLA-A targeting gRNA
cagtgagtgaccccggcccgggg

SEQ ID NO: 4755 - DNA, 23 bp, Artificial Sequence
  HLA-A targeting gRNA
cagtgcagagcctacctggaggg

SEQ ID NO: 4756 - DNA, 23 bp, Artificial Sequence
  HLA-A targeting gRNA
cagtggacacaagggtgggctgg

SEQ ID NO: 4757 - DNA, 23 bp, Artificial Sequence
  HLA-A targeting gRNA
cagtggacacgggggtgggctgg

SEQ ID NO: 4758 - DNA, 23 bp, Artificial Sequence
  HLA-A targeting gRNA
cagtggagagcccacctggaggg

SEQ ID NO: 4759 - DNA, 23 bp, Artificial Sequence
  HLA-A targeting gRNA
cagtggagagtctacctggaggg

SEQ ID NO: 4760 - DNA, 23 bp, Artificial Sequence
  HLA-A targeting gRNA
cagtggccctgaccgagacctgg

SEQ ID NO: 4761 - DNA, 23 bp, Artificial Sequence
  HLA-A targeting gRNA
cagtggtcaaagtggtcaaaggg

SEQ ID NO: 4762 - DNA, 23 bp, Artificial Sequence
  HLA-A targeting gRNA
cagtggtcgaagtggtcaaaggg

SEQ ID NO: 4763 - DNA, 23 bp, Artificial Sequence
  HLA-A targeting gRNA
cagttcgcctacgacggcaaggg

SEQ ID NO: 4764 - DNA, 23 bp, Artificial Sequence
  HLA-A targeting gRNA
cataaccaggacgcctacgacgg

SEQ ID NO: 4765 - DNA, 23 bp, Artificial Sequence
  HLA-A targeting gRNA
cataaccagtacgcctacgacgg

SEQ ID NO: 4766 - DNA, 23 bp, Artificial Sequence
  HLA-A targeting gRNA
cataaccagtactcctacgacgg

SEQ ID NO: 4767 - DNA, 23 bp, Artificial Sequence
  HLA-A targeting gRNA
cataaccagttagcctacgacgg

SEQ ID NO: 4768 - DNA, 23 bp, Artificial Sequence
  HLA-A targeting gRNA
cataaccagttcgcctacgacgg

SEQ ID NO: 4769 - DNA, 23 bp, Artificial Sequence
  HLA-A targeting gRNA
cataaccagtttgcctacgacgg

SEQ ID NO: 4770 - DNA, 23 bp, Artificial Sequence
  HLA-A targeting gRNA
catacccgcggaggaggcgccgg

SEQ ID NO: 4771 - DNA, 23 bp, Artificial Sequence
  HLA-A targeting gRNA
cataccctccagaggatgtacgg

SEQ ID NO: 4772 - DNA, 23 bp, Artificial Sequence
  HLA-A targeting gRNA
catactgctcatacccgcggagg

SEQ ID NO: 4773 - DNA, 23 bp, Artificial Sequence
  HLA-A targeting gRNA
catagcccacggtgatgaagcgg

SEQ ID NO: 4774 - DNA, 23 bp, Artificial Sequence
  HLA-A targeting gRNA
catccagcgcaagtgggaggcgg

SEQ ID NO: 4775 - DNA, 23 bp, Artificial Sequence
  HLA-A targeting gRNA
catctcagggtgaggggctccgg

SEQ ID NO: 4776 - DNA, 23 bp, Artificial Sequence
  HLA-A targeting gRNA
catctcagggtgaggggctctgg

SEQ ID NO: 4777 - DNA, 23 bp, Artificial Sequence
  HLA-A targeting gRNA
catctcagggtgaggggcttcgg

SEQ ID NO: 4778 - DNA, 23 bp, Artificial Sequence
  HLA-A targeting gRNA
catctcagggtgaggggctttgg

SEQ ID NO: 4779 - DNA, 23 bp, Artificial Sequence
  HLA-A targeting gRNA
catctctcataggacaccctagg

SEQ ID NO: 4780 - DNA, 23 bp, Artificial Sequence
  HLA-A targeting gRNA
catctctcatggcacaccctagg

SEQ ID NO: 4781 - DNA, 23 bp, Artificial Sequence
  HLA-A targeting gRNA
catctctcatgggacaccctagg

SEQ ID NO: 4782 - DNA, 23 bp, Artificial Sequence
  HLA-A targeting gRNA
catctttcatgggacaccctagg

SEQ ID NO: 4783 - DNA, 23 bp, Artificial Sequence
  HLA-A targeting gRNA
catgaccagtacgcctacgacgg

SEQ ID NO: 4784 - DNA, 23 bp, Artificial Sequence
  HLA-A targeting gRNA
catgaccagtccgcctacgacgg

SEQ ID NO: 4785 - DNA, 23 bp, Artificial Sequence
  HLA-A targeting gRNA
catgaccagtccgcctaggacgg

SEQ ID NO: 4786 - DNA, 23 bp, Artificial Sequence
  HLA-A targeting gRNA
catgaccagtccgcctgcgacgg

SEQ ID NO: 4787 - DNA, 23 bp, Artificial Sequence
  HLA-A targeting gRNA
catgaccagttagcctacgacgg

SEQ ID NO: 4788 - DNA, 23 bp, Artificial Sequence
  HLA-A targeting gRNA
catgaccagttcgcctacgacgg

SEQ ID NO: 4789 - DNA, 23 bp, Artificial Sequence
  HLA-A targeting gRNA
catgacccggcccggccgcgggg

SEQ ID NO: 4790 - DNA, 23 bp, Artificial Sequence
  HLA-A targeting gRNA
catgaggggcttcggtaaggagg

SEQ ID NO: 4791 - DNA, 23 bp, Artificial Sequence
  HLA-A targeting gRNA
catgatggggatggtaggctggg

SEQ ID NO: 4792 - DNA, 23 bp, Artificial Sequence
  HLA-A targeting gRNA
catgatggggatggtgggctggg

SEQ ID NO: 4793 - DNA, 23 bp, Artificial Sequence
  HLA-A targeting gRNA
catgcacgtgccctccaggtagg

SEQ ID NO: 4794 - DNA, 23 bp, Artificial Sequence
  HLA-A targeting gRNA
catgccaggtacagcatgagggg

SEQ ID NO: 4795 - DNA, 23 bp, Artificial Sequence
  HLA-A targeting gRNA
catgccatgtacagcatgagggg

SEQ ID NO: 4796 - DNA, 23 bp, Artificial Sequence
  HLA-A targeting gRNA
catgctgcttcccagtaatgagg

SEQ ID NO: 4797 - DNA, 23 bp, Artificial Sequence
  HLA-A targeting gRNA
catggcccagcacctcagggtgg

SEQ ID NO: 4798 - DNA, 23 bp, Artificial Sequence
  HLA-A targeting gRNA
catgggcatcgttgctggcctgg

SEQ ID NO: 4799 - DNA, 23 bp, Artificial Sequence
  HLA-A targeting gRNA
catggtcagagacgagatggtgg

SEQ ID NO: 4800 - DNA, 23 bp, Artificial Sequence
  HLA-A targeting gRNA
catggtcagagacgggatggtgg

SEQ ID NO: 4801 - DNA, 23 bp, Artificial Sequence
  HLA-A targeting gRNA
catggtcagagacggggtggtgg

SEQ ID NO: 4802 - DNA, 23 bp, Artificial Sequence
  HLA-A targeting gRNA
catggtcagagagggggtggtgg

SEQ ID NO: 4803 - DNA, 23 bp, Artificial Sequence
  HLA-A targeting gRNA
catggtcagagatgggatggtgg

SEQ ID NO: 4804 - DNA, 23 bp, Artificial Sequence
  HLA-A targeting gRNA
catgtcccggcccggccgtgggg

SEQ ID NO: 4805 - DNA, 23 bp, Artificial Sequence
  HLA-A targeting gRNA
catgtcccggcccggctgcgggg

SEQ ID NO: 4806 - DNA, 23 bp, Artificial Sequence
  HLA-A targeting gRNA
catgtcccggcctggccgcgggg

SEQ ID NO: 4807 - DNA, 23 bp, Artificial Sequence
  HLA-A targeting gRNA
catgtgaccagcctgagaatggg

SEQ ID NO: 4808 - DNA, 23 bp, Artificial Sequence
  HLA-A targeting gRNA
cattctcaggatagtcacatggg

SEQ ID NO: 4809 - DNA, 23 bp, Artificial Sequence
  HLA-A targeting gRNA
cattctcaggatggtcacatggg

SEQ ID NO: 4810 - DNA, 23 bp, Artificial Sequence
  HLA-A targeting gRNA
cattctcaggctggtcacatggg

SEQ ID NO: 4811 - DNA, 23 bp, Artificial Sequence
  HLA-A targeting gRNA
cattggggaggcgcagcattggg

SEQ ID NO: 4812 - DNA, 23 bp, Artificial Sequence
  HLA-A targeting gRNA
cattggggaggcgcagcgttggg

SEQ ID NO: 4813 - DNA, 23 bp, Artificial Sequence
  HLA-A targeting gRNA
cattggggaggcgccgcgttggg

SEQ ID NO: 4814 - DNA, 23 bp, Artificial Sequence
  HLA-A targeting gRNA
cattttcctcccctcctcgtggg

SEQ ID NO: 4815 - DNA, 23 bp, Artificial Sequence
  HLA-A targeting gRNA
cattttcctcccttcctcgtggg

SEQ ID NO: 4816 - DNA, 23 bp, Artificial Sequence
  HLA-A targeting gRNA
cattttcctcctcttctcgtggg

SEQ ID NO: 4817 - DNA, 23 bp, Artificial Sequence
  HLA-A targeting gRNA
cattttcctcttcttctcgtggg

SEQ ID NO: 4818 - DNA, 23 bp, Artificial Sequence
  HLA-A targeting gRNA
cattttcctcttcttctcgttgg

SEQ ID NO: 4819 - DNA, 23 bp, Artificial Sequence
  HLA-A targeting gRNA
ccaaacaccagcctggacgcagg

SEQ ID NO: 4820 - DNA, 23 bp, Artificial Sequence
  HLA-A targeting gRNA
ccaaacccctcaccctgagatgg

SEQ ID NO: 4821 - DNA, 23 bp, Artificial Sequence
  HLA-A targeting gRNA
ccaaccccgacgtacggcccggg

SEQ ID NO: 4822 - DNA, 23 bp, Artificial Sequence
  HLA-A targeting gRNA
ccaagggccgtgtctgcactggg

SEQ ID NO: 4823 - DNA, 23 bp, Artificial Sequence
  HLA-A targeting gRNA
ccaagggccgtgtctgcattggg

SEQ ID NO: 4824 - DNA, 23 bp, Artificial Sequence
  HLA-A targeting gRNA
ccaagttggggatggtgggctgg

SEQ ID NO: 4825 - DNA, 23 bp, Artificial Sequence
  HLA-A targeting gRNA
ccaatccaccgtccccatcgtgg

SEQ ID NO: 4826 - DNA, 23 bp, Artificial Sequence
  HLA-A targeting gRNA
ccaatgggagtgggaattggggg

SEQ ID NO: 4827 - DNA, 23 bp, Artificial Sequence
  HLA-A targeting gRNA
ccacaactgctaggacagccagg

SEQ ID NO: 4828 - DNA, 23 bp, Artificial Sequence
  HLA-A targeting gRNA
ccacagctacggtgaccacaagg

SEQ ID NO: 4829 - DNA, 23 bp, Artificial Sequence
  HLA-A targeting gRNA
ccacagctccaaggacagctagg

SEQ ID NO: 4830 - DNA, 23 bp, Artificial Sequence
  HLA-A targeting gRNA
ccacagctcctaggacagctagg

SEQ ID NO: 4831 - DNA, 23 bp, Artificial Sequence
  HLA-A targeting gRNA
ccaccacagctgtccacttctgg

SEQ ID NO: 4832 - DNA, 23 bp, Artificial Sequence
  HLA-A targeting gRNA
ccaccccctctctgaccatgagg

SEQ ID NO: 4833 - DNA, 23 bp, Artificial Sequence
  HLA-A targeting gRNA
ccaccccgtctctgaccatgagg

SEQ ID NO: 4834 - DNA, 23 bp, Artificial Sequence
  HLA-A targeting gRNA
ccacctggagggcacgtgcgtgg

SEQ ID NO: 4835 - DNA, 23 bp, Artificial Sequence
  HLA-A targeting gRNA
ccacgagaagaagaggaaaatgg

SEQ ID NO: 4836 - DNA, 23 bp, Artificial Sequence
  HLA-A targeting gRNA
ccacgagaagaggaggaaaatgg

SEQ ID NO: 4837 - DNA, 23 bp, Artificial Sequence
  HLA-A targeting gRNA
ccacgaggaagggaggaaaatgg

SEQ ID NO: 4838 - DNA, 23 bp, Artificial Sequence
  HLA-A targeting gRNA
ccacgaggaggggaggaaaatgg

SEQ ID NO: 4839 - DNA, 23 bp, Artificial Sequence
  HLA-A targeting gRNA
ccacgatggggacagtggactgg

SEQ ID NO: 4840 - DNA, 23 bp, Artificial Sequence
  HLA-A targeting gRNA
ccacgatggggacggtggactgg

SEQ ID NO: 4841 - DNA, 23 bp, Artificial Sequence
  HLA-A targeting gRNA
ccacgatggggacggtggattgg

SEQ ID NO: 4842 - DNA, 23 bp, Artificial Sequence
  HLA-A targeting gRNA
ccacgatggggatggtggactgg

SEQ ID NO: 4843 - DNA, 23 bp, Artificial Sequence
  HLA-A targeting gRNA
ccacgcacgtgccctccaggtgg

SEQ ID NO: 4844 - DNA, 23 bp, Artificial Sequence
  HLA-A targeting gRNA
ccacgccgcgagtccgaggacgg

SEQ ID NO: 4845 - DNA, 23 bp, Artificial Sequence
  HLA-A targeting gRNA
ccacggaggaggcgcccgtccgg

SEQ ID NO: 4846 - DNA, 23 bp, Artificial Sequence
  HLA-A targeting gRNA
ccacgtcccggcccggccgcggg

SEQ ID NO: 4847 - DNA, 23 bp, Artificial Sequence
  HLA-A targeting gRNA
ccactgcagcagctgtggtcagg

SEQ ID NO: 4848 - DNA, 23 bp, Artificial Sequence
  HLA-A targeting gRNA
ccactgccccccagagcagcagg

SEQ ID NO: 4849 - DNA, 23 bp, Artificial Sequence
  HLA-A targeting gRNA
ccactgccccctagagcagcagg

SEQ ID NO: 4850 - DNA, 23 bp, Artificial Sequence
  HLA-A targeting gRNA
ccactgcggcagctgtggtcagg

SEQ ID NO: 4851 - DNA, 23 bp, Artificial Sequence
  HLA-A targeting gRNA
ccactggggtttcaagccccagg

SEQ ID NO: 4852 - DNA, 23 bp, Artificial Sequence
  HLA-A targeting gRNA
ccagaaacgatgcccaagttggg

SEQ ID NO: 4853 - DNA, 23 bp, Artificial Sequence
  HLA-A targeting gRNA
ccagaagtggacagctgtggtgg

SEQ ID NO: 4854 - DNA, 23 bp, Artificial Sequence
  HLA-A targeting gRNA
ccagaagtgggcagctgtgatgg

SEQ ID NO: 4855 - DNA, 23 bp, Artificial Sequence
  HLA-A targeting gRNA
ccagacaccagcccggacgcagg

SEQ ID NO: 4856 - DNA, 23 bp, Artificial Sequence
  HLA-A targeting gRNA
ccagacaccagcctggacgcagg

SEQ ID NO: 4857 - DNA, 23 bp, Artificial Sequence
  HLA-A targeting gRNA
ccagacgccagcctggacacagg

SEQ ID NO: 4858 - DNA, 23 bp, Artificial Sequence
  HLA-A targeting gRNA
ccagcaacaatgcccacgatggg

SEQ ID NO: 4859 - DNA, 23 bp, Artificial Sequence
  HLA-A targeting gRNA
ccagcaacgatgcccacgatggg

SEQ ID NO: 4860 - DNA, 23 bp, Artificial Sequence
  HLA-A targeting gRNA
ccagcaacgatgcccatgatggg

SEQ ID NO: 4861 - DNA, 23 bp, Artificial Sequence
  HLA-A targeting gRNA
ccagccagcaacagtgcccaggg

SEQ ID NO: 4862 - DNA, 23 bp, Artificial Sequence
  HLA-A targeting gRNA
ccagccagcgacagtgcccaggg

SEQ ID NO: 4863 - DNA, 23 bp, Artificial Sequence
  HLA-A targeting gRNA
ccagcccaccatccccaacttgg

SEQ ID NO: 4864 - DNA, 23 bp, Artificial Sequence
  HLA-A targeting gRNA
ccagcccaccatccccatcatgg

SEQ ID NO: 4865 - DNA, 23 bp, Artificial Sequence
  HLA-A targeting gRNA
ccagccccgaccaacccgcgggg

SEQ ID NO: 4866 - DNA, 23 bp, Artificial Sequence
  HLA-A targeting gRNA
ccagcccggacgcaggcacctgg

SEQ ID NO: 4867 - DNA, 23 bp, Artificial Sequence
  HLA-A targeting gRNA
ccagccgtacatcctctggaggg

SEQ ID NO: 4868 - DNA, 23 bp, Artificial Sequence
  HLA-A targeting gRNA
ccagcctaccatccccatcatgg

SEQ ID NO: 4869 - DNA, 23 bp, Artificial Sequence
  HLA-A targeting gRNA
ccagcctggacacagggacctgg

SEQ ID NO: 4870 - DNA, 23 bp, Artificial Sequence
  HLA-A targeting gRNA
ccagcctggacgcaggcacctgg

SEQ ID NO: 4871 - DNA, 23 bp, Artificial Sequence
  HLA-A targeting gRNA
ccaggacagccaggacagccagg

SEQ ID NO: 4872 - DNA, 23 bp, Artificial Sequence
  HLA-A targeting gRNA
ccaggacagccaggacagctggg

SEQ ID NO: 4873 - DNA, 23 bp, Artificial Sequence
  HLA-A targeting gRNA
ccaggacgcctacgacggcaagg

SEQ ID NO: 4874 - DNA, 23 bp, Artificial Sequence
  HLA-A targeting gRNA
ccaggactcccgagagcagcagg

SEQ ID NO: 4875 - DNA, 23 bp, Artificial Sequence
  HLA-A targeting gRNA
ccaggcacagactgaccgagagg

SEQ ID NO: 4876 - DNA, 23 bp, Artificial Sequence
  HLA-A targeting gRNA
ccaggcagcaacagtgcccaggg

SEQ ID NO: 4877 - DNA, 23 bp, Artificial Sequence
  HLA-A targeting gRNA
ccaggcagcgacagtgcccaggg

SEQ ID NO: 4878 - DNA, 23 bp, Artificial Sequence
  HLA-A targeting gRNA
ccaggcctcccgagagcagcagg

SEQ ID NO: 4879 - DNA, 23 bp, Artificial Sequence
  HLA-A targeting gRNA
ccagggccccccagagcagcagg

SEQ ID NO: 4880 - DNA, 23 bp, Artificial Sequence
  HLA-A targeting gRNA
ccagggccgccgagagcagcagg

SEQ ID NO: 4881 - DNA, 23 bp, Artificial Sequence
  HLA-A targeting gRNA
ccagggccgtgtctgcattgggg

SEQ ID NO: 4882 - DNA, 23 bp, Artificial Sequence
  HLA-A targeting gRNA
ccagggctcccgagagcagcagg

SEQ ID NO: 4883 - DNA, 23 bp, Artificial Sequence
  HLA-A targeting gRNA
ccaggtcagggctgaggcttggg

SEQ ID NO: 4884 - DNA, 23 bp, Artificial Sequence
  HLA-A targeting gRNA
ccaggtccctgtgtccaggctgg

SEQ ID NO: 4885 - DNA, 23 bp, Artificial Sequence
  HLA-A targeting gRNA
ccaggtctcgatcagggccaggg

SEQ ID NO: 4886 - DNA, 23 bp, Artificial Sequence
  HLA-A targeting gRNA
ccaggtctcggtcagggccaggg

SEQ ID NO: 4887 - DNA, 23 bp, Artificial Sequence
  HLA-A targeting gRNA
ccaggtgcctgcgtccaggctgg

SEQ ID NO: 4888 - DNA, 23 bp, Artificial Sequence
  HLA-A targeting gRNA
ccaggtgcctgcgtccgggctgg

SEQ ID NO: 4889 - DNA, 23 bp, Artificial Sequence
  HLA-A targeting gRNA
ccagtacgcctacgacggcaggg

SEQ ID NO: 4890 - DNA, 23 bp, Artificial Sequence
  HLA-A targeting gRNA
ccagtactcctacgacggcaagg

SEQ ID NO: 4891 - DNA, 23 bp, Artificial Sequence
  HLA-A targeting gRNA
ccagtccaccatccccatcgtgg

SEQ ID NO: 4892 - DNA, 23 bp, Artificial Sequence
  HLA-A targeting gRNA
ccagtccaccgtccccatcgtgg

SEQ ID NO: 4893 - DNA, 23 bp, Artificial Sequence
  HLA-A targeting gRNA
ccagtccactgtccccatcgtgg

SEQ ID NO: 4894 - DNA, 23 bp, Artificial Sequence
  HLA-A targeting gRNA
ccagtcccgaccaacccgcgggg

SEQ ID NO: 4895 - DNA, 23 bp, Artificial Sequence
  HLA-A targeting gRNA
ccagtccgcctaagacggcaagg

SEQ ID NO: 4896 - DNA, 23 bp, Artificial Sequence
  HLA-A targeting gRNA
ccagtccgcctacgacggcaagg

SEQ ID NO: 4897 - DNA, 23 bp, Artificial Sequence
  HLA-A targeting gRNA
ccagtccgcctaggacggcaagg

SEQ ID NO: 4898 - DNA, 23 bp, Artificial Sequence
  HLA-A targeting gRNA
ccagtccgcctgcgacggcaagg

SEQ ID NO: 4899 - DNA, 23 bp, Artificial Sequence
  HLA-A targeting gRNA
ccagtgagtgaccccggcccggg

SEQ ID NO: 4900 - DNA, 23 bp, Artificial Sequence
  HLA-A targeting gRNA
ccagttagcctacgacggcaagg

SEQ ID NO: 4901 - DNA, 23 bp, Artificial Sequence
  HLA-A targeting gRNA
ccagttcgcctacgatggcaagg

SEQ ID NO: 4902 - DNA, 23 bp, Artificial Sequence
  HLA-A targeting gRNA
ccagtttgcctacgacggcaagg

SEQ ID NO: 4903 - DNA, 23 bp, Artificial Sequence
  HLA-A targeting gRNA
ccatagctcctaggacagctagg

SEQ ID NO: 4904 - DNA, 23 bp, Artificial Sequence
  HLA-A targeting gRNA
ccatcacagctgcccacttctgg

SEQ ID NO: 4905 - DNA, 23 bp, Artificial Sequence
  HLA-A targeting gRNA
ccatcccatctctgaccatgagg

SEQ ID NO: 4906 - DNA, 23 bp, Artificial Sequence
  HLA-A targeting gRNA
ccatcccccacggacggcccggg

SEQ ID NO: 4907 - DNA, 23 bp, Artificial Sequence
  HLA-A targeting gRNA
ccatcccccacgtacggcccggg

SEQ ID NO: 4908 - DNA, 23 bp, Artificial Sequence
  HLA-A targeting gRNA
ccatcccccacgtacggccgggg

SEQ ID NO: 4909 - DNA, 23 bp, Artificial Sequence
  HLA-A targeting gRNA
ccatcccgtctctgaccatgagg

SEQ ID NO: 4910 - DNA, 23 bp, Artificial Sequence
  HLA-A targeting gRNA
ccatctcagggtgaggggtttgg

SEQ ID NO: 4911 - DNA, 23 bp, Artificial Sequence
  HLA-A targeting gRNA
ccatctcccgtagatctcccggg

SEQ ID NO: 4912 - DNA, 23 bp, Artificial Sequence
  HLA-A targeting gRNA
ccatctcctatagatcgcccggg

SEQ ID NO: 4913 - DNA, 23 bp, Artificial Sequence
  HLA-A targeting gRNA
ccatctcctatagatctcccggg

SEQ ID NO: 4914 - DNA, 23 bp, Artificial Sequence
  HLA-A targeting gRNA
ccatctcctataggtcgccgggg

SEQ ID NO: 4915 - DNA, 23 bp, Artificial Sequence
  HLA-A targeting gRNA
ccatctcctgtagatctcccggg

SEQ ID NO: 4916 - DNA, 23 bp, Artificial Sequence
  HLA-A targeting gRNA
ccatctcgtctctgaccatgagg

SEQ ID NO: 4917 - DNA, 23 bp, Artificial Sequence
  HLA-A targeting gRNA
ccatgacccggcccggccgcggg

SEQ ID NO: 4918 - DNA, 23 bp, Artificial Sequence
  HLA-A targeting gRNA
ccatgatggggatggtaggctgg

SEQ ID NO: 4919 - DNA, 23 bp, Artificial Sequence
  HLA-A targeting gRNA
ccatgatggggatggtgggctgg

SEQ ID NO: 4920 - DNA, 23 bp, Artificial Sequence
  HLA-A targeting gRNA
ccatgtcccggcccggccgtggg

SEQ ID NO: 4921 - DNA, 23 bp, Artificial Sequence
  HLA-A targeting gRNA
ccatgtcccggcccggctgcggg

SEQ ID NO: 4922 - DNA, 23 bp, Artificial Sequence
  HLA-A targeting gRNA
ccatgtcccggcctggccgcggg

SEQ ID NO: 4923 - DNA, 23 bp, Artificial Sequence
  HLA-A targeting gRNA
ccatgtgaccagcctgagaatgg

SEQ ID NO: 4924 - DNA, 23 bp, Artificial Sequence
  HLA-A targeting gRNA
ccatgtgaccatcctgagaacgg

SEQ ID NO: 4925 - DNA, 23 bp, Artificial Sequence
  HLA-A targeting gRNA
ccatgtgaccatcctgagaatgg

SEQ ID NO: 4926 - DNA, 23 bp, Artificial Sequence
  HLA-A targeting gRNA
ccatgtgactatcctgagaatgg

SEQ ID NO: 4927 - DNA, 23 bp, Artificial Sequence
  HLA-A targeting gRNA
ccattctcaggatagtcacatgg

SEQ ID NO: 4928 - DNA, 23 bp, Artificial Sequence
  HLA-A targeting gRNA
ccattctcaggatggtcacatgg

SEQ ID NO: 4929 - DNA, 23 bp, Artificial Sequence
  HLA-A targeting gRNA
ccattctcaggctggtcacatgg

SEQ ID NO: 4930 - DNA, 23 bp, Artificial Sequence
  HLA-A targeting gRNA
ccattttcctcccctcctcgtgg

SEQ ID NO: 4931 - DNA, 23 bp, Artificial Sequence
  HLA-A targeting gRNA
ccattttcctcccttcctcgtgg

SEQ ID NO: 4932 - DNA, 23 bp, Artificial Sequence
  HLA-A targeting gRNA
ccattttcctcctcttctcgtgg

SEQ ID NO: 4933 - DNA, 23 bp, Artificial Sequence
  HLA-A targeting gRNA
ccattttcctcttcttctcgtgg

SEQ ID NO: 4934 - DNA, 23 bp, Artificial Sequence
  HLA-A targeting gRNA
cccaaccccgacgtacggcccgg

SEQ ID NO: 4935 - DNA, 23 bp, Artificial Sequence
  HLA-A targeting gRNA
cccaacttgggcatcgtttctgg

SEQ ID NO: 4936 - DNA, 23 bp, Artificial Sequence
  HLA-A targeting gRNA
cccaagcctcagccctgacccgg

SEQ ID NO: 4937 - DNA, 23 bp, Artificial Sequence
  HLA-A targeting gRNA
cccaagcctcagccctgacctgg

SEQ ID NO: 4938 - DNA, 23 bp, Artificial Sequence
  HLA-A targeting gRNA
cccaatgcagacaaggctctcgg

SEQ ID NO: 4939 - DNA, 23 bp, Artificial Sequence
  HLA-A targeting gRNA
cccaatgcagacacggccctggg

SEQ ID NO: 4940 - DNA, 23 bp, Artificial Sequence
  HLA-A targeting gRNA
cccaatgcagacacggcccttgg

SEQ ID NO: 4941 - DNA, 23 bp, Artificial Sequence
  HLA-A targeting gRNA
cccaatgcagacgcggccctcgg

SEQ ID NO: 4942 - DNA, 23 bp, Artificial Sequence
  HLA-A targeting gRNA
cccaatgggagtgggaaatgggg

SEQ ID NO: 4943 - DNA, 23 bp, Artificial Sequence
  HLA-A targeting gRNA
cccaatgggagtgggaagtgggg

SEQ ID NO: 4944 - DNA, 23 bp, Artificial Sequence
  HLA-A targeting gRNA
cccaatgggagtgggaattgggg

SEQ ID NO: 4945 - DNA, 23 bp, Artificial Sequence
  HLA-A targeting gRNA
cccacacaggcagctgtctcagg

SEQ ID NO: 4946 - DNA, 23 bp, Artificial Sequence
  HLA-A targeting gRNA
cccacggccgggccgggacatgg

SEQ ID NO: 4947 - DNA, 23 bp, Artificial Sequence
  HLA-A targeting gRNA
cccacgggcgcctcctccgcggg

SEQ ID NO: 4948 - DNA, 23 bp, Artificial Sequence
  HLA-A targeting gRNA
cccagccagcaacagtgcccagg

SEQ ID NO: 4949 - DNA, 23 bp, Artificial Sequence
  HLA-A targeting gRNA
cccagccccgaccaacccgcggg

SEQ ID NO: 4950 - DNA, 23 bp, Artificial Sequence
  HLA-A targeting gRNA
cccagccgtacatcctctggagg

SEQ ID NO: 4951 - DNA, 23 bp, Artificial Sequence
  HLA-A targeting gRNA
cccagctgtcctggctgtcctgg

SEQ ID NO: 4952 - DNA, 23 bp, Artificial Sequence
  HLA-A targeting gRNA
cccaggcagcaacagtgcccagg

SEQ ID NO: 4953 - DNA, 23 bp, Artificial Sequence
  HLA-A targeting gRNA
cccaggccggggtcactcaccgg

SEQ ID NO: 4954 - DNA, 23 bp, Artificial Sequence
  HLA-A targeting gRNA
cccagggccgtgtctgcattggg

SEQ ID NO: 4955 - DNA, 23 bp, Artificial Sequence
  HLA-A targeting gRNA
cccaggtctcgatcagggccagg

SEQ ID NO: 4956 - DNA, 23 bp, Artificial Sequence
  HLA-A targeting gRNA
cccaggtctcggtcagggccagg

SEQ ID NO: 4957 - DNA, 23 bp, Artificial Sequence
  HLA-A targeting gRNA
cccagtcacccacccggactcgg

SEQ ID NO: 4958 - DNA, 23 bp, Artificial Sequence
  HLA-A targeting gRNA
cccagtcccgaccaacccgcggg

SEQ ID NO: 4959 - DNA, 23 bp, Artificial Sequence
  HLA-A targeting gRNA
cccagtgcagacacggcccttgg

SEQ ID NO: 4960 - DNA, 23 bp, Artificial Sequence
  HLA-A targeting gRNA
cccatcatgggcatcgttgctgg

SEQ ID NO: 4961 - DNA, 23 bp, Artificial Sequence
  HLA-A targeting gRNA
cccatcccccacggacggcccgg

SEQ ID NO: 4962 - DNA, 23 bp, Artificial Sequence
  HLA-A targeting gRNA
cccatcccccacgtacggcccgg

SEQ ID NO: 4963 - DNA, 23 bp, Artificial Sequence
  HLA-A targeting gRNA
cccatcccccacgtacggccggg

SEQ ID NO: 4964 - DNA, 23 bp, Artificial Sequence
  HLA-A targeting gRNA
cccatcgtgggcatcgttgctgg

SEQ ID NO: 4965 - DNA, 23 bp, Artificial Sequence
  HLA-A targeting gRNA
cccatcgtgggcattgttgctgg

SEQ ID NO: 4966 - DNA, 23 bp, Artificial Sequence
  HLA-A targeting gRNA
cccatctcccgtagatctcccgg

SEQ ID NO: 4967 - DNA, 23 bp, Artificial Sequence
  HLA-A targeting gRNA
cccatctcctatagatcgcccgg

SEQ ID NO: 4968 - DNA, 23 bp, Artificial Sequence
  HLA-A targeting gRNA
cccatctcctatagatctcccgg

SEQ ID NO: 4969 - DNA, 23 bp, Artificial Sequence
  HLA-A targeting gRNA
cccatctcctataggtcgccggg

SEQ ID NO: 4970 - DNA, 23 bp, Artificial Sequence
  HLA-A targeting gRNA
cccatctcctgtagatctcccgg

SEQ ID NO: 4971 - DNA, 23 bp, Artificial Sequence
  HLA-A targeting gRNA
cccattctccattcaagggaggg

SEQ ID NO: 4972 - DNA, 23 bp, Artificial Sequence
  HLA-A targeting gRNA
cccattgcagacgcggccctcgg

SEQ ID NO: 4973 - DNA, 23 bp, Artificial Sequence
  HLA-A targeting gRNA
cccattttccattcaagggaggg

SEQ ID NO: 4974 - DNA, 23 bp, Artificial Sequence
  HLA-A targeting gRNA
ccccaaacacactgagtgtgagg

SEQ ID NO: 4975 - DNA, 23 bp, Artificial Sequence
  HLA-A targeting gRNA
ccccaacaccacaaccaccaagg

SEQ ID NO: 4976 - DNA, 23 bp, Artificial Sequence
  HLA-A targeting gRNA
ccccaacaccacaaccaccacgg

SEQ ID NO: 4977 - DNA, 23 bp, Artificial Sequence
  HLA-A targeting gRNA
ccccaacaccacaaccatcaagg

SEQ ID NO: 4978 - DNA, 23 bp, Artificial Sequence
  HLA-A targeting gRNA
ccccaacaccacaaccatcgagg

SEQ ID NO: 4979 - DNA, 23 bp, Artificial Sequence
  HLA-A targeting gRNA
ccccaacaccacaaccattaagg

SEQ ID NO: 4980 - DNA, 23 bp, Artificial Sequence
  HLA-A targeting gRNA
ccccaacaccataatcatcaagg

SEQ ID NO: 4981 - DNA, 23 bp, Artificial Sequence
  HLA-A targeting gRNA
ccccaacgccacaaccaccaagg

SEQ ID NO: 4982 - DNA, 23 bp, Artificial Sequence
  HLA-A targeting gRNA
ccccaatgcagacacggccctgg

SEQ ID NO: 4983 - DNA, 23 bp, Artificial Sequence
  HLA-A targeting gRNA
ccccaattcccactcccattggg

SEQ ID NO: 4984 - DNA, 23 bp, Artificial Sequence
  HLA-A targeting gRNA
ccccacgggcgcctcctccgcgg

SEQ ID NO: 4985 - DNA, 23 bp, Artificial Sequence
  HLA-A targeting gRNA
ccccacttcccactcccattggg

SEQ ID NO: 4986 - DNA, 23 bp, Artificial Sequence
  HLA-A targeting gRNA
ccccagccccgaccaacccgcgg

SEQ ID NO: 4987 - DNA, 23 bp, Artificial Sequence
  HLA-A targeting gRNA
ccccaggctcccactccttgagg

SEQ ID NO: 4988 - DNA, 23 bp, Artificial Sequence
  HLA-A targeting gRNA
ccccaggctcccacttcatgagg

SEQ ID NO: 4989 - DNA, 23 bp, Artificial Sequence
  HLA-A targeting gRNA
ccccaggctccctctccatgagg

SEQ ID NO: 4990 - DNA, 23 bp, Artificial Sequence
  HLA-A targeting gRNA
ccccaggcttccactccatgagg

SEQ ID NO: 4991 - DNA, 23 bp, Artificial Sequence
  HLA-A targeting gRNA
ccccaggttcccactccatgagg

SEQ ID NO: 4992 - DNA, 23 bp, Artificial Sequence
  HLA-A targeting gRNA
ccccagtcccgaccaacccgcgg

SEQ ID NO: 4993 - DNA, 23 bp, Artificial Sequence
  HLA-A targeting gRNA
ccccagtctcccactccatgagg

SEQ ID NO: 4994 - DNA, 23 bp, Artificial Sequence
  HLA-A targeting gRNA
ccccatcccccacgtacggccgg

SEQ ID NO: 4995 - DNA, 23 bp, Artificial Sequence
  HLA-A targeting gRNA
ccccatctcctataggtcgccgg

SEQ ID NO: 4996 - DNA, 23 bp, Artificial Sequence
  HLA-A targeting gRNA
ccccatttcccactcccattggg

SEQ ID NO: 4997 - DNA, 23 bp, Artificial Sequence
  HLA-A targeting gRNA
cccccaattcccactcccattgg

SEQ ID NO: 4998 - DNA, 23 bp, Artificial Sequence
  HLA-A targeting gRNA
cccccagagcagcaggaggacgg

SEQ ID NO: 4999 - DNA, 23 bp, Artificial Sequence
  HLA-A targeting gRNA
cccccagagcagcaggaggaggg

SEQ ID NO: 5000 - DNA, 23 bp, Artificial Sequence
  HLA-A targeting gRNA
ccccccagagcagcaggaggagg

SEQ ID NO: 5001 - DNA, 23 bp, Artificial Sequence
  HLA-A targeting gRNA
ccccctagagcagcaggaggagg

SEQ ID NO: 5002 - DNA, 23 bp, Artificial Sequence
  HLA-A targeting gRNA
ccccctccttaccccatctcagg

SEQ ID NO: 5003 - DNA, 23 bp, Artificial Sequence
  HLA-A targeting gRNA
ccccctccttactccatctcagg

SEQ ID NO: 5004 - DNA, 23 bp, Artificial Sequence
  HLA-A targeting gRNA
ccccgcccccgtggtcagcccgg

SEQ ID NO: 5005 - DNA, 23 bp, Artificial Sequence
  HLA-A targeting gRNA
ccccgccccgaccaacccgcggg

SEQ ID NO: 5006 - DNA, 23 bp, Artificial Sequence
  HLA-A targeting gRNA
ccccgccccgcccaacccgcggg

SEQ ID NO: 5007 - DNA, 23 bp, Artificial Sequence
  HLA-A targeting gRNA
ccccgccctgaccaacccgcggg

SEQ ID NO: 5008 - DNA, 23 bp, Artificial Sequence
  HLA-A targeting gRNA
ccccgcgggttgggcggggcggg

SEQ ID NO: 5009 - DNA, 23 bp, Artificial Sequence
  HLA-A targeting gRNA
ccccgcgggttggtcagggcggg

SEQ ID NO: 5010 - DNA, 23 bp, Artificial Sequence
  HLA-A targeting gRNA
ccccgcgggttggtcgggactgg

SEQ ID NO: 5011 - DNA, 23 bp, Artificial Sequence
  HLA-A targeting gRNA
ccccgcgggttggtcggggcggg

SEQ ID NO: 5012 - DNA, 23 bp, Artificial Sequence
  HLA-A targeting gRNA
ccccgcgggttggtcggggctgg

SEQ ID NO: 5013 - DNA, 23 bp, Artificial Sequence
  HLA-A targeting gRNA
ccccggccgtacgtgggggatgg

SEQ ID NO: 5014 - DNA, 23 bp, Artificial Sequence
  HLA-A targeting gRNA
ccccggcgacctataggagatgg

SEQ ID NO: 5015 - DNA, 23 bp, Artificial Sequence
  HLA-A targeting gRNA
ccccggcggtccaggagcgcagg

SEQ ID NO: 5016 - DNA, 23 bp, Artificial Sequence
  HLA-A targeting gRNA
ccccgggccggggtcactcacgg

SEQ ID NO: 5017 - DNA, 23 bp, Artificial Sequence
  HLA-A targeting gRNA
cccctagagcagcaggaggaggg

SEQ ID NO: 5018 - DNA, 23 bp, Artificial Sequence
  HLA-A targeting gRNA
cccctccctcctctccgcagagg

SEQ ID NO: 5019 - DNA, 23 bp, Artificial Sequence
  HLA-A targeting gRNA
cccctccttaccccagctcaggg

SEQ ID NO: 5020 - DNA, 23 bp, Artificial Sequence
  HLA-A targeting gRNA
cccctccttaccccatctcaggg

SEQ ID NO: 5021 - DNA, 23 bp, Artificial Sequence
  HLA-A targeting gRNA
cccctccttactccatctcaggg

SEQ ID NO: 5022 - DNA, 23 bp, Artificial Sequence
  HLA-A targeting gRNA
cccctcgctcctccccacagagg

SEQ ID NO: 5023 - DNA, 23 bp, Artificial Sequence
  HLA-A targeting gRNA
cccctcgctcctcccggcagagg

SEQ ID NO: 5024 - DNA, 23 bp, Artificial Sequence
  HLA-A targeting gRNA
cccctcgctcctctcagcagagg

SEQ ID NO: 5025 - DNA, 23 bp, Artificial Sequence
  HLA-A targeting gRNA
cccctcgctcctctccatagagg

SEQ ID NO: 5026 - DNA, 23 bp, Artificial Sequence
  HLA-A targeting gRNA
cccctcgctcctctccccagagg

SEQ ID NO: 5027 - DNA, 23 bp, Artificial Sequence
  HLA-A targeting gRNA
cccctcgctcctctccgcagagg

SEQ ID NO: 5028 - DNA, 23 bp, Artificial Sequence
  HLA-A targeting gRNA
cccctctctcctccccacagagg

SEQ ID NO: 5029 - DNA, 23 bp, Artificial Sequence
  HLA-A targeting gRNA
ccccttgctcctccctacagagg

SEQ ID NO: 5030 - DNA, 23 bp, Artificial Sequence
  HLA-A targeting gRNA
cccgaccggcgcctcctccgcgg

SEQ ID NO: 5031 - DNA, 23 bp, Artificial Sequence
  HLA-A targeting gRNA
cccgacgggcccctcctccgcgg

SEQ ID NO: 5032 - DNA, 23 bp, Artificial Sequence
  HLA-A targeting gRNA
cccgacgggcgcctcctccacgg

SEQ ID NO: 5033 - DNA, 23 bp, Artificial Sequence
  HLA-A targeting gRNA
cccgacgggcgcctcctccgcgg

SEQ ID NO: 5034 - DNA, 23 bp, Artificial Sequence
  HLA-A targeting gRNA
cccgacgggcgcttcctccgcgg

SEQ ID NO: 5035 - DNA, 23 bp, Artificial Sequence
  HLA-A targeting gRNA
cccgacgggcgtctcctccgcgg

SEQ ID NO: 5036 - DNA, 23 bp, Artificial Sequence
  HLA-A targeting gRNA
cccgcagccgggccgggacatgg

SEQ ID NO: 5037 - DNA, 23 bp, Artificial Sequence
  HLA-A targeting gRNA
cccgccccgaccaacccgcgggg

SEQ ID NO: 5038 - DNA, 23 bp, Artificial Sequence
  HLA-A targeting gRNA
cccgccccgcccaacccgcgggg

SEQ ID NO: 5039 - DNA, 23 bp, Artificial Sequence
  HLA-A targeting gRNA
cccgccctgaccaacccgcgggg

SEQ ID NO: 5040 - DNA, 23 bp, Artificial Sequence
  HLA-A targeting gRNA
cccgcggaggaagcgcccgtcgg

SEQ ID NO: 5041 - DNA, 23 bp, Artificial Sequence
  HLA-A targeting gRNA
cccgcggaggagacgcccgtcgg

SEQ ID NO: 5042 - DNA, 23 bp, Artificial Sequence
  HLA-A targeting gRNA
cccgcggaggaggcgcccgccgg

SEQ ID NO: 5043 - DNA, 23 bp, Artificial Sequence
  HLA-A targeting gRNA
cccgcggaggaggcgcccgtagg

SEQ ID NO: 5044 - DNA, 23 bp, Artificial Sequence
  HLA-A targeting gRNA
cccgcggaggaggcgcccgtcgg

SEQ ID NO: 5045 - DNA, 23 bp, Artificial Sequence
  HLA-A targeting gRNA
cccgcggaggaggcgcccgtggg

SEQ ID NO: 5046 - DNA, 23 bp, Artificial Sequence
  HLA-A targeting gRNA
cccgcggaggaggcgccggtcgg

SEQ ID NO: 5047 - DNA, 23 bp, Artificial Sequence
  HLA-A targeting gRNA
cccgcggaggaggggcccgtcgg

SEQ ID NO: 5048 - DNA, 23 bp, Artificial Sequence
  HLA-A targeting gRNA
cccgcggccaggccgggacacgg

SEQ ID NO: 5049 - DNA, 23 bp, Artificial Sequence
  HLA-A targeting gRNA
cccgcggccaggccgggacatgg

SEQ ID NO: 5050 - DNA, 23 bp, Artificial Sequence
  HLA-A targeting gRNA
cccgcggccgggccaggacacgg

SEQ ID NO: 5051 - DNA, 23 bp, Artificial Sequence
  HLA-A targeting gRNA
cccgcggccgggccgggacgtgg

SEQ ID NO: 5052 - DNA, 23 bp, Artificial Sequence
  HLA-A targeting gRNA
cccgcggccgggccgggtcatgg

SEQ ID NO: 5053 - DNA, 23 bp, Artificial Sequence
  HLA-A targeting gRNA
cccgcgggttgggcggggcgggg

SEQ ID NO: 5054 - DNA, 23 bp, Artificial Sequence
  HLA-A targeting gRNA
cccgcgggttggtcagggcgggg

SEQ ID NO: 5055 - DNA, 23 bp, Artificial Sequence
  HLA-A targeting gRNA
cccgcgggttggtcgggactggg

SEQ ID NO: 5056 - DNA, 23 bp, Artificial Sequence
  HLA-A targeting gRNA
cccgcgggttggtcggggcgggg

SEQ ID NO: 5057 - DNA, 23 bp, Artificial Sequence
  HLA-A targeting gRNA
cccgcgggttggtcggggctggg

SEQ ID NO: 5058 - DNA, 23 bp, Artificial Sequence
  HLA-A targeting gRNA
cccgctgccgggccgggacacgg

SEQ ID NO: 5059 - DNA, 23 bp, Artificial Sequence
  HLA-A targeting gRNA
cccggagactcggggcgacccgg

SEQ ID NO: 5060 - DNA, 23 bp, Artificial Sequence
  HLA-A targeting gRNA
cccggccgtacgtgggggatggg

SEQ ID NO: 5061 - DNA, 23 bp, Artificial Sequence
  HLA-A targeting gRNA
cccggcgacctataggagatggg

SEQ ID NO: 5062 - DNA, 23 bp, Artificial Sequence
  HLA-A targeting gRNA
cccggcgagggcgcaggacccgg

SEQ ID NO: 5063 - DNA, 23 bp, Artificial Sequence
  HLA-A targeting gRNA
cccggcgggcgcctcctccgcgg

SEQ ID NO: 5064 - DNA, 23 bp, Artificial Sequence
  HLA-A targeting gRNA
cccggctgaagggctccagaagg

SEQ ID NO: 5065 - DNA, 23 bp, Artificial Sequence
  HLA-A targeting gRNA
cccgggagatctacaggagatgg

SEQ ID NO: 5066 - DNA, 23 bp, Artificial Sequence
  HLA-A targeting gRNA
cccgggagatctacgggagatgg

SEQ ID NO: 5067 - DNA, 23 bp, Artificial Sequence
  HLA-A targeting gRNA
cccgggagatctataggagatgg

SEQ ID NO: 5068 - DNA, 23 bp, Artificial Sequence
  HLA-A targeting gRNA
cccgggccggggtcactcactgg

SEQ ID NO: 5069 - DNA, 23 bp, Artificial Sequence
  HLA-A targeting gRNA
cccgggccgtacgtcggggttgg

SEQ ID NO: 5070 - DNA, 23 bp, Artificial Sequence
  HLA-A targeting gRNA
cccgggccgtacgtgggggatgg

SEQ ID NO: 5071 - DNA, 23 bp, Artificial Sequence
  HLA-A targeting gRNA
cccgggccgtccgtgggggatgg

SEQ ID NO: 5072 - DNA, 23 bp, Artificial Sequence
  HLA-A targeting gRNA
cccgggcgatctataggagatgg

SEQ ID NO: 5073 - DNA, 23 bp, Artificial Sequence
  HLA-A targeting gRNA
cccgggtcctgcgccctcgccgg

SEQ ID NO: 5074 - DNA, 23 bp, Artificial Sequence
  HLA-A targeting gRNA
cccgggtcgccccgagtctcagg

SEQ ID NO: 5075 - DNA, 23 bp, Artificial Sequence
  HLA-A targeting gRNA
cccgggtcgccccgagtctccgg

SEQ ID NO: 5076 - DNA, 23 bp, Artificial Sequence
  HLA-A targeting gRNA
cccggtcccaatactccgtccgg

SEQ ID NO: 5077 - DNA, 23 bp, Artificial Sequence
  HLA-A targeting gRNA
cccggtttcattttcagttgagg

SEQ ID NO: 5078 - DNA, 23 bp, Artificial Sequence
  HLA-A targeting gRNA
cccggtttcattttcggtttagg

SEQ ID NO: 5079 - DNA, 23 bp, Artificial Sequence
  HLA-A targeting gRNA
cccggtttcgttttcagtttagg

SEQ ID NO: 5080 - DNA, 23 bp, Artificial Sequence
  HLA-A targeting gRNA
cccgtctgagatccaccccaagg

SEQ ID NO: 5081 - DNA, 23 bp, Artificial Sequence
  HLA-A targeting gRNA
cccgtctgagatccaccccgagg

SEQ ID NO: 5082 - DNA, 23 bp, Artificial Sequence
  HLA-A targeting gRNA
cccgtggaggaggcgcccgtcgg

SEQ ID NO: 5083 - DNA, 23 bp, Artificial Sequence
  HLA-A targeting gRNA
ccctacgggcgcctcctccgcgg

SEQ ID NO: 5084 - DNA, 23 bp, Artificial Sequence
  HLA-A targeting gRNA
ccctccagaggatgtacggctgg

SEQ ID NO: 5085 - DNA, 23 bp, Artificial Sequence
  HLA-A targeting gRNA
ccctccccaaccccgacgtacgg

SEQ ID NO: 5086 - DNA, 23 bp, Artificial Sequence
  HLA-A targeting gRNA
ccctccccatcccccacggacgg

SEQ ID NO: 5087 - DNA, 23 bp, Artificial Sequence
  HLA-A targeting gRNA
ccctcccgacccgcactcaccgg

SEQ ID NO: 5088 - DNA, 23 bp, Artificial Sequence
  HLA-A targeting gRNA
ccctcccttgaatggaaaatggg

SEQ ID NO: 5089 - DNA, 23 bp, Artificial Sequence
  HLA-A targeting gRNA
ccctcccttgaatggagaatggg

SEQ ID NO: 5090 - DNA, 23 bp, Artificial Sequence
  HLA-A targeting gRNA
ccctcctcatcccccacggacgg

SEQ ID NO: 5091 - DNA, 23 bp, Artificial Sequence
  HLA-A targeting gRNA
ccctcctcctgctgctctagggg

SEQ ID NO: 5092 - DNA, 23 bp, Artificial Sequence
  HLA-A targeting gRNA
ccctcctcctgctgctctggggg

SEQ ID NO: 5093 - DNA, 23 bp, Artificial Sequence
  HLA-A targeting gRNA
ccctgagactcggggcgacccgg

SEQ ID NO: 5094 - DNA, 23 bp, Artificial Sequence
  HLA-A targeting gRNA
ccctgagatggagtaaggagggg

SEQ ID NO: 5095 - DNA, 23 bp, Artificial Sequence
  HLA-A targeting gRNA
ccctgagatggggtaaggagggg

SEQ ID NO: 5096 - DNA, 23 bp, Artificial Sequence
  HLA-A targeting gRNA
ccctgagctggggtaaggagggg

SEQ ID NO: 5097 - DNA, 23 bp, Artificial Sequence
  HLA-A targeting gRNA
ccctgcagcgcgcgggtaccagg

SEQ ID NO: 5098 - DNA, 23 bp, Artificial Sequence
  HLA-A targeting gRNA
ccctgccgacccgcactcaccgg

SEQ ID NO: 5099 - DNA, 23 bp, Artificial Sequence
  HLA-A targeting gRNA
ccctgccgtcgtaggcgtactgg

SEQ ID NO: 5100 - DNA, 23 bp, Artificial Sequence
  HLA-A targeting gRNA
ccctgctaaggacagaccttagg

SEQ ID NO: 5101 - DNA, 23 bp, Artificial Sequence
  HLA-A targeting gRNA
ccctgctgaagggctccagaagg

SEQ ID NO: 5102 - DNA, 23 bp, Artificial Sequence
  HLA-A targeting gRNA
ccctggccctgaccgagacctgg

SEQ ID NO: 5103 - DNA, 23 bp, Artificial Sequence
  HLA-A targeting gRNA
ccctggccctgatcgagacctgg

SEQ ID NO: 5104 - DNA, 23 bp, Artificial Sequence
  HLA-A targeting gRNA
ccctgggcactgtcgctgcctgg

SEQ ID NO: 5105 - DNA, 23 bp, Artificial Sequence
  HLA-A targeting gRNA
ccctgggcactgtcgctggctgg

SEQ ID NO: 5106 - DNA, 23 bp, Artificial Sequence
  HLA-A targeting gRNA
ccctgggcactgttgctgcctgg

SEQ ID NO: 5107 - DNA, 23 bp, Artificial Sequence
  HLA-A targeting gRNA
ccctgggcactgttgctggctgg

SEQ ID NO: 5108 - DNA, 23 bp, Artificial Sequence
  HLA-A targeting gRNA
ccctggtacccgcgcgctgcagg

SEQ ID NO: 5109 - DNA, 23 bp, Artificial Sequence
  HLA-A targeting gRNA
cccttctggagcccttcagcagg

SEQ ID NO: 5110 - DNA, 23 bp, Artificial Sequence
  HLA-A targeting gRNA
cccttgaagtcacaaaggggagg

SEQ ID NO: 5111 - DNA, 23 bp, Artificial Sequence
  HLA-A targeting gRNA
ccgaaaatgaaaccgggtaaagg

SEQ ID NO: 5112 - DNA, 23 bp, Artificial Sequence
  HLA-A targeting gRNA
ccgaccggcgcctcctccgcggg

SEQ ID NO: 5113 - DNA, 23 bp, Artificial Sequence
  HLA-A targeting gRNA
ccgacgggcccctcctccgcggg

SEQ ID NO: 5114 - DNA, 23 bp, Artificial Sequence
  HLA-A targeting gRNA
ccgacgggcgcctcctccacggg

SEQ ID NO: 5115 - DNA, 23 bp, Artificial Sequence
  HLA-A targeting gRNA
ccgacgggcgcctcctccgcggg

SEQ ID NO: 5116 - DNA, 23 bp, Artificial Sequence
  HLA-A targeting gRNA
ccgacgggcgcttcctccgcggg

SEQ ID NO: 5117 - DNA, 23 bp, Artificial Sequence
  HLA-A targeting gRNA
ccgacgggcgtctcctccgcggg

SEQ ID NO: 5118 - DNA, 23 bp, Artificial Sequence
  HLA-A targeting gRNA
ccgagagccttgtctgcattggg

SEQ ID NO: 5119 - DNA, 23 bp, Artificial Sequence
  HLA-A targeting gRNA
ccgagggccgcgtctgcaatggg

SEQ ID NO: 5120 - DNA, 23 bp, Artificial Sequence
  HLA-A targeting gRNA
ccgagggccgcgtctgcattggg

SEQ ID NO: 5121 - DNA, 23 bp, Artificial Sequence
  HLA-A targeting gRNA
ccgagtccgggtgggtgactggg

SEQ ID NO: 5122 - DNA, 23 bp, Artificial Sequence
  HLA-A targeting gRNA
ccgcagcggtccaggagcgcagg

SEQ ID NO: 5123 - DNA, 23 bp, Artificial Sequence
  HLA-A targeting gRNA
ccgccgcgatccaggagctcagg

SEQ ID NO: 5124 - DNA, 23 bp, Artificial Sequence
  HLA-A targeting gRNA
ccgccgcggtccaggagctcagg

SEQ ID NO: 5125 - DNA, 23 bp, Artificial Sequence
  HLA-A targeting gRNA
ccgccgcggtccaggagcttagg

SEQ ID NO: 5126 - DNA, 23 bp, Artificial Sequence
  HLA-A targeting gRNA
ccgccgcggtccgggagctcagg

SEQ ID NO: 5127 - DNA, 23 bp, Artificial Sequence
  HLA-A targeting gRNA
ccgcggaggaagcgcccgtcggg

SEQ ID NO: 5128 - DNA, 23 bp, Artificial Sequence
  HLA-A targeting gRNA
ccgcggaggagacgcccgtcggg

SEQ ID NO: 5129 - DNA, 23 bp, Artificial Sequence
  HLA-A targeting gRNA
ccgcggaggaggcgcccatccgg

SEQ ID NO: 5130 - DNA, 23 bp, Artificial Sequence
  HLA-A targeting gRNA
ccgcggaggaggcgcccgccggg

SEQ ID NO: 5131 - DNA, 23 bp, Artificial Sequence
  HLA-A targeting gRNA
ccgcggaggaggcgcccgtaggg

SEQ ID NO: 5132 - DNA, 23 bp, Artificial Sequence
  HLA-A targeting gRNA
ccgcggaggaggcgcccgtcggg

SEQ ID NO: 5133 - DNA, 23 bp, Artificial Sequence
  HLA-A targeting gRNA
ccgcggaggaggcgcccgtgggg

SEQ ID NO: 5134 - DNA, 23 bp, Artificial Sequence
  HLA-A targeting gRNA
ccgcggaggaggcgccggtcggg

SEQ ID NO: 5135 - DNA, 23 bp, Artificial Sequence
  HLA-A targeting gRNA
ccgcggaggaggggcccgtcggg

SEQ ID NO: 5136 - DNA, 23 bp, Artificial Sequence
  HLA-A targeting gRNA
ccgcggcaatccaggagcgcagg

SEQ ID NO: 5137 - DNA, 23 bp, Artificial Sequence
  HLA-A targeting gRNA
ccgcggcagtccaggagcgcagg

SEQ ID NO: 5138 - DNA, 23 bp, Artificial Sequence
  HLA-A targeting gRNA
ccgcggcggtccaggagcgcagg

SEQ ID NO: 5139 - DNA, 23 bp, Artificial Sequence
  HLA-A targeting gRNA
ccgcggcggtccaggagctcagg

SEQ ID NO: 5140 - DNA, 23 bp, Artificial Sequence
  HLA-A targeting gRNA
ccgcggcggtccaggagggcagg

SEQ ID NO: 5141 - DNA, 23 bp, Artificial Sequence
  HLA-A targeting gRNA
ccgcgggttggtcgggactgggg

SEQ ID NO: 5142 - DNA, 23 bp, Artificial Sequence
  HLA-A targeting gRNA
ccgcgggttggtcggggctgggg

SEQ ID NO: 5143 - DNA, 23 bp, Artificial Sequence
  HLA-A targeting gRNA
ccgcggtgtccgccgcggtccgg

SEQ ID NO: 5144 - DNA, 23 bp, Artificial Sequence
  HLA-A targeting gRNA
ccgcggtgtccgccgcgtccagg

SEQ ID NO: 5145 - DNA, 23 bp, Artificial Sequence
  HLA-A targeting gRNA
ccggaacacacagatctacaagg

SEQ ID NO: 5146 - DNA, 23 bp, Artificial Sequence
  HLA-A targeting gRNA
ccggaacacacagatctgcaagg

SEQ ID NO: 5147 - DNA, 23 bp, Artificial Sequence
  HLA-A targeting gRNA
ccggaccgcggcggacaccgcgg

SEQ ID NO: 5148 - DNA, 23 bp, Artificial Sequence
  HLA-A targeting gRNA
ccggacggagtattgggaccggg

SEQ ID NO: 5149 - DNA, 23 bp, Artificial Sequence
  HLA-A targeting gRNA
ccggacgggcgcctcctccgtgg

SEQ ID NO: 5150 - DNA, 23 bp, Artificial Sequence
  HLA-A targeting gRNA
ccggagactcggggcgaccccgg

SEQ ID NO: 5151 - DNA, 23 bp, Artificial Sequence
  HLA-A targeting gRNA
ccggagactcggggcgacccggg

SEQ ID NO: 5152 - DNA, 23 bp, Artificial Sequence
  HLA-A targeting gRNA
ccggatgggcgcctcctccgcgg

SEQ ID NO: 5153 - DNA, 23 bp, Artificial Sequence
  HLA-A targeting gRNA
ccggccgtacgtgggggatgggg

SEQ ID NO: 5154 - DNA, 23 bp, Artificial Sequence
  HLA-A targeting gRNA
ccggcgacctataggagatgggg

SEQ ID NO: 5155 - DNA, 23 bp, Artificial Sequence
  HLA-A targeting gRNA
ccggcgagggcgcaggacccggg

SEQ ID NO: 5156 - DNA, 23 bp, Artificial Sequence
  HLA-A targeting gRNA
ccggcgggcgcctcctccgcggg

SEQ ID NO: 5157 - DNA, 23 bp, Artificial Sequence
  HLA-A targeting gRNA
ccgggagacacagatctgcaagg

SEQ ID NO: 5158 - DNA, 23 bp, Artificial Sequence
  HLA-A targeting gRNA
ccgggagacacggaacatgaagg

SEQ ID NO: 5159 - DNA, 23 bp, Artificial Sequence
  HLA-A targeting gRNA
ccgggagactcggggcgacccgg

SEQ ID NO: 5160 - DNA, 23 bp, Artificial Sequence
  HLA-A targeting gRNA
ccgggagacttggggcgacccgg

SEQ ID NO: 5161 - DNA, 23 bp, Artificial Sequence
  HLA-A targeting gRNA
ccgggagatctacaggagatagg

SEQ ID NO: 5162 - DNA, 23 bp, Artificial Sequence
  HLA-A targeting gRNA
ccgggagatctacaggagatggg

SEQ ID NO: 5163 - DNA, 23 bp, Artificial Sequence
  HLA-A targeting gRNA
ccgggagatctacgggagatggg

SEQ ID NO: 5164 - DNA, 23 bp, Artificial Sequence
  HLA-A targeting gRNA
ccgggagatctataggagatggg

SEQ ID NO: 5165 - DNA, 23 bp, Artificial Sequence
  HLA-A targeting gRNA
ccgggagccatggatagagcagg

SEQ ID NO: 5166 - DNA, 23 bp, Artificial Sequence
  HLA-A targeting gRNA
ccgggccgtacgtcggggttggg

SEQ ID NO: 5167 - DNA, 23 bp, Artificial Sequence
  HLA-A targeting gRNA
ccgggccgtacgtgggggatggg

SEQ ID NO: 5168 - DNA, 23 bp, Artificial Sequence
  HLA-A targeting gRNA
ccgggccgtccgtgggggatggg

SEQ ID NO: 5169 - DNA, 23 bp, Artificial Sequence
  HLA-A targeting gRNA
ccgggcgatctataggagatggg

SEQ ID NO: 5170 - DNA, 23 bp, Artificial Sequence
  HLA-A targeting gRNA
ccgggcgccatggatagagcagg

SEQ ID NO: 5171 - DNA, 23 bp, Artificial Sequence
  HLA-A targeting gRNA
ccgggcgccgtggatagagcagg

SEQ ID NO: 5172 - DNA, 23 bp, Artificial Sequence
  HLA-A targeting gRNA
ccgggcgccgtgggtggagcagg

SEQ ID NO: 5173 - DNA, 23 bp, Artificial Sequence
  HLA-A targeting gRNA
ccgggctgaccacgggggcgggg

SEQ ID NO: 5174 - DNA, 23 bp, Artificial Sequence
  HLA-A targeting gRNA
ccggggtcgccccgagtctccgg

SEQ ID NO: 5175 - DNA, 23 bp, Artificial Sequence
  HLA-A targeting gRNA
ccgggtcagggctgaggcttggg

SEQ ID NO: 5176 - DNA, 23 bp, Artificial Sequence
  HLA-A targeting gRNA
ccgggtcctgcgccctcgccggg

SEQ ID NO: 5177 - DNA, 23 bp, Artificial Sequence
  HLA-A targeting gRNA
ccgggtcgccccaagtctcccgg

SEQ ID NO: 5178 - DNA, 23 bp, Artificial Sequence
  HLA-A targeting gRNA
ccgggtcgccccgagtctcaggg

SEQ ID NO: 5179 - DNA, 23 bp, Artificial Sequence
  HLA-A targeting gRNA
ccgggtcgccccgagtctcccgg

SEQ ID NO: 5180 - DNA, 23 bp, Artificial Sequence
  HLA-A targeting gRNA
ccgggtcgccccgagtctccggg

SEQ ID NO: 5181 - DNA, 23 bp, Artificial Sequence
  HLA-A targeting gRNA
ccgggtctcacaccctccagagg

SEQ ID NO: 5182 - DNA, 23 bp, Artificial Sequence
  HLA-A targeting gRNA
ccgggtctcctcgagtctctagg

SEQ ID NO: 5183 - DNA, 23 bp, Artificial Sequence
  HLA-A targeting gRNA
ccggtccgcctacgacggcaagg

SEQ ID NO: 5184 - DNA, 23 bp, Artificial Sequence
  HLA-A targeting gRNA
ccggtctgagatccaccccgagg

SEQ ID NO: 5185 - DNA, 23 bp, Artificial Sequence
  HLA-A targeting gRNA
ccggtctgagatcctccccgagg

SEQ ID NO: 5186 - DNA, 23 bp, Artificial Sequence
  HLA-A targeting gRNA
ccggtgagtgaccccggcctggg

SEQ ID NO: 5187 - DNA, 23 bp, Artificial Sequence
  HLA-A targeting gRNA
ccggtgagtgcgggatcgggagg

SEQ ID NO: 5188 - DNA, 23 bp, Artificial Sequence
  HLA-A targeting gRNA
ccggtgagtgcggggtcggcagg

SEQ ID NO: 5189 - DNA, 23 bp, Artificial Sequence
  HLA-A targeting gRNA
ccggtgagtgcggggtcgggagg

SEQ ID NO: 5190 - DNA, 23 bp, Artificial Sequence
  HLA-A targeting gRNA
ccggtgagtgcggggttgggagg

SEQ ID NO: 5191 - DNA, 23 bp, Artificial Sequence
  HLA-A targeting gRNA
ccggtgagtgcgggtcggcaggg

SEQ ID NO: 5192 - DNA, 23 bp, Artificial Sequence
  HLA-A targeting gRNA
ccggtgagtgcgggtcgggaggg

SEQ ID NO: 5193 - DNA, 23 bp, Artificial Sequence
  HLA-A targeting gRNA
ccgtacgtcggggttggggaggg

SEQ ID NO: 5194 - DNA, 23 bp, Artificial Sequence
  HLA-A targeting gRNA
ccgtccgtgggggatgaggaggg

SEQ ID NO: 5195 - DNA, 23 bp, Artificial Sequence
  HLA-A targeting gRNA
ccgtccgtgggggatggggaggg

SEQ ID NO: 5196 - DNA, 23 bp, Artificial Sequence
  HLA-A targeting gRNA
ccgtcctcctgctgctctggggg

SEQ ID NO: 5197 - DNA, 23 bp, Artificial Sequence
  HLA-A targeting gRNA
ccgtcctcggactcgcggcgtgg

SEQ ID NO: 5198 - DNA, 23 bp, Artificial Sequence
  HLA-A targeting gRNA
ccgtgagtgaccccggcccgggg

SEQ ID NO: 5199 - DNA, 23 bp, Artificial Sequence
  HLA-A targeting gRNA
ccgtggaggaggcgcccgtcggg

SEQ ID NO: 5200 - DNA, 23 bp, Artificial Sequence
  HLA-A targeting gRNA
ccgtggtggttgtggtgttgggg

SEQ ID NO: 5201 - DNA, 23 bp, Artificial Sequence
  HLA-A targeting gRNA
ccgtgtcccggcccggcagcggg

SEQ ID NO: 5202 - DNA, 23 bp, Artificial Sequence
  HLA-A targeting gRNA
ccgtgtcccggcctggccgcggg

SEQ ID NO: 5203 - DNA, 23 bp, Artificial Sequence
  HLA-A targeting gRNA
ccgtgtcctggcccggccgcggg

SEQ ID NO: 5204 - DNA, 23 bp, Artificial Sequence
  HLA-A targeting gRNA
ccgttctcaggatggtcacatgg

SEQ ID NO: 5205 - DNA, 23 bp, Artificial Sequence
  HLA-A targeting gRNA
cctaaaccgaaaatgaaaccggg

SEQ ID NO: 5206 - DNA, 23 bp, Artificial Sequence
  HLA-A targeting gRNA
cctaaactgaaaacgaaaccggg

SEQ ID NO: 5207 - DNA, 23 bp, Artificial Sequence
  HLA-A targeting gRNA
cctaagctcctggaccgcggcgg

SEQ ID NO: 5208 - DNA, 23 bp, Artificial Sequence
  HLA-A targeting gRNA
cctaaggtctgtccttagcaggg

SEQ ID NO: 5209 - DNA, 23 bp, Artificial Sequence
  HLA-A targeting gRNA
cctacgggcgcctcctccgcggg

SEQ ID NO: 5210 - DNA, 23 bp, Artificial Sequence
  HLA-A targeting gRNA
cctagagactcgaggagacccgg

SEQ ID NO: 5211 - DNA, 23 bp, Artificial Sequence
  HLA-A targeting gRNA
cctagctgtcctaggagctatgg

SEQ ID NO: 5212 - DNA, 23 bp, Artificial Sequence
  HLA-A targeting gRNA
cctagctgtcctaggagctgtgg

SEQ ID NO: 5213 - DNA, 23 bp, Artificial Sequence
  HLA-A targeting gRNA
cctagctgtccttggagctgtgg

SEQ ID NO: 5214 - DNA, 23 bp, Artificial Sequence
  HLA-A targeting gRNA
cctatctcctgtagatctcccgg

SEQ ID NO: 5215 - DNA, 23 bp, Artificial Sequence
  HLA-A targeting gRNA
cctatgaggggactgggaggagg

SEQ ID NO: 5216 - DNA, 23 bp, Artificial Sequence
  HLA-A targeting gRNA
cctcaactgaaaatgaaaccggg

SEQ ID NO: 5217 - DNA, 23 bp, Artificial Sequence
  HLA-A targeting gRNA
cctcaaggagtgggagcctgggg

SEQ ID NO: 5218 - DNA, 23 bp, Artificial Sequence
  HLA-A targeting gRNA
cctcacaagacagctgtctcagg

SEQ ID NO: 5219 - DNA, 23 bp, Artificial Sequence
  HLA-A targeting gRNA
cctcacactcagtgtgtttgggg

SEQ ID NO: 5220 - DNA, 23 bp, Artificial Sequence
  HLA-A targeting gRNA
cctcaccctgagatggagtaagg

SEQ ID NO: 5221 - DNA, 23 bp, Artificial Sequence
  HLA-A targeting gRNA
cctcaccctgagctggggtaagg

SEQ ID NO: 5222 - DNA, 23 bp, Artificial Sequence
  HLA-A targeting gRNA
cctcatgaagtgggagcctgggg

SEQ ID NO: 5223 - DNA, 23 bp, Artificial Sequence
  HLA-A targeting gRNA
cctcatggagagggagcctgggg

SEQ ID NO: 5224 - DNA, 23 bp, Artificial Sequence
  HLA-A targeting gRNA
cctcatggagtggaagcctgggg

SEQ ID NO: 5225 - DNA, 23 bp, Artificial Sequence
  HLA-A targeting gRNA
cctcatggagtgggaacctgggg

SEQ ID NO: 5226 - DNA, 23 bp, Artificial Sequence
  HLA-A targeting gRNA
cctcatggagtgggagactgggg

SEQ ID NO: 5227 - DNA, 23 bp, Artificial Sequence
  HLA-A targeting gRNA
cctcatggtcagagacgagatgg

SEQ ID NO: 5228 - DNA, 23 bp, Artificial Sequence
  HLA-A targeting gRNA
cctcatggtcagagacgggatgg

SEQ ID NO: 5229 - DNA, 23 bp, Artificial Sequence
  HLA-A targeting gRNA
cctcatggtcagagacggggtgg

SEQ ID NO: 5230 - DNA, 23 bp, Artificial Sequence
  HLA-A targeting gRNA
cctcatggtcagagagggggtgg

SEQ ID NO: 5231 - DNA, 23 bp, Artificial Sequence
  HLA-A targeting gRNA
cctcatggtcagagatgggatgg

SEQ ID NO: 5232 - DNA, 23 bp, Artificial Sequence
  HLA-A targeting gRNA
cctccagaggatgtacggctggg

SEQ ID NO: 5233 - DNA, 23 bp, Artificial Sequence
  HLA-A targeting gRNA
cctcccaaccccgcactcacagg

SEQ ID NO: 5234 - DNA, 23 bp, Artificial Sequence
  HLA-A targeting gRNA
cctcccaaccccgcactcaccgg

SEQ ID NO: 5235 - DNA, 23 bp, Artificial Sequence
  HLA-A targeting gRNA
cctcccaacctcgcactcacagg

SEQ ID NO: 5236 - DNA, 23 bp, Artificial Sequence
  HLA-A targeting gRNA
cctcccctttgtgacttcaaggg

SEQ ID NO: 5237 - DNA, 23 bp, Artificial Sequence
  HLA-A targeting gRNA
cctcccgaccccgcactcaccgg

SEQ ID NO: 5238 - DNA, 23 bp, Artificial Sequence
  HLA-A targeting gRNA
cctcccgatcccgcactcaccgg

SEQ ID NO: 5239 - DNA, 23 bp, Artificial Sequence
  HLA-A targeting gRNA
cctcctaaccccgcactcacagg

SEQ ID NO: 5240 - DNA, 23 bp, Artificial Sequence
  HLA-A targeting gRNA
cctcctcacattaggctaacagg

SEQ ID NO: 5241 - DNA, 23 bp, Artificial Sequence
  HLA-A targeting gRNA
cctcctcacattatgctaacagg

SEQ ID NO: 5242 - DNA, 23 bp, Artificial Sequence
  HLA-A targeting gRNA
cctcctcccagtcccctcatagg

SEQ ID NO: 5243 - DNA, 23 bp, Artificial Sequence
  HLA-A targeting gRNA
cctcctccctgtcccctcacagg

SEQ ID NO: 5244 - DNA, 23 bp, Artificial Sequence
  HLA-A targeting gRNA
cctcctccgcgggcataaccagg

SEQ ID NO: 5245 - DNA, 23 bp, Artificial Sequence
  HLA-A targeting gRNA
cctcctccgcgggtaccaccagg

SEQ ID NO: 5246 - DNA, 23 bp, Artificial Sequence
  HLA-A targeting gRNA
cctcctccgcgggtatgaccagg

SEQ ID NO: 5247 - DNA, 23 bp, Artificial Sequence
  HLA-A targeting gRNA
cctcctcctgctgctctaggggg

SEQ ID NO: 5248 - DNA, 23 bp, Artificial Sequence
  HLA-A targeting gRNA
cctcctcctgctgctctgggggg

SEQ ID NO: 5249 - DNA, 23 bp, Artificial Sequence
  HLA-A targeting gRNA
cctcgaccgcagagagccccagg

SEQ ID NO: 5250 - DNA, 23 bp, Artificial Sequence
  HLA-A targeting gRNA
cctcgaccggcgagagccccagg

SEQ ID NO: 5251 - DNA, 23 bp, Artificial Sequence
  HLA-A targeting gRNA
cctcgatggttgtggtgttgggg

SEQ ID NO: 5252 - DNA, 23 bp, Artificial Sequence
  HLA-A targeting gRNA
cctcggggaggatctcagaccgg

SEQ ID NO: 5253 - DNA, 23 bp, Artificial Sequence
  HLA-A targeting gRNA
cctcggggtggatctcagaccgg

SEQ ID NO: 5254 - DNA, 23 bp, Artificial Sequence
  HLA-A targeting gRNA
cctcggggtggatctcagacggg

SEQ ID NO: 5255 - DNA, 23 bp, Artificial Sequence
  HLA-A targeting gRNA
cctctatggagaggagcgagggg

SEQ ID NO: 5256 - DNA, 23 bp, Artificial Sequence
  HLA-A targeting gRNA
cctctcggtcagtctgtgcctgg

SEQ ID NO: 5257 - DNA, 23 bp, Artificial Sequence
  HLA-A targeting gRNA
cctctgccgggaggagcgagggg

SEQ ID NO: 5258 - DNA, 23 bp, Artificial Sequence
  HLA-A targeting gRNA
cctctgcggagaggagcgagggg

SEQ ID NO: 5259 - DNA, 23 bp, Artificial Sequence
  HLA-A targeting gRNA
cctctgcggagaggagggagggg

SEQ ID NO: 5260 - DNA, 23 bp, Artificial Sequence
  HLA-A targeting gRNA
cctctgctgagaggagcgagggg

SEQ ID NO: 5261 - DNA, 23 bp, Artificial Sequence
  HLA-A targeting gRNA
cctctggagggtgtgagacccgg

SEQ ID NO: 5262 - DNA, 23 bp, Artificial Sequence
  HLA-A targeting gRNA
cctctggggagaggagcgagggg

SEQ ID NO: 5263 - DNA, 23 bp, Artificial Sequence
  HLA-A targeting gRNA
cctctgtagggaggagcaagggg

SEQ ID NO: 5264 - DNA, 23 bp, Artificial Sequence
  HLA-A targeting gRNA
cctctgtggggaggagagagggg

SEQ ID NO: 5265 - DNA, 23 bp, Artificial Sequence
  HLA-A targeting gRNA
cctctgtggggaggagcgagggg

SEQ ID NO: 5266 - DNA, 23 bp, Artificial Sequence
  HLA-A targeting gRNA
cctgaccacagctgccgcagtgg

SEQ ID NO: 5267 - DNA, 23 bp, Artificial Sequence
  HLA-A targeting gRNA
cctgaccacagctgctgcagtgg

SEQ ID NO: 5268 - DNA, 23 bp, Artificial Sequence
  HLA-A targeting gRNA
cctgagacagctgcctgtgtggg

SEQ ID NO: 5269 - DNA, 23 bp, Artificial Sequence
  HLA-A targeting gRNA
cctgagacagctgtcttgtgagg

SEQ ID NO: 5270 - DNA, 23 bp, Artificial Sequence
  HLA-A targeting gRNA
cctgagactcggggcgacccggg

SEQ ID NO: 5271 - DNA, 23 bp, Artificial Sequence
  HLA-A targeting gRNA
cctgagatggagtaaggaggggg

SEQ ID NO: 5272 - DNA, 23 bp, Artificial Sequence
  HLA-A targeting gRNA
cctgagatggggtaaggaggggg

SEQ ID NO: 5273 - DNA, 23 bp, Artificial Sequence
  HLA-A targeting gRNA
cctgagctcccggaccgcggcgg

SEQ ID NO: 5274 - DNA, 23 bp, Artificial Sequence
  HLA-A targeting gRNA
cctgagctcctggaccgccgcgg

SEQ ID NO: 5275 - DNA, 23 bp, Artificial Sequence
  HLA-A targeting gRNA
cctgagctcctggaccgcggcgg

SEQ ID NO: 5276 - DNA, 23 bp, Artificial Sequence
  HLA-A targeting gRNA
cctgagctcctggatcgcggcgg

SEQ ID NO: 5277 - DNA, 23 bp, Artificial Sequence
  HLA-A targeting gRNA
cctgcagcgcgcgggtaccaggg

SEQ ID NO: 5278 - DNA, 23 bp, Artificial Sequence
  HLA-A targeting gRNA
cctgcatctcagtcccacacagg

SEQ ID NO: 5279 - DNA, 23 bp, Artificial Sequence
  HLA-A targeting gRNA
cctgccctcctggaccgccgcgg

SEQ ID NO: 5280 - DNA, 23 bp, Artificial Sequence
  HLA-A targeting gRNA
cctgccgaccccgcactcaccgg

SEQ ID NO: 5281 - DNA, 23 bp, Artificial Sequence
  HLA-A targeting gRNA
cctgcgctcctggaccgccgcgg

SEQ ID NO: 5282 - DNA, 23 bp, Artificial Sequence
  HLA-A targeting gRNA
cctgcgctcctggaccgccgggg

SEQ ID NO: 5283 - DNA, 23 bp, Artificial Sequence
  HLA-A targeting gRNA
cctgcgctcctggaccgctgcgg

SEQ ID NO: 5284 - DNA, 23 bp, Artificial Sequence
  HLA-A targeting gRNA
cctgcgctcctggactgccgcgg

SEQ ID NO: 5285 - DNA, 23 bp, Artificial Sequence
  HLA-A targeting gRNA
cctgcgctcctggattgccgcgg

SEQ ID NO: 5286 - DNA, 23 bp, Artificial Sequence
  HLA-A targeting gRNA
cctgcgtccaggctggtgtctgg

SEQ ID NO: 5287 - DNA, 23 bp, Artificial Sequence
  HLA-A targeting gRNA
cctgcgtccaggctggtgtttgg

SEQ ID NO: 5288 - DNA, 23 bp, Artificial Sequence
  HLA-A targeting gRNA
cctgcgtccgggctggtgtctgg

SEQ ID NO: 5289 - DNA, 23 bp, Artificial Sequence
  HLA-A targeting gRNA
cctgctccacccacggcgcccgg

SEQ ID NO: 5290 - DNA, 23 bp, Artificial Sequence
  HLA-A targeting gRNA
cctgctctatccacggcgcccgg

SEQ ID NO: 5291 - DNA, 23 bp, Artificial Sequence
  HLA-A targeting gRNA
cctgctctatccatggcgcccgg

SEQ ID NO: 5292 - DNA, 23 bp, Artificial Sequence
  HLA-A targeting gRNA
cctgctctatccatggctcccgg

SEQ ID NO: 5293 - DNA, 23 bp, Artificial Sequence
  HLA-A targeting gRNA
cctgctgaagggctccagaaggg

SEQ ID NO: 5294 - DNA, 23 bp, Artificial Sequence
  HLA-A targeting gRNA
cctgctgctctagggggcagtgg

SEQ ID NO: 5295 - DNA, 23 bp, Artificial Sequence
  HLA-A targeting gRNA
cctgctgctctcggcggccctgg

SEQ ID NO: 5296 - DNA, 23 bp, Artificial Sequence
  HLA-A targeting gRNA
cctgctgctctcgggagccctgg

SEQ ID NO: 5297 - DNA, 23 bp, Artificial Sequence
  HLA-A targeting gRNA
cctgctgctctcgggaggcctgg

SEQ ID NO: 5298 - DNA, 23 bp, Artificial Sequence
  HLA-A targeting gRNA
cctgctgctctcgggagtcctgg

SEQ ID NO: 5299 - DNA, 23 bp, Artificial Sequence
  HLA-A targeting gRNA
cctgctgctctggggggcagtgg

SEQ ID NO: 5300 - DNA, 23 bp, Artificial Sequence
  HLA-A targeting gRNA
cctgctgctctggggggccctgg

SEQ ID NO: 5301 - DNA, 23 bp, Artificial Sequence
  HLA-A targeting gRNA
cctggacgcggcggacaccgcgg

SEQ ID NO: 5302 - DNA, 23 bp, Artificial Sequence
  HLA-A targeting gRNA
cctggccctgaccgagacctggg

SEQ ID NO: 5303 - DNA, 23 bp, Artificial Sequence
  HLA-A targeting gRNA
cctggccctgatcgagacctggg

SEQ ID NO: 5304 - DNA, 23 bp, Artificial Sequence
  HLA-A targeting gRNA
cctggctgtcctagcagttgtgg

SEQ ID NO: 5305 - DNA, 23 bp, Artificial Sequence
  HLA-A targeting gRNA
cctggctgtcctggctgtcctgg

SEQ ID NO: 5306 - DNA, 23 bp, Artificial Sequence
  HLA-A targeting gRNA
cctgggcactgttgctgcctggg

SEQ ID NO: 5307 - DNA, 23 bp, Artificial Sequence
  HLA-A targeting gRNA
cctgggcactgttgctggctggg

SEQ ID NO: 5308 - DNA, 23 bp, Artificial Sequence
  HLA-A targeting gRNA
cctggggctctcgccggtcgagg

SEQ ID NO: 5309 - DNA, 23 bp, Artificial Sequence
  HLA-A targeting gRNA
cctggggctctctgcggtcgagg

SEQ ID NO: 5310 - DNA, 23 bp, Artificial Sequence
  HLA-A targeting gRNA
cctggggcttgaaaccccagtgg

SEQ ID NO: 5311 - DNA, 23 bp, Artificial Sequence
  HLA-A targeting gRNA
cctggtacccgcgcgctgcaggg

SEQ ID NO: 5312 - DNA, 23 bp, Artificial Sequence
  HLA-A targeting gRNA
cctggtcatacccgcggaggagg

SEQ ID NO: 5313 - DNA, 23 bp, Artificial Sequence
  HLA-A targeting gRNA
cctggtggtacccgcggaggagg

SEQ ID NO: 5314 - DNA, 23 bp, Artificial Sequence
  HLA-A targeting gRNA
cctggttatgcccgcggaggagg

SEQ ID NO: 5315 - DNA, 23 bp, Artificial Sequence
  HLA-A targeting gRNA
cctgtgaggggacagggaggagg

SEQ ID NO: 5316 - DNA, 23 bp, Artificial Sequence
  HLA-A targeting gRNA
cctgtgagtgcgaggttgggagg

SEQ ID NO: 5317 - DNA, 23 bp, Artificial Sequence
  HLA-A targeting gRNA
cctgtgagtgcggggttaggagg

SEQ ID NO: 5318 - DNA, 23 bp, Artificial Sequence
  HLA-A targeting gRNA
cctgtgagtgcggggttgggagg

SEQ ID NO: 5319 - DNA, 23 bp, Artificial Sequence
  HLA-A targeting gRNA
cctgtgtccaggctggcgtctgg

SEQ ID NO: 5320 - DNA, 23 bp, Artificial Sequence
  HLA-A targeting gRNA
cctgtgtgggactgagatgcagg

SEQ ID NO: 5321 - DNA, 23 bp, Artificial Sequence
  HLA-A targeting gRNA
cctgttagcataatgtgaggagg

SEQ ID NO: 5322 - DNA, 23 bp, Artificial Sequence
  HLA-A targeting gRNA
cctgttagcctaatgtgaggagg

SEQ ID NO: 5323 - DNA, 23 bp, Artificial Sequence
  HLA-A targeting gRNA
ccttaatggttgtggtgttgggg

SEQ ID NO: 5324 - DNA, 23 bp, Artificial Sequence
  HLA-A targeting gRNA
ccttaccccagctcagggtgagg

SEQ ID NO: 5325 - DNA, 23 bp, Artificial Sequence
  HLA-A targeting gRNA
ccttactccatctcagggtgagg

SEQ ID NO: 5326 - DNA, 23 bp, Artificial Sequence
  HLA-A targeting gRNA
ccttcatgttccgtgtctcccgg

SEQ ID NO: 5327 - DNA, 23 bp, Artificial Sequence
  HLA-A targeting gRNA
ccttctggagcccttcagcaggg

SEQ ID NO: 5328 - DNA, 23 bp, Artificial Sequence
  HLA-A targeting gRNA
ccttctggagcccttcagccggg

SEQ ID NO: 5329 - DNA, 23 bp, Artificial Sequence
  HLA-A targeting gRNA
ccttgatgattatggtgttgggg

SEQ ID NO: 5330 - DNA, 23 bp, Artificial Sequence
  HLA-A targeting gRNA
ccttgatggttgtggtgttgggg

SEQ ID NO: 5331 - DNA, 23 bp, Artificial Sequence
  HLA-A targeting gRNA
ccttgcagatctgtgtctcccgg

SEQ ID NO: 5332 - DNA, 23 bp, Artificial Sequence
  HLA-A targeting gRNA
ccttgcagatctgtgtgttccgg

SEQ ID NO: 5333 - DNA, 23 bp, Artificial Sequence
  HLA-A targeting gRNA
ccttgccatcgtaggcgaactgg

SEQ ID NO: 5334 - DNA, 23 bp, Artificial Sequence
  HLA-A targeting gRNA
ccttgccgtcctaggcggactgg

SEQ ID NO: 5335 - DNA, 23 bp, Artificial Sequence
  HLA-A targeting gRNA
ccttgccgtcgcaggcggactgg

SEQ ID NO: 5336 - DNA, 23 bp, Artificial Sequence
  HLA-A targeting gRNA
ccttgccgtcgtaggagtactgg

SEQ ID NO: 5337 - DNA, 23 bp, Artificial Sequence
  HLA-A targeting gRNA
ccttgccgtcgtaggcaaactgg

SEQ ID NO: 5338 - DNA, 23 bp, Artificial Sequence
  HLA-A targeting gRNA
ccttgccgtcgtaggcggaccgg

SEQ ID NO: 5339 - DNA, 23 bp, Artificial Sequence
  HLA-A targeting gRNA
ccttgccgtcgtaggcggactgg

SEQ ID NO: 5340 - DNA, 23 bp, Artificial Sequence
  HLA-A targeting gRNA
ccttgccgtcgtaggcgtcctgg

SEQ ID NO: 5341 - DNA, 23 bp, Artificial Sequence
  HLA-A targeting gRNA
ccttgccgtcgtaggctaactgg

SEQ ID NO: 5342 - DNA, 23 bp, Artificial Sequence
  HLA-A targeting gRNA
ccttgccgtcttaggcggactgg

SEQ ID NO: 5343 - DNA, 23 bp, Artificial Sequence
  HLA-A targeting gRNA
ccttggggtggatctcagacggg

SEQ ID NO: 5344 - DNA, 23 bp, Artificial Sequence
  HLA-A targeting gRNA
ccttggtggttgtggcgttgggg

SEQ ID NO: 5345 - DNA, 23 bp, Artificial Sequence
  HLA-A targeting gRNA
ccttggtggttgtggtgttgggg

SEQ ID NO: 5346 - DNA, 23 bp, Artificial Sequence
  HLA-A targeting gRNA
ccttgtagatctgtgtgttccgg

SEQ ID NO: 5347 - DNA, 23 bp, Artificial Sequence
  HLA-A targeting gRNA
ccttgtggtcaccgtagctgtgg

SEQ ID NO: 5348 - DNA, 23 bp, Artificial Sequence
  HLA-A targeting gRNA
cctttacccggtttcattttcgg

SEQ ID NO: 5349 - DNA, 23 bp, Artificial Sequence
  HLA-A targeting gRNA
cgaaaccgggtaaaggtgactgg

SEQ ID NO: 5350 - DNA, 23 bp, Artificial Sequence
  HLA-A targeting gRNA
cgaactggtcatacccgcggagg

SEQ ID NO: 5351 - DNA, 23 bp, Artificial Sequence
  HLA-A targeting gRNA
cgaactggtcatgcccgcggagg

SEQ ID NO: 5352 - DNA, 23 bp, Artificial Sequence
  HLA-A targeting gRNA
cgaactggttatacccgcggagg

SEQ ID NO: 5353 - DNA, 23 bp, Artificial Sequence
  HLA-A targeting gRNA
cgaactggttatacccgtggagg

SEQ ID NO: 5354 - DNA, 23 bp, Artificial Sequence
  HLA-A targeting gRNA
cgaactggttatgcccgcggagg

SEQ ID NO: 5355 - DNA, 23 bp, Artificial Sequence
  HLA-A targeting gRNA
cgaagcccctcaccctgagatgg

SEQ ID NO: 5356 - DNA, 23 bp, Artificial Sequence
  HLA-A targeting gRNA
cgaagtcccaggccccgggcggg

SEQ ID NO: 5357 - DNA, 23 bp, Artificial Sequence
  HLA-A targeting gRNA
cgaagtcccaggtcccggacggg

SEQ ID NO: 5358 - DNA, 23 bp, Artificial Sequence
  HLA-A targeting gRNA
cgaagtcccaggtcccgggcggg

SEQ ID NO: 5359 - DNA, 23 bp, Artificial Sequence
  HLA-A targeting gRNA
cgaagtcccatgtcccggacggg

SEQ ID NO: 5360 - DNA, 23 bp, Artificial Sequence
  HLA-A targeting gRNA
cgaccaacccgcggggattttgg

SEQ ID NO: 5361 - DNA, 23 bp, Artificial Sequence
  HLA-A targeting gRNA
cgaccccgcgagtccgagagggg

SEQ ID NO: 5362 - DNA, 23 bp, Artificial Sequence
  HLA-A targeting gRNA
cgacccctccccatcccccacgg

SEQ ID NO: 5363 - DNA, 23 bp, Artificial Sequence
  HLA-A targeting gRNA
cgacccctcctcatcccccacgg

SEQ ID NO: 5364 - DNA, 23 bp, Artificial Sequence
  HLA-A targeting gRNA
cgacccgcactcacccgcccagg

SEQ ID NO: 5365 - DNA, 23 bp, Artificial Sequence
  HLA-A targeting gRNA
cgacccgcactcaccggcccagg

SEQ ID NO: 5366 - DNA, 23 bp, Artificial Sequence
  HLA-A targeting gRNA
cgacctataggagatggggaagg

SEQ ID NO: 5367 - DNA, 23 bp, Artificial Sequence
  HLA-A targeting gRNA
cgacctctccccatcccccacgg

SEQ ID NO: 5368 - DNA, 23 bp, Artificial Sequence
  HLA-A targeting gRNA
cgacgccacgagtccgaggaagg

SEQ ID NO: 5369 - DNA, 23 bp, Artificial Sequence
  HLA-A targeting gRNA
cgacgccacgagtccgaggatgg

SEQ ID NO: 5370 - DNA, 23 bp, Artificial Sequence
  HLA-A targeting gRNA
cgacgccgcaagtccgagagggg

SEQ ID NO: 5371 - DNA, 23 bp, Artificial Sequence
  HLA-A targeting gRNA
cgacgccgcgagtccaagagggg

SEQ ID NO: 5372 - DNA, 23 bp, Artificial Sequence
  HLA-A targeting gRNA
cgacgccgcgagtccgagaaggg

SEQ ID NO: 5373 - DNA, 23 bp, Artificial Sequence
  HLA-A targeting gRNA
cgacgccgcgagtccgagagagg

SEQ ID NO: 5374 - DNA, 23 bp, Artificial Sequence
  HLA-A targeting gRNA
cgacgccgcgagtccgagagggg

SEQ ID NO: 5375 - DNA, 23 bp, Artificial Sequence
  HLA-A targeting gRNA
cgacgccgcgagtccgaggaagg

SEQ ID NO: 5376 - DNA, 23 bp, Artificial Sequence
  HLA-A targeting gRNA
cgacgccgcgagtccgaggacgg

SEQ ID NO: 5377 - DNA, 23 bp, Artificial Sequence
  HLA-A targeting gRNA
cgacgccgcgagtccgaggatgg

SEQ ID NO: 5378 - DNA, 23 bp, Artificial Sequence
  HLA-A targeting gRNA
cgacgccgcgagtccgagggggg

SEQ ID NO: 5379 - DNA, 23 bp, Artificial Sequence
  HLA-A targeting gRNA
cgacgctgcgagtccgaggacgg

SEQ ID NO: 5380 - DNA, 23 bp, Artificial Sequence
  HLA-A targeting gRNA
cgactccgcgagtccaagagggg

SEQ ID NO: 5381 - DNA, 23 bp, Artificial Sequence
  HLA-A targeting gRNA
cgagagaggagccgcgggcgcgg

SEQ ID NO: 5382 - DNA, 23 bp, Artificial Sequence
  HLA-A targeting gRNA
cgagagccttgtctgcattgggg

SEQ ID NO: 5383 - DNA, 23 bp, Artificial Sequence
  HLA-A targeting gRNA
cgagatccgccccgaggccgcgg

SEQ ID NO: 5384 - DNA, 23 bp, Artificial Sequence
  HLA-A targeting gRNA
cgagcagctgagagcctacctgg

SEQ ID NO: 5385 - DNA, 23 bp, Artificial Sequence
  HLA-A targeting gRNA
cgagggccgcgtctgcaatgggg

SEQ ID NO: 5386 - DNA, 23 bp, Artificial Sequence
  HLA-A targeting gRNA
cgagggccgcgtctgcattgggg

SEQ ID NO: 5387 - DNA, 23 bp, Artificial Sequence
  HLA-A targeting gRNA
cgagtccaagaggggagccgcgg

SEQ ID NO: 5388 - DNA, 23 bp, Artificial Sequence
  HLA-A targeting gRNA
cgagtccgagagaggagccgcgg

SEQ ID NO: 5389 - DNA, 23 bp, Artificial Sequence
  HLA-A targeting gRNA
cgagtccgagaggggagccccgg

SEQ ID NO: 5390 - DNA, 23 bp, Artificial Sequence
  HLA-A targeting gRNA
cgagtccgagaggggagccgcgg

SEQ ID NO: 5391 - DNA, 23 bp, Artificial Sequence
  HLA-A targeting gRNA
cgagtccgaggaaggagccgcgg

SEQ ID NO: 5392 - DNA, 23 bp, Artificial Sequence
  HLA-A targeting gRNA
cgagtccgaggacggagccccgg

SEQ ID NO: 5393 - DNA, 23 bp, Artificial Sequence
  HLA-A targeting gRNA
cgagtccgaggacggagccctgg

SEQ ID NO: 5394 - DNA, 23 bp, Artificial Sequence
  HLA-A targeting gRNA
cgagtccgaggatggagccccgg

SEQ ID NO: 5395 - DNA, 23 bp, Artificial Sequence
  HLA-A targeting gRNA
cgagtccgaggatggcgccccgg

SEQ ID NO: 5396 - DNA, 23 bp, Artificial Sequence
  HLA-A targeting gRNA
cgagtccgaggatggcgccctgg

SEQ ID NO: 5397 - DNA, 23 bp, Artificial Sequence
  HLA-A targeting gRNA
cgagtccgaggggggagccgcgg

SEQ ID NO: 5398 - DNA, 23 bp, Artificial Sequence
  HLA-A targeting gRNA
cgagtccgggtgggtgactgggg

SEQ ID NO: 5399 - DNA, 23 bp, Artificial Sequence
  HLA-A targeting gRNA
cgagtctctgagcggggaacagg

SEQ ID NO: 5400 - DNA, 23 bp, Artificial Sequence
  HLA-A targeting gRNA
cgagtctctgagtggggaacagg

SEQ ID NO: 5401 - DNA, 23 bp, Artificial Sequence
  HLA-A targeting gRNA
cgatctataggagatggggaagg

SEQ ID NO: 5402 - DNA, 23 bp, Artificial Sequence
  HLA-A targeting gRNA
cgatgaagcggagctccccgcgg

SEQ ID NO: 5403 - DNA, 23 bp, Artificial Sequence
  HLA-A targeting gRNA
cgatgaagcggggctccccacgg

SEQ ID NO: 5404 - DNA, 23 bp, Artificial Sequence
  HLA-A targeting gRNA
cgatgaagcggggctctccgcgg

SEQ ID NO: 5405 - DNA, 23 bp, Artificial Sequence
  HLA-A targeting gRNA
cgatgaagtggggctccccgcgg

SEQ ID NO: 5406 - DNA, 23 bp, Artificial Sequence
  HLA-A targeting gRNA
cgatgaagtggggctctccgcgg

SEQ ID NO: 5407 - DNA, 23 bp, Artificial Sequence
  HLA-A targeting gRNA
cgatgtacggctgcgacgtgggg

SEQ ID NO: 5408 - DNA, 23 bp, Artificial Sequence
  HLA-A targeting gRNA
cgatgtatggctgcgacatgggg

SEQ ID NO: 5409 - DNA, 23 bp, Artificial Sequence
  HLA-A targeting gRNA
cgatgtatggctgcgacctgggg

SEQ ID NO: 5410 - DNA, 23 bp, Artificial Sequence
  HLA-A targeting gRNA
cgatgtatggctgcgacgtgggg

SEQ ID NO: 5411 - DNA, 23 bp, Artificial Sequence
  HLA-A targeting gRNA
cgcaagttggaggcggcccgtgg

SEQ ID NO: 5412 - DNA, 23 bp, Artificial Sequence
  HLA-A targeting gRNA
cgcacgggccgcctccaacttgg

SEQ ID NO: 5413 - DNA, 23 bp, Artificial Sequence
  HLA-A targeting gRNA
cgcagccaaacatccactggagg

SEQ ID NO: 5414 - DNA, 23 bp, Artificial Sequence
  HLA-A targeting gRNA
cgcagccaaacatcctctggagg

SEQ ID NO: 5415 - DNA, 23 bp, Artificial Sequence
  HLA-A targeting gRNA
cgcagccacacatccactggagg

SEQ ID NO: 5416 - DNA, 23 bp, Artificial Sequence
  HLA-A targeting gRNA
cgcagccagacatcctctggagg

SEQ ID NO: 5417 - DNA, 23 bp, Artificial Sequence
  HLA-A targeting gRNA
cgcagccatacatattctggagg

SEQ ID NO: 5418 - DNA, 23 bp, Artificial Sequence
  HLA-A targeting gRNA
cgcagccatacatccactggagg

SEQ ID NO: 5419 - DNA, 23 bp, Artificial Sequence
  HLA-A targeting gRNA
cgcagccatacatccgctggagg

SEQ ID NO: 5420 - DNA, 23 bp, Artificial Sequence
  HLA-A targeting gRNA
cgcagccatacatgctctggagg

SEQ ID NO: 5421 - DNA, 23 bp, Artificial Sequence
  HLA-A targeting gRNA
cgcagccgtacaagctctggagg

SEQ ID NO: 5422 - DNA, 23 bp, Artificial Sequence
  HLA-A targeting gRNA
cgcagccgtacatccactggagg

SEQ ID NO: 5423 - DNA, 23 bp, Artificial Sequence
  HLA-A targeting gRNA
cgcagccgtacatcctctggagg

SEQ ID NO: 5424 - DNA, 23 bp, Artificial Sequence
  HLA-A targeting gRNA
cgcagccgtacatcctctggcgg

SEQ ID NO: 5425 - DNA, 23 bp, Artificial Sequence
  HLA-A targeting gRNA
cgcagccgtacatcgtctggagg

SEQ ID NO: 5426 - DNA, 23 bp, Artificial Sequence
  HLA-A targeting gRNA
cgcagccgtacatgctctggagg

SEQ ID NO: 5427 - DNA, 23 bp, Artificial Sequence
  HLA-A targeting gRNA
cgcaggagacgtgggacaggagg

SEQ ID NO: 5428 - DNA, 23 bp, Artificial Sequence
  HLA-A targeting gRNA
cgcaggagacgttggacaggagg

SEQ ID NO: 5429 - DNA, 23 bp, Artificial Sequence
  HLA-A targeting gRNA
cgcaggagatgtgggacaagagg

SEQ ID NO: 5430 - DNA, 23 bp, Artificial Sequence
  HLA-A targeting gRNA
cgcagggaggagggtcgggcggg

SEQ ID NO: 5431 - DNA, 23 bp, Artificial Sequence
  HLA-A targeting gRNA
cgcagggaggtgggtcgggcggg

SEQ ID NO: 5432 - DNA, 23 bp, Artificial Sequence
  HLA-A targeting gRNA
cgcaggtaccaggggcagtgggg

SEQ ID NO: 5433 - DNA, 23 bp, Artificial Sequence
  HLA-A targeting gRNA
cgccatggatagagcaagagggg

SEQ ID NO: 5434 - DNA, 23 bp, Artificial Sequence
  HLA-A targeting gRNA
cgccatggatagagcaggagggg

SEQ ID NO: 5435 - DNA, 23 bp, Artificial Sequence
  HLA-A targeting gRNA
cgcccaacccgcggggattttgg

SEQ ID NO: 5436 - DNA, 23 bp, Artificial Sequence
  HLA-A targeting gRNA
cgccctggatagagcaggagggg

SEQ ID NO: 5437 - DNA, 23 bp, Artificial Sequence
  HLA-A targeting gRNA
cgccgagagcagcaggaggacgg

SEQ ID NO: 5438 - DNA, 23 bp, Artificial Sequence
  HLA-A targeting gRNA
cgccgggaggagggtctggcggg

SEQ ID NO: 5439 - DNA, 23 bp, Artificial Sequence
  HLA-A targeting gRNA
cgccgggaggtgggtcgggcggg

SEQ ID NO: 5440 - DNA, 23 bp, Artificial Sequence
  HLA-A targeting gRNA
cgccggtaggagggtcgggcggg

SEQ ID NO: 5441 - DNA, 23 bp, Artificial Sequence
  HLA-A targeting gRNA
cgccggtcgagggtctgggcggg

SEQ ID NO: 5442 - DNA, 23 bp, Artificial Sequence
  HLA-A targeting gRNA
cgccggtcgagggtttgggcggg

SEQ ID NO: 5443 - DNA, 23 bp, Artificial Sequence
  HLA-A targeting gRNA
cgccgtggatagagcaagagggg

SEQ ID NO: 5444 - DNA, 23 bp, Artificial Sequence
  HLA-A targeting gRNA
cgccgtgggtggagaaggagggg

SEQ ID NO: 5445 - DNA, 23 bp, Artificial Sequence
  HLA-A targeting gRNA
cgccgtgggtggagcaggagggg

SEQ ID NO: 5446 - DNA, 23 bp, Artificial Sequence
  HLA-A targeting gRNA
cgccgtgtccgcagcggtccagg

SEQ ID NO: 5447 - DNA, 23 bp, Artificial Sequence
  HLA-A targeting gRNA
cgccgtgtccgccgcggtccagg

SEQ ID NO: 5448 - DNA, 23 bp, Artificial Sequence
  HLA-A targeting gRNA
cgccgtgtccgcggcaatccagg

SEQ ID NO: 5449 - DNA, 23 bp, Artificial Sequence
  HLA-A targeting gRNA
cgccgtgtccgcggcagtccagg

SEQ ID NO: 5450 - DNA, 23 bp, Artificial Sequence
  HLA-A targeting gRNA
cgccgtgtccgcggcggtccagg

SEQ ID NO: 5451 - DNA, 23 bp, Artificial Sequence
  HLA-A targeting gRNA
cgccttgatggttgtggtgttgg

SEQ ID NO: 5452 - DNA, 23 bp, Artificial Sequence
  HLA-A targeting gRNA
cgccttgtccgcggcggtccagg

SEQ ID NO: 5453 - DNA, 23 bp, Artificial Sequence
  HLA-A targeting gRNA
cgcgcaggtaccaggggcagtgg

SEQ ID NO: 5454 - DNA, 23 bp, Artificial Sequence
  HLA-A targeting gRNA
cgcgcccgcggctcctctctcgg

SEQ ID NO: 5455 - DNA, 23 bp, Artificial Sequence
  HLA-A targeting gRNA
cgcgcgggtaccaagggcagtgg

SEQ ID NO: 5456 - DNA, 23 bp, Artificial Sequence
  HLA-A targeting gRNA
cgcgcgggtaccaggggcagtgg

SEQ ID NO: 5457 - DNA, 23 bp, Artificial Sequence
  HLA-A targeting gRNA
cgcgcgggtaccggggcagtggg

SEQ ID NO: 5458 - DNA, 23 bp, Artificial Sequence
  HLA-A targeting gRNA
cgcgctgcagcgtctccttccgg

SEQ ID NO: 5459 - DNA, 23 bp, Artificial Sequence
  HLA-A targeting gRNA
cgcgctggtaccaggggcagtgg

SEQ ID NO: 5460 - DNA, 23 bp, Artificial Sequence
  HLA-A targeting gRNA
cgcggcctcggggcggatctcgg

SEQ ID NO: 5461 - DNA, 23 bp, Artificial Sequence
  HLA-A targeting gRNA
cgcgggacggggctgaccacggg

SEQ ID NO: 5462 - DNA, 23 bp, Artificial Sequence
  HLA-A targeting gRNA
cgcgggtaccaagggcagtgggg

SEQ ID NO: 5463 - DNA, 23 bp, Artificial Sequence
  HLA-A targeting gRNA
cgcgggtaccaggggcagtgggg

SEQ ID NO: 5464 - DNA, 23 bp, Artificial Sequence
  HLA-A targeting gRNA
cgcggtatccgcggcggtccagg

SEQ ID NO: 5465 - DNA, 23 bp, Artificial Sequence
  HLA-A targeting gRNA
cgcggtcagccccgtccccccgg

SEQ ID NO: 5466 - DNA, 23 bp, Artificial Sequence
  HLA-A targeting gRNA
cgcggtggatagagcaggagggg

SEQ ID NO: 5467 - DNA, 23 bp, Artificial Sequence
  HLA-A targeting gRNA
cgcggtgtccgcagcggtccagg

SEQ ID NO: 5468 - DNA, 23 bp, Artificial Sequence
  HLA-A targeting gRNA
cgcggtgtccgccgcgatccagg

SEQ ID NO: 5469 - DNA, 23 bp, Artificial Sequence
  HLA-A targeting gRNA
cgcggtgtccgccgcggtccagg

SEQ ID NO: 5470 - DNA, 23 bp, Artificial Sequence
  HLA-A targeting gRNA
cgcggtgtccgccgcggtccggg

SEQ ID NO: 5471 - DNA, 23 bp, Artificial Sequence
  HLA-A targeting gRNA
cgcggtgtccgcggcggtccagg

SEQ ID NO: 5472 - DNA, 23 bp, Artificial Sequence
  HLA-A targeting gRNA
cgctctggttgtagccgcgcagg

SEQ ID NO: 5473 - DNA, 23 bp, Artificial Sequence
  HLA-A targeting gRNA
cgctgcaacgcgcgggtaccagg

SEQ ID NO: 5474 - DNA, 23 bp, Artificial Sequence
  HLA-A targeting gRNA
cgctgcagagcgcgggtaccagg

SEQ ID NO: 5475 - DNA, 23 bp, Artificial Sequence
  HLA-A targeting gRNA
cgctgcagcacgcgggtaccagg

SEQ ID NO: 5476 - DNA, 23 bp, Artificial Sequence
  HLA-A targeting gRNA
cgctgcagcgcgcaggtaccagg

SEQ ID NO: 5477 - DNA, 23 bp, Artificial Sequence
  HLA-A targeting gRNA
cgctgcagcgcgcgggtaccggg

SEQ ID NO: 5478 - DNA, 23 bp, Artificial Sequence
  HLA-A targeting gRNA
cgctggagcgcgcgggtaccagg

SEQ ID NO: 5479 - DNA, 23 bp, Artificial Sequence
  HLA-A targeting gRNA
cgctggagggtgtgagaccctgg

SEQ ID NO: 5480 - DNA, 23 bp, Artificial Sequence
  HLA-A targeting gRNA
cgctggtaccaggggcagtgggg

SEQ ID NO: 5481 - DNA, 23 bp, Artificial Sequence
  HLA-A targeting gRNA
cgctgtcgaacctcacgaactgg

SEQ ID NO: 5482 - DNA, 23 bp, Artificial Sequence
  HLA-A targeting gRNA
cgctgtgtccccggcggtccagg

SEQ ID NO: 5483 - DNA, 23 bp, Artificial Sequence
  HLA-A targeting gRNA
cgctgtgtccgcggcggtccagg

SEQ ID NO: 5484 - DNA, 23 bp, Artificial Sequence
  HLA-A targeting gRNA
cgcttgtaaaggtgagattctgg

SEQ ID NO: 5485 - DNA, 23 bp, Artificial Sequence
  HLA-A targeting gRNA
cgcttgtaaggtgagattctggg

SEQ ID NO: 5486 - DNA, 23 bp, Artificial Sequence
  HLA-A targeting gRNA
cggacaggacacctggggtgggg

SEQ ID NO: 5487 - DNA, 23 bp, Artificial Sequence
  HLA-A targeting gRNA
cggaccggtcatacccgcggagg

SEQ ID NO: 5488 - DNA, 23 bp, Artificial Sequence
  HLA-A targeting gRNA
cggacgggcgcctcctccgtggg

SEQ ID NO: 5489 - DNA, 23 bp, Artificial Sequence
  HLA-A targeting gRNA
cggactcacattctccccagagg

SEQ ID NO: 5490 - DNA, 23 bp, Artificial Sequence
  HLA-A targeting gRNA
cggactgatcatacccgcggagg

SEQ ID NO: 5491 - DNA, 23 bp, Artificial Sequence
  HLA-A targeting gRNA
cggactggccatacccgcggagg

SEQ ID NO: 5492 - DNA, 23 bp, Artificial Sequence
  HLA-A targeting gRNA
cggactggtcatacccgcggagg

SEQ ID NO: 5493 - DNA, 23 bp, Artificial Sequence
  HLA-A targeting gRNA
cggactggtcatgcccgcggagg

SEQ ID NO: 5494 - DNA, 23 bp, Artificial Sequence
  HLA-A targeting gRNA
cggagcagctgagagcctaccgg

SEQ ID NO: 5495 - DNA, 23 bp, Artificial Sequence
  HLA-A targeting gRNA
cggagcccctcaccctgagatgg

SEQ ID NO: 5496 - DNA, 23 bp, Artificial Sequence
  HLA-A targeting gRNA
cggagctgtggtcgctgctgtgg

SEQ ID NO: 5497 - DNA, 23 bp, Artificial Sequence
  HLA-A targeting gRNA
cggatacctggagaacgggaagg

SEQ ID NO: 5498 - DNA, 23 bp, Artificial Sequence
  HLA-A targeting gRNA
cggatgggcgcctcctccgcggg

SEQ ID NO: 5499 - DNA, 23 bp, Artificial Sequence
  HLA-A targeting gRNA
cggatgtatggctgcgacctggg

SEQ ID NO: 5500 - DNA, 23 bp, Artificial Sequence
  HLA-A targeting gRNA
cggattccgcagcctcggggtgg

SEQ ID NO: 5501 - DNA, 23 bp, Artificial Sequence
  HLA-A targeting gRNA
cggcaaggattacatcgccctgg

SEQ ID NO: 5502 - DNA, 23 bp, Artificial Sequence
  HLA-A targeting gRNA
cggcagggaaatggcctctgtgg

SEQ ID NO: 5503 - DNA, 23 bp, Artificial Sequence
  HLA-A targeting gRNA
cggcatggcctcccacgaggagg

SEQ ID NO: 5504 - DNA, 23 bp, Artificial Sequence
  HLA-A targeting gRNA
cggccactacaaccagagcgagg

SEQ ID NO: 5505 - DNA, 23 bp, Artificial Sequence
  HLA-A targeting gRNA
cggcccctcctgctctatccagg

SEQ ID NO: 5506 - DNA, 23 bp, Artificial Sequence
  HLA-A targeting gRNA
cggcccgtgaggcggagcaacgg

SEQ ID NO: 5507 - DNA, 23 bp, Artificial Sequence
  HLA-A targeting gRNA
cggcccgtgaggcggagcagcgg

SEQ ID NO: 5508 - DNA, 23 bp, Artificial Sequence
  HLA-A targeting gRNA
cggcccgtgaggcggagcagtgg

SEQ ID NO: 5509 - DNA, 23 bp, Artificial Sequence
  HLA-A targeting gRNA
cggcccgtgcggcggagcagtgg

SEQ ID NO: 5510 - DNA, 23 bp, Artificial Sequence
  HLA-A targeting gRNA
cggcccgtgtggcggagcagcgg

SEQ ID NO: 5511 - DNA, 23 bp, Artificial Sequence
  HLA-A targeting gRNA
cggccgcctcccacttgcgctgg

SEQ ID NO: 5512 - DNA, 23 bp, Artificial Sequence
  HLA-A targeting gRNA
cggccggtgaggcggagcagcgg

SEQ ID NO: 5513 - DNA, 23 bp, Artificial Sequence
  HLA-A targeting gRNA
cggcctcagggggcggatctcgg

SEQ ID NO: 5514 - DNA, 23 bp, Artificial Sequence
  HLA-A targeting gRNA
cggcctcgctctggttgtagtgg

SEQ ID NO: 5515 - DNA, 23 bp, Artificial Sequence
  HLA-A targeting gRNA
cggcctgtgaggcggagcagcgg

SEQ ID NO: 5516 - DNA, 23 bp, Artificial Sequence
  HLA-A targeting gRNA
cggcgagggcgcaggacccgggg

SEQ ID NO: 5517 - DNA, 23 bp, Artificial Sequence
  HLA-A targeting gRNA
cggctactacaaccggagcgagg

SEQ ID NO: 5518 - DNA, 23 bp, Artificial Sequence
  HLA-A targeting gRNA
cggctactataaccagagcgagg

SEQ ID NO: 5519 - DNA, 23 bp, Artificial Sequence
  HLA-A targeting gRNA
cggctcccccctcggactcgcgg

SEQ ID NO: 5520 - DNA, 23 bp, Artificial Sequence
  HLA-A targeting gRNA
cggctcccctctcggactcgcgg

SEQ ID NO: 5521 - DNA, 23 bp, Artificial Sequence
  HLA-A targeting gRNA
cggctcccctcttggactcgcgg

SEQ ID NO: 5522 - DNA, 23 bp, Artificial Sequence
  HLA-A targeting gRNA
cggctcctctctcggactcgcgg

SEQ ID NO: 5523 - DNA, 23 bp, Artificial Sequence
  HLA-A targeting gRNA
cggctccttcctcggactcgcgg

SEQ ID NO: 5524 - DNA, 23 bp, Artificial Sequence
  HLA-A targeting gRNA
cggctccttcctcggactcgtgg

SEQ ID NO: 5525 - DNA, 23 bp, Artificial Sequence
  HLA-A targeting gRNA
cggctcgtgaggcggagcagcgg

SEQ ID NO: 5526 - DNA, 23 bp, Artificial Sequence
  HLA-A targeting gRNA
cggctgcgacctgggcccgacgg

SEQ ID NO: 5527 - DNA, 23 bp, Artificial Sequence
  HLA-A targeting gRNA
cgggaaaggaagggaagatgagg

SEQ ID NO: 5528 - DNA, 23 bp, Artificial Sequence
  HLA-A targeting gRNA
cgggaagccgcgcagggaggagg

SEQ ID NO: 5529 - DNA, 23 bp, Artificial Sequence
  HLA-A targeting gRNA
cgggacacctggggtggggaagg

SEQ ID NO: 5530 - DNA, 23 bp, Artificial Sequence
  HLA-A targeting gRNA
cgggacctgcgccccgggccggg

SEQ ID NO: 5531 - DNA, 23 bp, Artificial Sequence
  HLA-A targeting gRNA
cgggacggggctgaccacggggg

SEQ ID NO: 5532 - DNA, 23 bp, Artificial Sequence
  HLA-A targeting gRNA
cgggactggggcggggctcgggg

SEQ ID NO: 5533 - DNA, 23 bp, Artificial Sequence
  HLA-A targeting gRNA
cgggagactcggggcgacccggg

SEQ ID NO: 5534 - DNA, 23 bp, Artificial Sequence
  HLA-A targeting gRNA
cgggagacttggggcgacccggg

SEQ ID NO: 5535 - DNA, 23 bp, Artificial Sequence
  HLA-A targeting gRNA
cgggagatctacaggagataggg

SEQ ID NO: 5536 - DNA, 23 bp, Artificial Sequence
  HLA-A targeting gRNA
cgggagatctacaggagatgggg

SEQ ID NO: 5537 - DNA, 23 bp, Artificial Sequence
  HLA-A targeting gRNA
cgggagatctacgggagatgggg

SEQ ID NO: 5538 - DNA, 23 bp, Artificial Sequence
  HLA-A targeting gRNA
cgggagatctataggagatgggg

SEQ ID NO: 5539 - DNA, 23 bp, Artificial Sequence
  HLA-A targeting gRNA
cgggagggaaatggcctctgtgg

SEQ ID NO: 5540 - DNA, 23 bp, Artificial Sequence
  HLA-A targeting gRNA
cgggatggcctcccacgaggagg

SEQ ID NO: 5541 - DNA, 23 bp, Artificial Sequence
  HLA-A targeting gRNA
cgggatggccttccacgaggagg

SEQ ID NO: 5542 - DNA, 23 bp, Artificial Sequence
  HLA-A targeting gRNA
cgggcatgaccagtccgcctagg

SEQ ID NO: 5543 - DNA, 23 bp, Artificial Sequence
  HLA-A targeting gRNA
cgggccgggacacggaggtgtgg

SEQ ID NO: 5544 - DNA, 23 bp, Artificial Sequence
  HLA-A targeting gRNA
cgggccgggacatggcggtgtgg

SEQ ID NO: 5545 - DNA, 23 bp, Artificial Sequence
  HLA-A targeting gRNA
cgggccgtacgtcggggttgggg

SEQ ID NO: 5546 - DNA, 23 bp, Artificial Sequence
  HLA-A targeting gRNA
cgggccgtacgtgggggatgggg

SEQ ID NO: 5547 - DNA, 23 bp, Artificial Sequence
  HLA-A targeting gRNA
cgggccgtccgtgggggatgagg

SEQ ID NO: 5548 - DNA, 23 bp, Artificial Sequence
  HLA-A targeting gRNA
cgggccgtccgtgggggatgggg

SEQ ID NO: 5549 - DNA, 23 bp, Artificial Sequence
  HLA-A targeting gRNA
cgggcgatctataggagatgggg

SEQ ID NO: 5550 - DNA, 23 bp, Artificial Sequence
  HLA-A targeting gRNA
cgggcgccgtgggtggaggaggg

SEQ ID NO: 5551 - DNA, 23 bp, Artificial Sequence
  HLA-A targeting gRNA
cggggagacacggaacatgaagg

SEQ ID NO: 5552 - DNA, 23 bp, Artificial Sequence
  HLA-A targeting gRNA
cggggagactcggggcgacccgg

SEQ ID NO: 5553 - DNA, 23 bp, Artificial Sequence
  HLA-A targeting gRNA
cggggagactctaggcgacccgg

SEQ ID NO: 5554 - DNA, 23 bp, Artificial Sequence
  HLA-A targeting gRNA
cggggagactctgggcgacccgg

SEQ ID NO: 5555 - DNA, 23 bp, Artificial Sequence
  HLA-A targeting gRNA
cggggagccgcgcagggaggagg

SEQ ID NO: 5556 - DNA, 23 bp, Artificial Sequence
  HLA-A targeting gRNA
cggggagccgcgcagggaggtgg

SEQ ID NO: 5557 - DNA, 23 bp, Artificial Sequence
  HLA-A targeting gRNA
cggggagccgcgccgggaggagg

SEQ ID NO: 5558 - DNA, 23 bp, Artificial Sequence
  HLA-A targeting gRNA
cggggagccgcgccgggaggtgg

SEQ ID NO: 5559 - DNA, 23 bp, Artificial Sequence
  HLA-A targeting gRNA
cggggagccgcgccggtaggagg

SEQ ID NO: 5560 - DNA, 23 bp, Artificial Sequence
  HLA-A targeting gRNA
cggggagcggcgcagggaggagg

SEQ ID NO: 5561 - DNA, 23 bp, Artificial Sequence
  HLA-A targeting gRNA
cggggagcggcgcagggaggtgg

SEQ ID NO: 5562 - DNA, 23 bp, Artificial Sequence
  HLA-A targeting gRNA
cggggccagggtctcacacttgg

SEQ ID NO: 5563 - DNA, 23 bp, Artificial Sequence
  HLA-A targeting gRNA
cggggccctcagaggaaactcgg

SEQ ID NO: 5564 - DNA, 23 bp, Artificial Sequence
  HLA-A targeting gRNA
cggggcggggccggggggacggg

SEQ ID NO: 5565 - DNA, 23 bp, Artificial Sequence
  HLA-A targeting gRNA
cggggcggggcggggccgggggg

SEQ ID NO: 5566 - DNA, 23 bp, Artificial Sequence
  HLA-A targeting gRNA
cggggcggggctcgggggacggg

SEQ ID NO: 5567 - DNA, 23 bp, Artificial Sequence
  HLA-A targeting gRNA
cggggcggggctcggggggacgg

SEQ ID NO: 5568 - DNA, 23 bp, Artificial Sequence
  HLA-A targeting gRNA
cggggctcgggggacggggctgg

SEQ ID NO: 5569 - DNA, 23 bp, Artificial Sequence
  HLA-A targeting gRNA
cggggctgaccacgggggcgggg

SEQ ID NO: 5570 - DNA, 23 bp, Artificial Sequence
  HLA-A targeting gRNA
cggggctgaccgcggggccgggg

SEQ ID NO: 5571 - DNA, 23 bp, Artificial Sequence
  HLA-A targeting gRNA
cggggctgaccgcggggcctagg

SEQ ID NO: 5572 - DNA, 23 bp, Artificial Sequence
  HLA-A targeting gRNA
cggggctgaccgcggggcctggg

SEQ ID NO: 5573 - DNA, 23 bp, Artificial Sequence
  HLA-A targeting gRNA
cggggctgaccgcgggggcgggg

SEQ ID NO: 5574 - DNA, 23 bp, Artificial Sequence
  HLA-A targeting gRNA
cggggctggccgcggggccgggg

SEQ ID NO: 5575 - DNA, 23 bp, Artificial Sequence
  HLA-A targeting gRNA
cggggctggggcggggctcgcgg

SEQ ID NO: 5576 - DNA, 23 bp, Artificial Sequence
  HLA-A targeting gRNA
cggggctggggcggggctcgggg

SEQ ID NO: 5577 - DNA, 23 bp, Artificial Sequence
  HLA-A targeting gRNA
cggggctggggcggggttcgggg

SEQ ID NO: 5578 - DNA, 23 bp, Artificial Sequence
  HLA-A targeting gRNA
cgggggaccgggctgaccacggg

SEQ ID NO: 5579 - DNA, 23 bp, Artificial Sequence
  HLA-A targeting gRNA
cgggggacgggctgaccacgggg

SEQ ID NO: 5580 - DNA, 23 bp, Artificial Sequence
  HLA-A targeting gRNA
cgggggacggggctgaccacggg

SEQ ID NO: 5581 - DNA, 23 bp, Artificial Sequence
  HLA-A targeting gRNA
cgggggacggggctgaccgcggg

SEQ ID NO: 5582 - DNA, 23 bp, Artificial Sequence
  HLA-A targeting gRNA
cgggggacggggctggccgcggg

SEQ ID NO: 5583 - DNA, 23 bp, Artificial Sequence
  HLA-A targeting gRNA
cgggggacggtgctgaccgcggg

SEQ ID NO: 5584 - DNA, 23 bp, Artificial Sequence
  HLA-A targeting gRNA
cgggggactgggctgaccacggg

SEQ ID NO: 5585 - DNA, 23 bp, Artificial Sequence
  HLA-A targeting gRNA
cggggggacggggctgaccgcgg

SEQ ID NO: 5586 - DNA, 23 bp, Artificial Sequence
  HLA-A targeting gRNA
cggggggactgggctgaccgcgg

SEQ ID NO: 5587 - DNA, 23 bp, Artificial Sequence
  HLA-A targeting gRNA
cgggggggggtggggtggggagg

SEQ ID NO: 5588 - DNA, 23 bp, Artificial Sequence
  HLA-A targeting gRNA
cggggggggtggggtggggaggg

SEQ ID NO: 5589 - DNA, 23 bp, Artificial Sequence
  HLA-A targeting gRNA
cggggggggtggtggggcagagg

SEQ ID NO: 5590 - DNA, 23 bp, Artificial Sequence
  HLA-A targeting gRNA
cggggtcacagtggacacaaggg

SEQ ID NO: 5591 - DNA, 23 bp, Artificial Sequence
  HLA-A targeting gRNA
cggggtcgccccgagtctccggg

SEQ ID NO: 5592 - DNA, 23 bp, Artificial Sequence
  HLA-A targeting gRNA
cggggtggggcagaggggaaagg

SEQ ID NO: 5593 - DNA, 23 bp, Artificial Sequence
  HLA-A targeting gRNA
cgggtcagggctgaggcttgggg

SEQ ID NO: 5594 - DNA, 23 bp, Artificial Sequence
  HLA-A targeting gRNA
cgggtcccgcggcctcagggagg

SEQ ID NO: 5595 - DNA, 23 bp, Artificial Sequence
  HLA-A targeting gRNA
cgggtcccgcggcctcagggggg

SEQ ID NO: 5596 - DNA, 23 bp, Artificial Sequence
  HLA-A targeting gRNA
cgggtcccgcggcctcggggcgg

SEQ ID NO: 5597 - DNA, 23 bp, Artificial Sequence
  HLA-A targeting gRNA
cgggtctgagatccaccccgagg

SEQ ID NO: 5598 - DNA, 23 bp, Artificial Sequence
  HLA-A targeting gRNA
cgggtgagtgcgggtcggcaggg

SEQ ID NO: 5599 - DNA, 23 bp, Artificial Sequence
  HLA-A targeting gRNA
cgggtgggtgacttcagaaccgg

SEQ ID NO: 5600 - DNA, 23 bp, Artificial Sequence
  HLA-A targeting gRNA
cgggttccgcagatccaccttgg

SEQ ID NO: 5601 - DNA, 23 bp, Artificial Sequence
  HLA-A targeting gRNA
cgggttccgcagcctcggggagg

SEQ ID NO: 5602 - DNA, 23 bp, Artificial Sequence
  HLA-A targeting gRNA
cgggttccgcagcctcggggtgg

SEQ ID NO: 5603 - DNA, 23 bp, Artificial Sequence
  HLA-A targeting gRNA
cgggttgggcggggcggggcggg

SEQ ID NO: 5604 - DNA, 23 bp, Artificial Sequence
  HLA-A targeting gRNA
cgggttggtcagggcggggcggg

SEQ ID NO: 5605 - DNA, 23 bp, Artificial Sequence
  HLA-A targeting gRNA
cgggttggtcgggactggggcgg

SEQ ID NO: 5606 - DNA, 23 bp, Artificial Sequence
  HLA-A targeting gRNA
cgggttggtcggggctggggcgg

SEQ ID NO: 5607 - DNA, 23 bp, Artificial Sequence
  HLA-A targeting gRNA
cggtgaccacaaggacagccagg

SEQ ID NO: 5608 - DNA, 23 bp, Artificial Sequence
  HLA-A targeting gRNA
cggtgagtgaccccggcctgggg

SEQ ID NO: 5609 - DNA, 23 bp, Artificial Sequence
  HLA-A targeting gRNA
cggtgagtgcgggatcgggaggg

SEQ ID NO: 5610 - DNA, 23 bp, Artificial Sequence
  HLA-A targeting gRNA
cggtgagtgcggggtcggcaggg

SEQ ID NO: 5611 - DNA, 23 bp, Artificial Sequence
  HLA-A targeting gRNA
cggtgagtgcggggtcgggaggg

SEQ ID NO: 5612 - DNA, 23 bp, Artificial Sequence
  HLA-A targeting gRNA
cggtgagtgcggggttgggaggg

SEQ ID NO: 5613 - DNA, 23 bp, Artificial Sequence
  HLA-A targeting gRNA
cggtgcccaaggctgctgcaggg

SEQ ID NO: 5614 - DNA, 23 bp, Artificial Sequence
  HLA-A targeting gRNA
cggtgctgaccgcggggccgggg

SEQ ID NO: 5615 - DNA, 23 bp, Artificial Sequence
  HLA-A targeting gRNA
cggttcccaaggctgctgcaggg

SEQ ID NO: 5616 - DNA, 23 bp, Artificial Sequence
  HLA-A targeting gRNA
cggttctgaagtcacccacccgg

SEQ ID NO: 5617 - DNA, 23 bp, Artificial Sequence
  HLA-A targeting gRNA
cgtaacccactgagatgaagcgg

SEQ ID NO: 5618 - DNA, 23 bp, Artificial Sequence
  HLA-A targeting gRNA
cgtacgtcggggttggggagggg

SEQ ID NO: 5619 - DNA, 23 bp, Artificial Sequence
  HLA-A targeting gRNA
cgtactggacatacccgcggagg

SEQ ID NO: 5620 - DNA, 23 bp, Artificial Sequence
  HLA-A targeting gRNA
cgtactggtcatacccgcggagg

SEQ ID NO: 5621 - DNA, 23 bp, Artificial Sequence
  HLA-A targeting gRNA
cgtactggtcatgcccgcggagg

SEQ ID NO: 5622 - DNA, 23 bp, Artificial Sequence
  HLA-A targeting gRNA
cgtactggttatacccgcggagg

SEQ ID NO: 5623 - DNA, 23 bp, Artificial Sequence
  HLA-A targeting gRNA
cgtactggttatgcccgcggagg

SEQ ID NO: 5624 - DNA, 23 bp, Artificial Sequence
  HLA-A targeting gRNA
cgtagcccacggtaatgaagcgg

SEQ ID NO: 5625 - DNA, 23 bp, Artificial Sequence
  HLA-A targeting gRNA
cgtagcccacggtgatgaagcgg

SEQ ID NO: 5626 - DNA, 23 bp, Artificial Sequence
  HLA-A targeting gRNA
cgtagcccactgagacgaagcgg

SEQ ID NO: 5627 - DNA, 23 bp, Artificial Sequence
  HLA-A targeting gRNA
cgtagcccactgagatgaagcgg

SEQ ID NO: 5628 - DNA, 23 bp, Artificial Sequence
  HLA-A targeting gRNA
cgtagcccactgcaatgaagcgg

SEQ ID NO: 5629 - DNA, 23 bp, Artificial Sequence
  HLA-A targeting gRNA
cgtagcccactgcgatgaagtgg

SEQ ID NO: 5630 - DNA, 23 bp, Artificial Sequence
  HLA-A targeting gRNA
cgtagcgcactgagatgaagcgg

SEQ ID NO: 5631 - DNA, 23 bp, Artificial Sequence
  HLA-A targeting gRNA
cgtcatggagtgggagcctgggg

SEQ ID NO: 5632 - DNA, 23 bp, Artificial Sequence
  HLA-A targeting gRNA
cgtccgtgggggatgaggagggg

SEQ ID NO: 5633 - DNA, 23 bp, Artificial Sequence
  HLA-A targeting gRNA
cgtccgtgggggatggggagagg

SEQ ID NO: 5634 - DNA, 23 bp, Artificial Sequence
  HLA-A targeting gRNA
cgtccgtgggggatggggagggg

SEQ ID NO: 5635 - DNA, 23 bp, Artificial Sequence
  HLA-A targeting gRNA
cgtcctcctgctgctctcggcgg

SEQ ID NO: 5636 - DNA, 23 bp, Artificial Sequence
  HLA-A targeting gRNA
cgtcctcctgctgctctgggggg

SEQ ID NO: 5637 - DNA, 23 bp, Artificial Sequence
  HLA-A targeting gRNA
cgtcctggtcatacccgcggagg

SEQ ID NO: 5638 - DNA, 23 bp, Artificial Sequence
  HLA-A targeting gRNA
cgtcctggtggtacccgcggagg

SEQ ID NO: 5639 - DNA, 23 bp, Artificial Sequence
  HLA-A targeting gRNA
cgtcctggttatgcccgcggagg

SEQ ID NO: 5640 - DNA, 23 bp, Artificial Sequence
  HLA-A targeting gRNA
cgtcgcagccagacatcctctgg

SEQ ID NO: 5641 - DNA, 23 bp, Artificial Sequence
  HLA-A targeting gRNA
cgtcgcagccatacatattctgg

SEQ ID NO: 5642 - DNA, 23 bp, Artificial Sequence
  HLA-A targeting gRNA
cgtcgcagccatacatcacctgg

SEQ ID NO: 5643 - DNA, 23 bp, Artificial Sequence
  HLA-A targeting gRNA
cgtcgcagccatacatccactgg

SEQ ID NO: 5644 - DNA, 23 bp, Artificial Sequence
  HLA-A targeting gRNA
cgtcgcagccatacatgctctgg

SEQ ID NO: 5645 - DNA, 23 bp, Artificial Sequence
  HLA-A targeting gRNA
cgtcgcagccgtacaagctctgg

SEQ ID NO: 5646 - DNA, 23 bp, Artificial Sequence
  HLA-A targeting gRNA
cgtcgcagccgtacatcctctgg

SEQ ID NO: 5647 - DNA, 23 bp, Artificial Sequence
  HLA-A targeting gRNA
cgtcgcagccgtacatcgtctgg

SEQ ID NO: 5648 - DNA, 23 bp, Artificial Sequence
  HLA-A targeting gRNA
cgtcgcagccgtacatgctctgg

SEQ ID NO: 5649 - DNA, 23 bp, Artificial Sequence
  HLA-A targeting gRNA
cgtcgcagccttacatcctctgg

SEQ ID NO: 5650 - DNA, 23 bp, Artificial Sequence
  HLA-A targeting gRNA
cgtgaagaaatcctgcatctcgg

SEQ ID NO: 5651 - DNA, 23 bp, Artificial Sequence
  HLA-A targeting gRNA
cgtgacctgcgccccaggccggg

SEQ ID NO: 5652 - DNA, 23 bp, Artificial Sequence
  HLA-A targeting gRNA
cgtgccatatgcagcacgagggg

SEQ ID NO: 5653 - DNA, 23 bp, Artificial Sequence
  HLA-A targeting gRNA
cgtgccatgtgcagcacgagggg

SEQ ID NO: 5654 - DNA, 23 bp, Artificial Sequence
  HLA-A targeting gRNA
cgtgccatgtgcagcatgagggg

SEQ ID NO: 5655 - DNA, 23 bp, Artificial Sequence
  HLA-A targeting gRNA
cgtgccatgttcagcacgagggg

SEQ ID NO: 5656 - DNA, 23 bp, Artificial Sequence
  HLA-A targeting gRNA
cgtgggacaggaggaattagggg

SEQ ID NO: 5657 - DNA, 23 bp, Artificial Sequence
  HLA-A targeting gRNA
cgtgggacaggaggaattatggg

SEQ ID NO: 5658 - DNA, 23 bp, Artificial Sequence
  HLA-A targeting gRNA
cgtgggcatcgttgctggcctgg

SEQ ID NO: 5659 - DNA, 23 bp, Artificial Sequence
  HLA-A targeting gRNA
cgtgggcattgttgctggcctgg

SEQ ID NO: 5660 - DNA, 23 bp, Artificial Sequence
  HLA-A targeting gRNA
cgtgggggatggggaggggtcgg

SEQ ID NO: 5661 - DNA, 23 bp, Artificial Sequence
  HLA-A targeting gRNA
cgtgtcccggcccggcagcgggg

SEQ ID NO: 5662 - DNA, 23 bp, Artificial Sequence
  HLA-A targeting gRNA
cgtgtcccggcctggccgcgggg

SEQ ID NO: 5663 - DNA, 23 bp, Artificial Sequence
  HLA-A targeting gRNA
cgtgtccgcggcggtccaggagg

SEQ ID NO: 5664 - DNA, 23 bp, Artificial Sequence
  HLA-A targeting gRNA
cgtgtcctggcccggccgcgggg

SEQ ID NO: 5665 - DNA, 23 bp, Artificial Sequence
  HLA-A targeting gRNA
cgtgtcgtccacatagcccacgg

SEQ ID NO: 5666 - DNA, 23 bp, Artificial Sequence
  HLA-A targeting gRNA
cgtgtttcctgatcctgccctgg

SEQ ID NO: 5667 - DNA, 23 bp, Artificial Sequence
  HLA-A targeting gRNA
cgtgtttcctgatcctgccttgg

SEQ ID NO: 5668 - DNA, 23 bp, Artificial Sequence
  HLA-A targeting gRNA
cgttctcaggatggtcacatggg

SEQ ID NO: 5669 - DNA, 23 bp, Artificial Sequence
  HLA-A targeting gRNA
cgttgctggcctggctgtcctgg

SEQ ID NO: 5670 - DNA, 23 bp, Artificial Sequence
  HLA-A targeting gRNA
cgttggacaggaggaattatggg

SEQ ID NO: 5671 - DNA, 23 bp, Artificial Sequence
  HLA-A targeting gRNA
cgtttctggcccagctgtcctgg

SEQ ID NO: 5672 - DNA, 23 bp, Artificial Sequence
  HLA-A targeting gRNA
ctaactggtcatgcccgcggagg

SEQ ID NO: 5673 - DNA, 23 bp, Artificial Sequence
  HLA-A targeting gRNA
ctaactggttatacccgcggagg

SEQ ID NO: 5674 - DNA, 23 bp, Artificial Sequence
  HLA-A targeting gRNA
ctaactggttatgcccacggagg

SEQ ID NO: 5675 - DNA, 23 bp, Artificial Sequence
  HLA-A targeting gRNA
ctaactggttatgcccgcggagg

SEQ ID NO: 5676 - DNA, 23 bp, Artificial Sequence
  HLA-A targeting gRNA
ctaagccgcggtgtccgccgcgg

SEQ ID NO: 5677 - DNA, 23 bp, Artificial Sequence
  HLA-A targeting gRNA
ctaccgggagggcctgtgcgtgg

SEQ ID NO: 5678 - DNA, 23 bp, Artificial Sequence
  HLA-A targeting gRNA
ctacctggaggacacgtgcgtgg

SEQ ID NO: 5679 - DNA, 23 bp, Artificial Sequence
  HLA-A targeting gRNA
ctacctggagggaacgtgcgtgg

SEQ ID NO: 5680 - DNA, 23 bp, Artificial Sequence
  HLA-A targeting gRNA
ctacctggagggcaagtgcgtgg

SEQ ID NO: 5681 - DNA, 23 bp, Artificial Sequence
  HLA-A targeting gRNA
ctacctggagggcacgcgcgtgg

SEQ ID NO: 5682 - DNA, 23 bp, Artificial Sequence
  HLA-A targeting gRNA
ctacctggagggcacgtacgtgg

SEQ ID NO: 5683 - DNA, 23 bp, Artificial Sequence
  HLA-A targeting gRNA
ctacctggagggcacgtgagtgg

SEQ ID NO: 5684 - DNA, 23 bp, Artificial Sequence
  HLA-A targeting gRNA
ctacctggagggcacgtgcatgg

SEQ ID NO: 5685 - DNA, 23 bp, Artificial Sequence
  HLA-A targeting gRNA
ctacctggagggcacgtgtgtgg

SEQ ID NO: 5686 - DNA, 23 bp, Artificial Sequence
  HLA-A targeting gRNA
ctacctggagggcacgttcgtgg

SEQ ID NO: 5687 - DNA, 23 bp, Artificial Sequence
  HLA-A targeting gRNA
ctacctggagggcctgtgcgagg

SEQ ID NO: 5688 - DNA, 23 bp, Artificial Sequence
  HLA-A targeting gRNA
ctacctggagggcctgtgtgtgg

SEQ ID NO: 5689 - DNA, 23 bp, Artificial Sequence
  HLA-A targeting gRNA
ctacctggagggtctgtgcgtgg

SEQ ID NO: 5690 - DNA, 23 bp, Artificial Sequence
  HLA-A targeting gRNA
ctacctggtgggcacgtgcgtgg

SEQ ID NO: 5691 - DNA, 23 bp, Artificial Sequence
  HLA-A targeting gRNA
ctacgccgcgagtccaagagggg

SEQ ID NO: 5692 - DNA, 23 bp, Artificial Sequence
  HLA-A targeting gRNA
ctacggagatcacactgacctgg

SEQ ID NO: 5693 - DNA, 23 bp, Artificial Sequence
  HLA-A targeting gRNA
ctacgtggacgacacgctgttgg

SEQ ID NO: 5694 - DNA, 23 bp, Artificial Sequence
  HLA-A targeting gRNA
ctagacacccgacacccaatggg

SEQ ID NO: 5695 - DNA, 23 bp, Artificial Sequence
  HLA-A targeting gRNA
ctagagactcgaggagacccggg

SEQ ID NO: 5696 - DNA, 23 bp, Artificial Sequence
  HLA-A targeting gRNA
ctagagtgggcgggggggcgggg

SEQ ID NO: 5697 - DNA, 23 bp, Artificial Sequence
  HLA-A targeting gRNA
ctagagtgggcggggggggcggg

SEQ ID NO: 5698 - DNA, 23 bp, Artificial Sequence
  HLA-A targeting gRNA
ctagagtgggcgggggggggtgg

SEQ ID NO: 5699 - DNA, 23 bp, Artificial Sequence
  HLA-A targeting gRNA
ctagagtgggcggggggggtggg

SEQ ID NO: 5700 - DNA, 23 bp, Artificial Sequence
  HLA-A targeting gRNA
ctagagtgggtgggggtggcggg

SEQ ID NO: 5701 - DNA, 23 bp, Artificial Sequence
  HLA-A targeting gRNA
ctagatatccaatacccaatggg

SEQ ID NO: 5702 - DNA, 23 bp, Artificial Sequence
  HLA-A targeting gRNA
ctagatatccgacacccaatggg

SEQ ID NO: 5703 - DNA, 23 bp, Artificial Sequence
  HLA-A targeting gRNA
ctaggacaaccaggacagccagg

SEQ ID NO: 5704 - DNA, 23 bp, Artificial Sequence
  HLA-A targeting gRNA
ctaggacagccaggacagccagg

SEQ ID NO: 5705 - DNA, 23 bp, Artificial Sequence
  HLA-A targeting gRNA
ctaggacagctaggacaaccagg

SEQ ID NO: 5706 - DNA, 23 bp, Artificial Sequence
  HLA-A targeting gRNA
ctaggacagctaggacagccagg

SEQ ID NO: 5707 - DNA, 23 bp, Artificial Sequence
  HLA-A targeting gRNA
ctagggctctctccggtcgaggg

SEQ ID NO: 5708 - DNA, 23 bp, Artificial Sequence
  HLA-A targeting gRNA
ctatctcctgtagatctcccggg

SEQ ID NO: 5709 - DNA, 23 bp, Artificial Sequence
  HLA-A targeting gRNA
ctatgtcccggcccggccgcggg

SEQ ID NO: 5710 - DNA, 23 bp, Artificial Sequence
  HLA-A targeting gRNA
ctatgtcgggtccttcttccagg

SEQ ID NO: 5711 - DNA, 23 bp, Artificial Sequence
  HLA-A targeting gRNA
ctcaaggagtgggagcctggggg

SEQ ID NO: 5712 - DNA, 23 bp, Artificial Sequence
  HLA-A targeting gRNA
ctcacactcaatgtgtctgaagg

SEQ ID NO: 5713 - DNA, 23 bp, Artificial Sequence
  HLA-A targeting gRNA
ctcacgctcaatgtgtttaaagg

SEQ ID NO: 5714 - DNA, 23 bp, Artificial Sequence
  HLA-A targeting gRNA
ctcacgctcaatgtgtttgaagg

SEQ ID NO: 5715 - DNA, 23 bp, Artificial Sequence
  HLA-A targeting gRNA
ctcagatcacccagcccaagtgg

SEQ ID NO: 5716 - DNA, 23 bp, Artificial Sequence
  HLA-A targeting gRNA
ctcagatcacccagcgcaaatgg

SEQ ID NO: 5717 - DNA, 23 bp, Artificial Sequence
  HLA-A targeting gRNA
ctcagatcacccagcgtaagtgg

SEQ ID NO: 5718 - DNA, 23 bp, Artificial Sequence
  HLA-A targeting gRNA
ctcagatcacccagctcaagtgg

SEQ ID NO: 5719 - DNA, 23 bp, Artificial Sequence
  HLA-A targeting gRNA
ctcagatcatccagcgcaagtgg

SEQ ID NO: 5720 - DNA, 23 bp, Artificial Sequence
  HLA-A targeting gRNA
ctcagatctcccagcgcaagtgg

SEQ ID NO: 5721 - DNA, 23 bp, Artificial Sequence
  HLA-A targeting gRNA
ctcagcccctcctcacccccagg

SEQ ID NO: 5722 - DNA, 23 bp, Artificial Sequence
  HLA-A targeting gRNA
ctcagcccctcctcgcccccagg

SEQ ID NO: 5723 - DNA, 23 bp, Artificial Sequence
  HLA-A targeting gRNA
ctcagcccctcctcgctcccagg

SEQ ID NO: 5724 - DNA, 23 bp, Artificial Sequence
  HLA-A targeting gRNA
ctcagcccctcctctcccccagg

SEQ ID NO: 5725 - DNA, 23 bp, Artificial Sequence
  HLA-A targeting gRNA
ctcagcccctcctggcccccagg

SEQ ID NO: 5726 - DNA, 23 bp, Artificial Sequence
  HLA-A targeting gRNA
ctcagccctgacccagctgaagg

SEQ ID NO: 5727 - DNA, 23 bp, Artificial Sequence
  HLA-A targeting gRNA
ctcagccctgacccggctgaagg

SEQ ID NO: 5728 - DNA, 23 bp, Artificial Sequence
  HLA-A targeting gRNA
ctcagccctgacctggctgaagg

SEQ ID NO: 5729 - DNA, 23 bp, Artificial Sequence
  HLA-A targeting gRNA
ctcagctcctcctcgcccccagg

SEQ ID NO: 5730 - DNA, 23 bp, Artificial Sequence
  HLA-A targeting gRNA
ctcaggagacgtgggacaggagg

SEQ ID NO: 5731 - DNA, 23 bp, Artificial Sequence
  HLA-A targeting gRNA
ctcaggctgcatgtaagtgatgg

SEQ ID NO: 5732 - DNA, 23 bp, Artificial Sequence
  HLA-A targeting gRNA
ctcaggctgcgtgtaaatgatgg

SEQ ID NO: 5733 - DNA, 23 bp, Artificial Sequence
  HLA-A targeting gRNA
ctcaggctgcgtgtaagtgatgg

SEQ ID NO: 5734 - DNA, 23 bp, Artificial Sequence
  HLA-A targeting gRNA
ctcaggctgcgtgtaagtggtgg

SEQ ID NO: 5735 - DNA, 23 bp, Artificial Sequence
  HLA-A targeting gRNA
ctcagggaaaccagaagtcctgg

SEQ ID NO: 5736 - DNA, 23 bp, Artificial Sequence
  HLA-A targeting gRNA
ctcagggaaagcagaagtcctgg

SEQ ID NO: 5737 - DNA, 23 bp, Artificial Sequence
  HLA-A targeting gRNA
ctcagggtctcaggctccaaggg

SEQ ID NO: 5738 - DNA, 23 bp, Artificial Sequence
  HLA-A targeting gRNA
ctcagggtctcaggctccgaggg

SEQ ID NO: 5739 - DNA, 23 bp, Artificial Sequence
  HLA-A targeting gRNA
ctcaggtagggaaggggtgaggg

SEQ ID NO: 5740 - DNA, 23 bp, Artificial Sequence
  HLA-A targeting gRNA
ctcaggttgcgtgtaagtgatgg

SEQ ID NO: 5741 - DNA, 23 bp, Artificial Sequence
  HLA-A targeting gRNA
ctcatactcaatgtgtctgaagg

SEQ ID NO: 5742 - DNA, 23 bp, Artificial Sequence
  HLA-A targeting gRNA
ctcatcccattctccattcaagg

SEQ ID NO: 5743 - DNA, 23 bp, Artificial Sequence
  HLA-A targeting gRNA
ctcatcccattttccattcaagg

SEQ ID NO: 5744 - DNA, 23 bp, Artificial Sequence
  HLA-A targeting gRNA
ctcatcccccacggacggcccgg

SEQ ID NO: 5745 - DNA, 23 bp, Artificial Sequence
  HLA-A targeting gRNA
ctcatcttcccttcctttcccgg

SEQ ID NO: 5746 - DNA, 23 bp, Artificial Sequence
  HLA-A targeting gRNA
ctcatgaagtgggagcctggggg

SEQ ID NO: 5747 - DNA, 23 bp, Artificial Sequence
  HLA-A targeting gRNA
ctcatgccattctccattcaagg

SEQ ID NO: 5748 - DNA, 23 bp, Artificial Sequence
  HLA-A targeting gRNA
ctcatgctcaatgtgtttgaagg

SEQ ID NO: 5749 - DNA, 23 bp, Artificial Sequence
  HLA-A targeting gRNA
ctcatggagagggagcctggggg

SEQ ID NO: 5750 - DNA, 23 bp, Artificial Sequence
  HLA-A targeting gRNA
ctcatggagtggaagcctggggg

SEQ ID NO: 5751 - DNA, 23 bp, Artificial Sequence
  HLA-A targeting gRNA
ctcatggagtgggaacctggggg

SEQ ID NO: 5752 - DNA, 23 bp, Artificial Sequence
  HLA-A targeting gRNA
ctcatggagtgggagactggggg

SEQ ID NO: 5753 - DNA, 23 bp, Artificial Sequence
  HLA-A targeting gRNA
ctccacaagctcggtgtcctggg

SEQ ID NO: 5754 - DNA, 23 bp, Artificial Sequence
  HLA-A targeting gRNA
ctccacagggtagaaacccaggg

SEQ ID NO: 5755 - DNA, 23 bp, Artificial Sequence
  HLA-A targeting gRNA
ctccacagggtagaagcccaggg

SEQ ID NO: 5756 - DNA, 23 bp, Artificial Sequence
  HLA-A targeting gRNA
ctcccagcgcaagtgggaggcgg

SEQ ID NO: 5757 - DNA, 23 bp, Artificial Sequence
  HLA-A targeting gRNA
ctcccagcgcaagttggaggcgg

SEQ ID NO: 5758 - DNA, 23 bp, Artificial Sequence
  HLA-A targeting gRNA
ctccccagacgccgagatgcggg

SEQ ID NO: 5759 - DNA, 23 bp, Artificial Sequence
  HLA-A targeting gRNA
ctccccagaggccgagatgcggg

SEQ ID NO: 5760 - DNA, 23 bp, Artificial Sequence
  HLA-A targeting gRNA
ctccccagggtagaagcccaggg

SEQ ID NO: 5761 - DNA, 23 bp, Artificial Sequence
  HLA-A targeting gRNA
ctcccgagagcagcaggaggagg

SEQ ID NO: 5762 - DNA, 23 bp, Artificial Sequence
  HLA-A targeting gRNA
ctcccgagagcagcaggatgagg

SEQ ID NO: 5763 - DNA, 23 bp, Artificial Sequence
  HLA-A targeting gRNA
ctcccgtagatctcccggcatgg

SEQ ID NO: 5764 - DNA, 23 bp, Artificial Sequence
  HLA-A targeting gRNA
ctcccgtagatctcccgggatgg

SEQ ID NO: 5765 - DNA, 23 bp, Artificial Sequence
  HLA-A targeting gRNA
ctccctccttttccacctgtggg

SEQ ID NO: 5766 - DNA, 23 bp, Artificial Sequence
  HLA-A targeting gRNA
ctccgatgaccacaactgctagg

SEQ ID NO: 5767 - DNA, 23 bp, Artificial Sequence
  HLA-A targeting gRNA
ctccgcagacacctgaagaatgg

SEQ ID NO: 5768 - DNA, 23 bp, Artificial Sequence
  HLA-A targeting gRNA
ctccgcagatacctgaagaaagg

SEQ ID NO: 5769 - DNA, 23 bp, Artificial Sequence
  HLA-A targeting gRNA
ctccgcagatacctgaagaatgg

SEQ ID NO: 5770 - DNA, 23 bp, Artificial Sequence
  HLA-A targeting gRNA
ctccgcagatacctggagaaagg

SEQ ID NO: 5771 - DNA, 23 bp, Artificial Sequence
  HLA-A targeting gRNA
ctccgcagatacctggagaatgg

SEQ ID NO: 5772 - DNA, 23 bp, Artificial Sequence
  HLA-A targeting gRNA
ctccgcagatacctggggaacgg

SEQ ID NO: 5773 - DNA, 23 bp, Artificial Sequence
  HLA-A targeting gRNA
ctccgcagatatctggagaacgg

SEQ ID NO: 5774 - DNA, 23 bp, Artificial Sequence
  HLA-A targeting gRNA
ctccgcagggtagaaacccaggg

SEQ ID NO: 5775 - DNA, 23 bp, Artificial Sequence
  HLA-A targeting gRNA
ctccgcagggtagaagcacaggg

SEQ ID NO: 5776 - DNA, 23 bp, Artificial Sequence
  HLA-A targeting gRNA
ctccgcagggtagaagcccatgg

SEQ ID NO: 5777 - DNA, 23 bp, Artificial Sequence
  HLA-A targeting gRNA
ctccgcggatacctggagaacgg

SEQ ID NO: 5778 - DNA, 23 bp, Artificial Sequence
  HLA-A targeting gRNA
ctccggatgatgtgagaccctgg

SEQ ID NO: 5779 - DNA, 23 bp, Artificial Sequence
  HLA-A targeting gRNA
ctccggccgagggtctgggcggg

SEQ ID NO: 5780 - DNA, 23 bp, Artificial Sequence
  HLA-A targeting gRNA
ctccggtcgagggtctgggcggg

SEQ ID NO: 5781 - DNA, 23 bp, Artificial Sequence
  HLA-A targeting gRNA
ctccgtagggtagaagcccaggg

SEQ ID NO: 5782 - DNA, 23 bp, Artificial Sequence
  HLA-A targeting gRNA
ctcctaccggcgcggctccccgg

SEQ ID NO: 5783 - DNA, 23 bp, Artificial Sequence
  HLA-A targeting gRNA
ctcctagtcttggacccaaaagg

SEQ ID NO: 5784 - DNA, 23 bp, Artificial Sequence
  HLA-A targeting gRNA
ctcctatagatcgcccgggatgg

SEQ ID NO: 5785 - DNA, 23 bp, Artificial Sequence
  HLA-A targeting gRNA
ctcctatagatctcccgggatgg

SEQ ID NO: 5786 - DNA, 23 bp, Artificial Sequence
  HLA-A targeting gRNA
ctcctataggtcgccggggatgg

SEQ ID NO: 5787 - DNA, 23 bp, Artificial Sequence
  HLA-A targeting gRNA
ctcctcacattaggctaacaggg

SEQ ID NO: 5788 - DNA, 23 bp, Artificial Sequence
  HLA-A targeting gRNA
ctcctcacattatgctaacaggg

SEQ ID NO: 5789 - DNA, 23 bp, Artificial Sequence
  HLA-A targeting gRNA
ctcctcagacaccgagatgcggg

SEQ ID NO: 5790 - DNA, 23 bp, Artificial Sequence
  HLA-A targeting gRNA
ctcctcagacgccaagatgctgg

SEQ ID NO: 5791 - DNA, 23 bp, Artificial Sequence
  HLA-A targeting gRNA
ctcctcagacgccgagatgcggg

SEQ ID NO: 5792 - DNA, 23 bp, Artificial Sequence
  HLA-A targeting gRNA
ctcctcagacgccgagatgctgg

SEQ ID NO: 5793 - DNA, 23 bp, Artificial Sequence
  HLA-A targeting gRNA
ctcctcccagtcccctcataggg

SEQ ID NO: 5794 - DNA, 23 bp, Artificial Sequence
  HLA-A targeting gRNA
ctcctcccggcgcggctccccgg

SEQ ID NO: 5795 - DNA, 23 bp, Artificial Sequence
  HLA-A targeting gRNA
ctcctccctgcgccgctccccgg

SEQ ID NO: 5796 - DNA, 23 bp, Artificial Sequence
  HLA-A targeting gRNA
ctcctccctgcgcggctccccgg

SEQ ID NO: 5797 - DNA, 23 bp, Artificial Sequence
  HLA-A targeting gRNA
ctcctccctgcgcggcttcccgg

SEQ ID NO: 5798 - DNA, 23 bp, Artificial Sequence
  HLA-A targeting gRNA
ctcctccctgtcccctcacaggg

SEQ ID NO: 5799 - DNA, 23 bp, Artificial Sequence
  HLA-A targeting gRNA
ctcctcctgctgctctcgggagg

SEQ ID NO: 5800 - DNA, 23 bp, Artificial Sequence
  HLA-A targeting gRNA
ctcctcgtcttggaaccaaaagg

SEQ ID NO: 5801 - DNA, 23 bp, Artificial Sequence
  HLA-A targeting gRNA
ctcctcgtcttggacccaaaagg

SEQ ID NO: 5802 - DNA, 23 bp, Artificial Sequence
  HLA-A targeting gRNA
ctcctcgtggaaggccatcccgg

SEQ ID NO: 5803 - DNA, 23 bp, Artificial Sequence
  HLA-A targeting gRNA
ctcctcgtgggaggccatcccgg

SEQ ID NO: 5804 - DNA, 23 bp, Artificial Sequence
  HLA-A targeting gRNA
ctcctcgtgggaggccatgccgg

SEQ ID NO: 5805 - DNA, 23 bp, Artificial Sequence
  HLA-A targeting gRNA
ctcctggaccgccgcggacaagg

SEQ ID NO: 5806 - DNA, 23 bp, Artificial Sequence
  HLA-A targeting gRNA
ctcctggaccgccgcggacacgg

SEQ ID NO: 5807 - DNA, 23 bp, Artificial Sequence
  HLA-A targeting gRNA
ctcctggaccgcggcggacacgg

SEQ ID NO: 5808 - DNA, 23 bp, Artificial Sequence
  HLA-A targeting gRNA
ctcctggaccgctgcggacacgg

SEQ ID NO: 5809 - DNA, 23 bp, Artificial Sequence
  HLA-A targeting gRNA
ctcctggactgccgcggacacgg

SEQ ID NO: 5810 - DNA, 23 bp, Artificial Sequence
  HLA-A targeting gRNA
ctcctggattgccgcggacacgg

SEQ ID NO: 5811 - DNA, 23 bp, Artificial Sequence
  HLA-A targeting gRNA
ctcctgtagatctcccgggatgg

SEQ ID NO: 5812 - DNA, 23 bp, Artificial Sequence
  HLA-A targeting gRNA
ctcctgtccaacgtctcctgcgg

SEQ ID NO: 5813 - DNA, 23 bp, Artificial Sequence
  HLA-A targeting gRNA
ctcctgtcccacgtctcctgagg

SEQ ID NO: 5814 - DNA, 23 bp, Artificial Sequence
  HLA-A targeting gRNA
ctcctgtcccacgtctcctgcgg

SEQ ID NO: 5815 - DNA, 23 bp, Artificial Sequence
  HLA-A targeting gRNA
ctcctgtcccacgtctcctgtgg

SEQ ID NO: 5816 - DNA, 23 bp, Artificial Sequence
  HLA-A targeting gRNA
ctcgacgggcgcctcctccgcgg

SEQ ID NO: 5817 - DNA, 23 bp, Artificial Sequence
  HLA-A targeting gRNA
ctcgcacaggccctccaggtagg

SEQ ID NO: 5818 - DNA, 23 bp, Artificial Sequence
  HLA-A targeting gRNA
ctcggggaggatctcagaccggg

SEQ ID NO: 5819 - DNA, 23 bp, Artificial Sequence
  HLA-A targeting gRNA
ctcgggggacgggctgaccacgg

SEQ ID NO: 5820 - DNA, 23 bp, Artificial Sequence
  HLA-A targeting gRNA
ctcggggtggatctcagacccgg

SEQ ID NO: 5821 - DNA, 23 bp, Artificial Sequence
  HLA-A targeting gRNA
ctcggggtggatctcagaccggg

SEQ ID NO: 5822 - DNA, 23 bp, Artificial Sequence
  HLA-A targeting gRNA
ctcggggtggatctcagacgggg

SEQ ID NO: 5823 - DNA, 23 bp, Artificial Sequence
  HLA-A targeting gRNA
ctctagaacccgacacccaatgg

SEQ ID NO: 5824 - DNA, 23 bp, Artificial Sequence
  HLA-A targeting gRNA
ctctagaatccgacacccaatgg

SEQ ID NO: 5825 - DNA, 23 bp, Artificial Sequence
  HLA-A targeting gRNA
ctctcaactgctccgcctcacgg

SEQ ID NO: 5826 - DNA, 23 bp, Artificial Sequence
  HLA-A targeting gRNA
ctctcagctgctccgccacacgg

SEQ ID NO: 5827 - DNA, 23 bp, Artificial Sequence
  HLA-A targeting gRNA
ctctcagctgctccgccacccgg

SEQ ID NO: 5828 - DNA, 23 bp, Artificial Sequence
  HLA-A targeting gRNA
ctctcagctgctccgccccacgg

SEQ ID NO: 5829 - DNA, 23 bp, Artificial Sequence
  HLA-A targeting gRNA
ctctcagctgctccgccgcacgg

SEQ ID NO: 5830 - DNA, 23 bp, Artificial Sequence
  HLA-A targeting gRNA
ctctcagctgctccgccgtacgg

SEQ ID NO: 5831 - DNA, 23 bp, Artificial Sequence
  HLA-A targeting gRNA
ctctcagctgctccgcctcacgg

SEQ ID NO: 5832 - DNA, 23 bp, Artificial Sequence
  HLA-A targeting gRNA
ctctcagctgctcggccgcacgg

SEQ ID NO: 5833 - DNA, 23 bp, Artificial Sequence
  HLA-A targeting gRNA
ctctccactgctccgccgcacgg

SEQ ID NO: 5834 - DNA, 23 bp, Artificial Sequence
  HLA-A targeting gRNA
ctctccactgctccgcctcacgg

SEQ ID NO: 5835 - DNA, 23 bp, Artificial Sequence
  HLA-A targeting gRNA
ctctccccatcccccacggacgg

SEQ ID NO: 5836 - DNA, 23 bp, Artificial Sequence
  HLA-A targeting gRNA
ctctccgctgctccgccacacgg

SEQ ID NO: 5837 - DNA, 23 bp, Artificial Sequence
  HLA-A targeting gRNA
ctctccgctgctccgcctcacgg

SEQ ID NO: 5838 - DNA, 23 bp, Artificial Sequence
  HLA-A targeting gRNA
ctctccgtcagtctgtgcctggg

SEQ ID NO: 5839 - DNA, 23 bp, Artificial Sequence
  HLA-A targeting gRNA
ctctccgttgctccgcctcacgg

SEQ ID NO: 5840 - DNA, 23 bp, Artificial Sequence
  HLA-A targeting gRNA
ctctcgccggtcgagggtctggg

SEQ ID NO: 5841 - DNA, 23 bp, Artificial Sequence
  HLA-A targeting gRNA
ctctcgccggtcgagggtttggg

SEQ ID NO: 5842 - DNA, 23 bp, Artificial Sequence
  HLA-A targeting gRNA
ctctcggtaagtctgcgcggagg

SEQ ID NO: 5843 - DNA, 23 bp, Artificial Sequence
  HLA-A targeting gRNA
ctctcggtaagtctgtgccttgg

SEQ ID NO: 5844 - DNA, 23 bp, Artificial Sequence
  HLA-A targeting gRNA
ctctcggtaagtctgtgtgttgg

SEQ ID NO: 5845 - DNA, 23 bp, Artificial Sequence
  HLA-A targeting gRNA
ctctcggtacgtctgtgtgttgg

SEQ ID NO: 5846 - DNA, 23 bp, Artificial Sequence
  HLA-A targeting gRNA
ctctcggtcagcctgtgtgttgg

SEQ ID NO: 5847 - DNA, 23 bp, Artificial Sequence
  HLA-A targeting gRNA
ctctcggtcagtctgtgcctggg

SEQ ID NO: 5848 - DNA, 23 bp, Artificial Sequence
  HLA-A targeting gRNA
ctctcggtcagtctgtgccttgg

SEQ ID NO: 5849 - DNA, 23 bp, Artificial Sequence
  HLA-A targeting gRNA
ctctcggtcagtctgtgtgttgg

SEQ ID NO: 5850 - DNA, 23 bp, Artificial Sequence
  HLA-A targeting gRNA
ctctcgttaagtctgtgtgttgg

SEQ ID NO: 5851 - DNA, 23 bp, Artificial Sequence
  HLA-A targeting gRNA
ctctctccggccgagggtctggg

SEQ ID NO: 5852 - DNA, 23 bp, Artificial Sequence
  HLA-A targeting gRNA
ctctctccggtcgagggtctggg

SEQ ID NO: 5853 - DNA, 23 bp, Artificial Sequence
  HLA-A targeting gRNA
ctctctgcggtcgaggttctggg

SEQ ID NO: 5854 - DNA, 23 bp, Artificial Sequence
  HLA-A targeting gRNA
ctctctgctgctccgccgcacgg

SEQ ID NO: 5855 - DNA, 23 bp, Artificial Sequence
  HLA-A targeting gRNA
ctctgcactgctccgcctcacgg

SEQ ID NO: 5856 - DNA, 23 bp, Artificial Sequence
  HLA-A targeting gRNA
ctctgccaagtgtgagaccctgg

SEQ ID NO: 5857 - DNA, 23 bp, Artificial Sequence
  HLA-A targeting gRNA
ctctggaaggtgtgagaccctgg

SEQ ID NO: 5858 - DNA, 23 bp, Artificial Sequence
  HLA-A targeting gRNA
ctctggagagtgtgagaccctgg

SEQ ID NO: 5859 - DNA, 23 bp, Artificial Sequence
  HLA-A targeting gRNA
ctctggaggatgtgagaccctgg

SEQ ID NO: 5860 - DNA, 23 bp, Artificial Sequence
  HLA-A targeting gRNA
ctctggagggtatgagaccctgg

SEQ ID NO: 5861 - DNA, 23 bp, Artificial Sequence
  HLA-A targeting gRNA
ctctggagggtgtgagaccctgg

SEQ ID NO: 5862 - DNA, 23 bp, Artificial Sequence
  HLA-A targeting gRNA
ctctggatgatgtgagaccctgg

SEQ ID NO: 5863 - DNA, 23 bp, Artificial Sequence
  HLA-A targeting gRNA
ctctggatggtgtgagaccctgg

SEQ ID NO: 5864 - DNA, 23 bp, Artificial Sequence
  HLA-A targeting gRNA
ctctggcgggtgtgagaccctgg

SEQ ID NO: 5865 - DNA, 23 bp, Artificial Sequence
  HLA-A targeting gRNA
ctctggggagaatgtgagtccgg

SEQ ID NO: 5866 - DNA, 23 bp, Artificial Sequence
  HLA-A targeting gRNA
ctctgggtctcaagctcccaggg

SEQ ID NO: 5867 - DNA, 23 bp, Artificial Sequence
  HLA-A targeting gRNA
ctctgtcctgctccgccacacgg

SEQ ID NO: 5868 - DNA, 23 bp, Artificial Sequence
  HLA-A targeting gRNA
ctctgtcctgctccgccatacgg

SEQ ID NO: 5869 - DNA, 23 bp, Artificial Sequence
  HLA-A targeting gRNA
ctctgtcctgctccgccgcacgg

SEQ ID NO: 5870 - DNA, 23 bp, Artificial Sequence
  HLA-A targeting gRNA
ctcttagctgctccgccacacgg

SEQ ID NO: 5871 - DNA, 23 bp, Artificial Sequence
  HLA-A targeting gRNA
ctcttctctctagacaattaagg

SEQ ID NO: 5872 - DNA, 23 bp, Artificial Sequence
  HLA-A targeting gRNA
ctcttgaagtcacaaaggaaagg

SEQ ID NO: 5873 - DNA, 23 bp, Artificial Sequence
  HLA-A targeting gRNA
ctcttgaagtcacaaaggagagg

SEQ ID NO: 5874 - DNA, 23 bp, Artificial Sequence
  HLA-A targeting gRNA
ctcttgaagtcacaaaggggagg

SEQ ID NO: 5875 - DNA, 23 bp, Artificial Sequence
  HLA-A targeting gRNA
ctcttgggtccaagactaggagg

SEQ ID NO: 5876 - DNA, 23 bp, Artificial Sequence
  HLA-A targeting gRNA
ctcttgtcccacatctcctgcgg

SEQ ID NO: 5877 - DNA, 23 bp, Artificial Sequence
  HLA-A targeting gRNA
ctcttgtcccacatctcctgtgg

SEQ ID NO: 5878 - DNA, 23 bp, Artificial Sequence
  HLA-A targeting gRNA
ctgaaaacgaaaccgggtaaagg

SEQ ID NO: 5879 - DNA, 23 bp, Artificial Sequence
  HLA-A targeting gRNA
ctgaagcaactgccctcctaagg

SEQ ID NO: 5880 - DNA, 23 bp, Artificial Sequence
  HLA-A targeting gRNA
ctgaagggctccaggacttctgg

SEQ ID NO: 5881 - DNA, 23 bp, Artificial Sequence
  HLA-A targeting gRNA
ctgaccacgggggcggggccagg

SEQ ID NO: 5882 - DNA, 23 bp, Artificial Sequence
  HLA-A targeting gRNA
ctgaccatgaggtcaccctgagg

SEQ ID NO: 5883 - DNA, 23 bp, Artificial Sequence
  HLA-A targeting gRNA
ctgaccgcgagggctgggccagg

SEQ ID NO: 5884 - DNA, 23 bp, Artificial Sequence
  HLA-A targeting gRNA
ctgaccgcggggccggggccagg

SEQ ID NO: 5885 - DNA, 23 bp, Artificial Sequence
  HLA-A targeting gRNA
ctgaccgcggggcctaggccagg

SEQ ID NO: 5886 - DNA, 23 bp, Artificial Sequence
  HLA-A targeting gRNA
ctgaccgcggggcctgggccagg

SEQ ID NO: 5887 - DNA, 23 bp, Artificial Sequence
  HLA-A targeting gRNA
ctgaccgcgggggcggggccagg

SEQ ID NO: 5888 - DNA, 23 bp, Artificial Sequence
  HLA-A targeting gRNA
ctgacctgagtggaggccgaagg

SEQ ID NO: 5889 - DNA, 23 bp, Artificial Sequence
  HLA-A targeting gRNA
ctgacctgagtggaggctgcagg

SEQ ID NO: 5890 - DNA, 23 bp, Artificial Sequence
  HLA-A targeting gRNA
ctgacgctcaatgtgtttgaagg

SEQ ID NO: 5891 - DNA, 23 bp, Artificial Sequence
  HLA-A targeting gRNA
ctgagaacggacaggacacctgg

SEQ ID NO: 5892 - DNA, 23 bp, Artificial Sequence
  HLA-A targeting gRNA
ctgagaatggacaggacacctgg

SEQ ID NO: 5893 - DNA, 23 bp, Artificial Sequence
  HLA-A targeting gRNA
ctgagaatggacgggacacctgg

SEQ ID NO: 5894 - DNA, 23 bp, Artificial Sequence
  HLA-A targeting gRNA
ctgagaatgggcaggacacctgg

SEQ ID NO: 5895 - DNA, 23 bp, Artificial Sequence
  HLA-A targeting gRNA
ctgagacagctgtcttgtgaggg

SEQ ID NO: 5896 - DNA, 23 bp, Artificial Sequence
  HLA-A targeting gRNA
ctgagccgccgtgtccgcagcgg

SEQ ID NO: 5897 - DNA, 23 bp, Artificial Sequence
  HLA-A targeting gRNA
ctgagccgccgtgtccgccgcgg

SEQ ID NO: 5898 - DNA, 23 bp, Artificial Sequence
  HLA-A targeting gRNA
ctgagccgccgtgtccgcggcgg

SEQ ID NO: 5899 - DNA, 23 bp, Artificial Sequence
  HLA-A targeting gRNA
ctgagccgccttgtccgcggcgg

SEQ ID NO: 5900 - DNA, 23 bp, Artificial Sequence
  HLA-A targeting gRNA
ctgagccgcggtatccgcggcgg

SEQ ID NO: 5901 - DNA, 23 bp, Artificial Sequence
  HLA-A targeting gRNA
ctgagccgcggtgtccgcagcgg

SEQ ID NO: 5902 - DNA, 23 bp, Artificial Sequence
  HLA-A targeting gRNA
ctgagccgcggtgtccgccgcgg

SEQ ID NO: 5903 - DNA, 23 bp, Artificial Sequence
  HLA-A targeting gRNA
ctgagccgcggtgtccgcggcgg

SEQ ID NO: 5904 - DNA, 23 bp, Artificial Sequence
  HLA-A targeting gRNA
ctgagccgctgtgtccccggcgg

SEQ ID NO: 5905 - DNA, 23 bp, Artificial Sequence
  HLA-A targeting gRNA
ctgagccgctgtgtccgcggcgg

SEQ ID NO: 5906 - DNA, 23 bp, Artificial Sequence
  HLA-A targeting gRNA
ctgagtccgggtgggtgactggg

SEQ ID NO: 5907 - DNA, 23 bp, Artificial Sequence
  HLA-A targeting gRNA
ctgagtccgggtgggtgcgtggg

SEQ ID NO: 5908 - DNA, 23 bp, Artificial Sequence
  HLA-A targeting gRNA
ctgagttttcttgtcccactggg

SEQ ID NO: 5909 - DNA, 23 bp, Artificial Sequence
  HLA-A targeting gRNA
ctgcaacgcgcgggtaccagggg

SEQ ID NO: 5910 - DNA, 23 bp, Artificial Sequence
  HLA-A targeting gRNA
ctgcacaaaagagtaagtgctgg

SEQ ID NO: 5911 - DNA, 23 bp, Artificial Sequence
  HLA-A targeting gRNA
ctgcacaaaagagtaagttctgg

SEQ ID NO: 5912 - DNA, 23 bp, Artificial Sequence
  HLA-A targeting gRNA
ctgcaccctgagatggagtaagg

SEQ ID NO: 5913 - DNA, 23 bp, Artificial Sequence
  HLA-A targeting gRNA
ctgcagagcgcgggtaccagggg

SEQ ID NO: 5914 - DNA, 23 bp, Artificial Sequence
  HLA-A targeting gRNA
ctgcagcacgcgggtaccagggg

SEQ ID NO: 5915 - DNA, 23 bp, Artificial Sequence
  HLA-A targeting gRNA
ctgcagcctccactcaggtcagg

SEQ ID NO: 5916 - DNA, 23 bp, Artificial Sequence
  HLA-A targeting gRNA
ctgcagcgcgcaggtaccagggg

SEQ ID NO: 5917 - DNA, 23 bp, Artificial Sequence
  HLA-A targeting gRNA
ctgcagcgcgcgggtaccaaggg

SEQ ID NO: 5918 - DNA, 23 bp, Artificial Sequence
  HLA-A targeting gRNA
ctgcatcccagtaatgaggcagg

SEQ ID NO: 5919 - DNA, 23 bp, Artificial Sequence
  HLA-A targeting gRNA
ctgcatgtaagtgatggcggtgg

SEQ ID NO: 5920 - DNA, 23 bp, Artificial Sequence
  HLA-A targeting gRNA
ctgccccacactcagtgtttggg

SEQ ID NO: 5921 - DNA, 23 bp, Artificial Sequence
  HLA-A targeting gRNA
ctgccccccagagcagcaggagg

SEQ ID NO: 5922 - DNA, 23 bp, Artificial Sequence
  HLA-A targeting gRNA
ctgccccctagagcagcaggagg

SEQ ID NO: 5923 - DNA, 23 bp, Artificial Sequence
  HLA-A targeting gRNA
ctgcctggagggcgagtgcgtgg

SEQ ID NO: 5924 - DNA, 23 bp, Artificial Sequence
  HLA-A targeting gRNA
ctgcggagatcacactgatctgg

SEQ ID NO: 5925 - DNA, 23 bp, Artificial Sequence
  HLA-A targeting gRNA
ctgcggtcgaggttctgggcggg

SEQ ID NO: 5926 - DNA, 23 bp, Artificial Sequence
  HLA-A targeting gRNA
ctgcgtccaggctggtgtctggg

SEQ ID NO: 5927 - DNA, 23 bp, Artificial Sequence
  HLA-A targeting gRNA
ctgcgtccaggctggtgtttggg

SEQ ID NO: 5928 - DNA, 23 bp, Artificial Sequence
  HLA-A targeting gRNA
ctgcgtccgggctggtgtctggg

SEQ ID NO: 5929 - DNA, 23 bp, Artificial Sequence
  HLA-A targeting gRNA
ctgcgtgtaaatgatggcggcgg

SEQ ID NO: 5930 - DNA, 23 bp, Artificial Sequence
  HLA-A targeting gRNA
ctgcgtgtaagtgatgccggtgg

SEQ ID NO: 5931 - DNA, 23 bp, Artificial Sequence
  HLA-A targeting gRNA
ctgcgtgtaagtgatggcagtgg

SEQ ID NO: 5932 - DNA, 23 bp, Artificial Sequence
  HLA-A targeting gRNA
ctgcgtgtaagtgatggcggcgg

SEQ ID NO: 5933 - DNA, 23 bp, Artificial Sequence
  HLA-A targeting gRNA
ctgcgtgtaagtgatggcggtgg

SEQ ID NO: 5934 - DNA, 23 bp, Artificial Sequence
  HLA-A targeting gRNA
ctgcgtgtaagtgatgggggcgg

SEQ ID NO: 5935 - DNA, 23 bp, Artificial Sequence
  HLA-A targeting gRNA
ctgcgtgtaagtgatgggggtgg

SEQ ID NO: 5936 - DNA, 23 bp, Artificial Sequence
  HLA-A targeting gRNA
ctgcgtgtaagtggtgggggtgg

SEQ ID NO: 5937 - DNA, 23 bp, Artificial Sequence
  HLA-A targeting gRNA
ctgctccacccacggcgcccggg

SEQ ID NO: 5938 - DNA, 23 bp, Artificial Sequence
  HLA-A targeting gRNA
ctgctctatccacggcgcccggg

SEQ ID NO: 5939 - DNA, 23 bp, Artificial Sequence
  HLA-A targeting gRNA
ctgctctatccatggcgcccagg

SEQ ID NO: 5940 - DNA, 23 bp, Artificial Sequence
  HLA-A targeting gRNA
ctgctctatccatggcgcccggg

SEQ ID NO: 5941 - DNA, 23 bp, Artificial Sequence
  HLA-A targeting gRNA
ctgctctatccatggctcccggg

SEQ ID NO: 5942 - DNA, 23 bp, Artificial Sequence
  HLA-A targeting gRNA
ctgctctctaggacaattaaggg

SEQ ID NO: 5943 - DNA, 23 bp, Artificial Sequence
  HLA-A targeting gRNA
ctgctgtctaggacaattaaggg

SEQ ID NO: 5944 - DNA, 23 bp, Artificial Sequence
  HLA-A targeting gRNA
ctgcttcccagtaatgaggcagg

SEQ ID NO: 5945 - DNA, 23 bp, Artificial Sequence
  HLA-A targeting gRNA
ctgcttcccagtaatgatgcagg

SEQ ID NO: 5946 - DNA, 23 bp, Artificial Sequence
  HLA-A targeting gRNA
ctggaagaaggacccgacacagg

SEQ ID NO: 5947 - DNA, 23 bp, Artificial Sequence
  HLA-A targeting gRNA
ctggaagaaggacccgacatagg

SEQ ID NO: 5948 - DNA, 23 bp, Artificial Sequence
  HLA-A targeting gRNA
ctggaagcaccatccacacatgg

SEQ ID NO: 5949 - DNA, 23 bp, Artificial Sequence
  HLA-A targeting gRNA
ctggaagcaccatccacacctgg

SEQ ID NO: 5950 - DNA, 23 bp, Artificial Sequence
  HLA-A targeting gRNA
ctggaagcaccatccacacgtgg

SEQ ID NO: 5951 - DNA, 23 bp, Artificial Sequence
  HLA-A targeting gRNA
ctggaccaactgccctcctaagg

SEQ ID NO: 5952 - DNA, 23 bp, Artificial Sequence
  HLA-A targeting gRNA
ctggaccaactgctctcctaagg

SEQ ID NO: 5953 - DNA, 23 bp, Artificial Sequence
  HLA-A targeting gRNA
ctggaccgccgcggacaaggcgg

SEQ ID NO: 5954 - DNA, 23 bp, Artificial Sequence
  HLA-A targeting gRNA
ctggaccgccgcggacacagcgg

SEQ ID NO: 5955 - DNA, 23 bp, Artificial Sequence
  HLA-A targeting gRNA
ctggaccgccgcggacaccgcgg

SEQ ID NO: 5956 - DNA, 23 bp, Artificial Sequence
  HLA-A targeting gRNA
ctggaccgccgcggacacggcgg

SEQ ID NO: 5957 - DNA, 23 bp, Artificial Sequence
  HLA-A targeting gRNA
ctggaccgccgcggataccgcgg

SEQ ID NO: 5958 - DNA, 23 bp, Artificial Sequence
  HLA-A targeting gRNA
ctggaccgccggggacacagcgg

SEQ ID NO: 5959 - DNA, 23 bp, Artificial Sequence
  HLA-A targeting gRNA
ctggaccgcggcggacaccgcgg

SEQ ID NO: 5960 - DNA, 23 bp, Artificial Sequence
  HLA-A targeting gRNA
ctggaccgcggcggacacggcgg

SEQ ID NO: 5961 - DNA, 23 bp, Artificial Sequence
  HLA-A targeting gRNA
ctggaccgctgcggacaccgcgg

SEQ ID NO: 5962 - DNA, 23 bp, Artificial Sequence
  HLA-A targeting gRNA
ctggaccgctgcggacacggcgg

SEQ ID NO: 5963 - DNA, 23 bp, Artificial Sequence
  HLA-A targeting gRNA
ctggactgccgcggacacggcgg

SEQ ID NO: 5964 - DNA, 23 bp, Artificial Sequence
  HLA-A targeting gRNA
ctggagcaactgccctcctaagg

SEQ ID NO: 5965 - DNA, 23 bp, Artificial Sequence
  HLA-A targeting gRNA
ctggagcccttcagcagggtcgg

SEQ ID NO: 5966 - DNA, 23 bp, Artificial Sequence
  HLA-A targeting gRNA
ctggagcgcgcgggtaccagggg

SEQ ID NO: 5967 - DNA, 23 bp, Artificial Sequence
  HLA-A targeting gRNA
ctggagcgcgctggtaccagggg

SEQ ID NO: 5968 - DNA, 23 bp, Artificial Sequence
  HLA-A targeting gRNA
ctggatagagcaggaggggccgg

SEQ ID NO: 5969 - DNA, 23 bp, Artificial Sequence
  HLA-A targeting gRNA
ctggatcgcggcggacaccgcgg

SEQ ID NO: 5970 - DNA, 23 bp, Artificial Sequence
  HLA-A targeting gRNA
ctggattgccgcggacacggcgg

SEQ ID NO: 5971 - DNA, 23 bp, Artificial Sequence
  HLA-A targeting gRNA
ctggccgcggggccggggccagg

SEQ ID NO: 5972 - DNA, 23 bp, Artificial Sequence
  HLA-A targeting gRNA
ctggcctggtctccacaagctgg

SEQ ID NO: 5973 - DNA, 23 bp, Artificial Sequence
  HLA-A targeting gRNA
ctggctgtcctagctgtcctagg

SEQ ID NO: 5974 - DNA, 23 bp, Artificial Sequence
  HLA-A targeting gRNA
ctgggaagcagcatccacacagg

SEQ ID NO: 5975 - DNA, 23 bp, Artificial Sequence
  HLA-A targeting gRNA
ctgggaagcagcatcctcacagg

SEQ ID NO: 5976 - DNA, 23 bp, Artificial Sequence
  HLA-A targeting gRNA
ctgggaagcagcatgcacacagg

SEQ ID NO: 5977 - DNA, 23 bp, Artificial Sequence
  HLA-A targeting gRNA
ctgggagctgaagtggtcggggg

SEQ ID NO: 5978 - DNA, 23 bp, Artificial Sequence
  HLA-A targeting gRNA
ctgggatgcagcatccacacagg

SEQ ID NO: 5979 - DNA, 23 bp, Artificial Sequence
  HLA-A targeting gRNA
ctgggcactgttgctgcctgggg

SEQ ID NO: 5980 - DNA, 23 bp, Artificial Sequence
  HLA-A targeting gRNA
ctgggcactgttgctggctgggg

SEQ ID NO: 5981 - DNA, 23 bp, Artificial Sequence
  HLA-A targeting gRNA
ctgggccagggtctcacacttgg

SEQ ID NO: 5982 - DNA, 23 bp, Artificial Sequence
  HLA-A targeting gRNA
ctgggccggtgagtgcgggtcgg

SEQ ID NO: 5983 - DNA, 23 bp, Artificial Sequence
  HLA-A targeting gRNA
ctgggcgccatggatagagcagg

SEQ ID NO: 5984 - DNA, 23 bp, Artificial Sequence
  HLA-A targeting gRNA
ctgggcggattccgcagcctcgg

SEQ ID NO: 5985 - DNA, 23 bp, Artificial Sequence
  HLA-A targeting gRNA
ctgggcgggtcccgcggcctcgg

SEQ ID NO: 5986 - DNA, 23 bp, Artificial Sequence
  HLA-A targeting gRNA
ctgggcgggtgagtgcgggtcgg

SEQ ID NO: 5987 - DNA, 23 bp, Artificial Sequence
  HLA-A targeting gRNA
ctgggcgggttccgcagcctcgg

SEQ ID NO: 5988 - DNA, 23 bp, Artificial Sequence
  HLA-A targeting gRNA
ctgggctgaccacgggggcgggg

SEQ ID NO: 5989 - DNA, 23 bp, Artificial Sequence
  HLA-A targeting gRNA
ctgggctgaccgcgagggctggg

SEQ ID NO: 5990 - DNA, 23 bp, Artificial Sequence
  HLA-A targeting gRNA
ctgggctgaccgcggggccgggg

SEQ ID NO: 5991 - DNA, 23 bp, Artificial Sequence
  HLA-A targeting gRNA
ctgggctgaccgcgggggcgggg

SEQ ID NO: 5992 - DNA, 23 bp, Artificial Sequence
  HLA-A targeting gRNA
ctggggagatcacactgacctgg

SEQ ID NO: 5993 - DNA, 23 bp, Artificial Sequence
  HLA-A targeting gRNA
ctggggagctgaagtggtcgggg

SEQ ID NO: 5994 - DNA, 23 bp, Artificial Sequence
  HLA-A targeting gRNA
ctggggagctgaagtggtctggg

SEQ ID NO: 5995 - DNA, 23 bp, Artificial Sequence
  HLA-A targeting gRNA
ctggggcggggctcgcgggacgg

SEQ ID NO: 5996 - DNA, 23 bp, Artificial Sequence
  HLA-A targeting gRNA
ctggggcggggctcgggggacgg

SEQ ID NO: 5997 - DNA, 23 bp, Artificial Sequence
  HLA-A targeting gRNA
ctggggcggggtggggcagaggg

SEQ ID NO: 5998 - DNA, 23 bp, Artificial Sequence
  HLA-A targeting gRNA
ctggggcggggttcgggggacgg

SEQ ID NO: 5999 - DNA, 23 bp, Artificial Sequence
  HLA-A targeting gRNA
ctggggctctcgccggtcgaggg

SEQ ID NO: 6000 - DNA, 23 bp, Artificial Sequence
  HLA-A targeting gRNA
ctggggctctctccggccgaggg

SEQ ID NO: 6001 - DNA, 23 bp, Artificial Sequence
  HLA-A targeting gRNA
ctggggctctctccggtcgaggg

SEQ ID NO: 6002 - DNA, 23 bp, Artificial Sequence
  HLA-A targeting gRNA
ctggggcttgaaaccccagtggg

SEQ ID NO: 6003 - DNA, 23 bp, Artificial Sequence
  HLA-A targeting gRNA
ctggggcttgaaacccccagtgg

SEQ ID NO: 6004 - DNA, 23 bp, Artificial Sequence
  HLA-A targeting gRNA
ctggggcttgaaactcccagtgg

SEQ ID NO: 6005 - DNA, 23 bp, Artificial Sequence
  HLA-A targeting gRNA
ctggggggggggggggcagaggg

SEQ ID NO: 6006 - DNA, 23 bp, Artificial Sequence
  HLA-A targeting gRNA
ctgggggtgggtggggcagaggg

SEQ ID NO: 6007 - DNA, 23 bp, Artificial Sequence
  HLA-A targeting gRNA
ctgggggtgggtggggcagtggg

SEQ ID NO: 6008 - DNA, 23 bp, Artificial Sequence
  HLA-A targeting gRNA
ctggggtaaggaggggaatgggg

SEQ ID NO: 6009 - DNA, 23 bp, Artificial Sequence
  HLA-A targeting gRNA
ctgggtcagggctgaggcttggg

SEQ ID NO: 6010 - DNA, 23 bp, Artificial Sequence
  HLA-A targeting gRNA
ctgggttttcttgtcccactggg

SEQ ID NO: 6011 - DNA, 23 bp, Artificial Sequence
  HLA-A targeting gRNA
ctgggttttcttgttccactggg

SEQ ID NO: 6012 - DNA, 23 bp, Artificial Sequence
  HLA-A targeting gRNA
ctgggttttgttgtcccactggg

SEQ ID NO: 6013 - DNA, 23 bp, Artificial Sequence
  HLA-A targeting gRNA
ctggtcacatgggtggtcctagg

SEQ ID NO: 6014 - DNA, 23 bp, Artificial Sequence
  HLA-A targeting gRNA
ctggtcatacccgcggaggaggg

SEQ ID NO: 6015 - DNA, 23 bp, Artificial Sequence
  HLA-A targeting gRNA
ctggtgagtgcggggtcggcagg

SEQ ID NO: 6016 - DNA, 23 bp, Artificial Sequence
  HLA-A targeting gRNA
ctggtgagtgcggggtcgggagg

SEQ ID NO: 6017 - DNA, 23 bp, Artificial Sequence
  HLA-A targeting gRNA
ctggttgtagtagcggagcaggg

SEQ ID NO: 6018 - DNA, 23 bp, Artificial Sequence
  HLA-A targeting gRNA
ctggttgtagtagcggagcgcgg

SEQ ID NO: 6019 - DNA, 23 bp, Artificial Sequence
  HLA-A targeting gRNA
ctggttgtcctagctgtcctagg

SEQ ID NO: 6020 - DNA, 23 bp, Artificial Sequence
  HLA-A targeting gRNA
ctggttgtcctagctgtccttgg

SEQ ID NO: 6021 - DNA, 23 bp, Artificial Sequence
  HLA-A targeting gRNA
ctgtaggacagctgcctgtgtgg

SEQ ID NO: 6022 - DNA, 23 bp, Artificial Sequence
  HLA-A targeting gRNA
ctgtgagtgcgaggttgggaggg

SEQ ID NO: 6023 - DNA, 23 bp, Artificial Sequence
  HLA-A targeting gRNA
ctgtgagtgcggggttaggaggg

SEQ ID NO: 6024 - DNA, 23 bp, Artificial Sequence
  HLA-A targeting gRNA
ctgtgagtgcggggttgggaggg

SEQ ID NO: 6025 - DNA, 23 bp, Artificial Sequence
  HLA-A targeting gRNA
ctgtgccccttccccacaccagg

SEQ ID NO: 6026 - DNA, 23 bp, Artificial Sequence
  HLA-A targeting gRNA
ctgtgccccttccccaccccagg

SEQ ID NO: 6027 - DNA, 23 bp, Artificial Sequence
  HLA-A targeting gRNA
ctgtgccccttccctaccccagg

SEQ ID NO: 6028 - DNA, 23 bp, Artificial Sequence
  HLA-A targeting gRNA
ctgtgtccaggctggcgtctggg

SEQ ID NO: 6029 - DNA, 23 bp, Artificial Sequence
  HLA-A targeting gRNA
ctgtgtcccggcccggccgcggg

SEQ ID NO: 6030 - DNA, 23 bp, Artificial Sequence
  HLA-A targeting gRNA
ctgtgtcccttccccaccccagg

SEQ ID NO: 6031 - DNA, 23 bp, Artificial Sequence
  HLA-A targeting gRNA
ctgtgtcgggtccttcttccagg

SEQ ID NO: 6032 - DNA, 23 bp, Artificial Sequence
  HLA-A targeting gRNA
ctgttccggtcccaatactccgg

SEQ ID NO: 6033 - DNA, 23 bp, Artificial Sequence
  HLA-A targeting gRNA
cttaattgtctagagagaagagg

SEQ ID NO: 6034 - DNA, 23 bp, Artificial Sequence
  HLA-A targeting gRNA
cttaccccagctcagggtgaggg

SEQ ID NO: 6035 - DNA, 23 bp, Artificial Sequence
  HLA-A targeting gRNA
cttactccatctcagggtgaggg

SEQ ID NO: 6036 - DNA, 23 bp, Artificial Sequence
  HLA-A targeting gRNA
cttactccatctcagggtgcagg

SEQ ID NO: 6037 - DNA, 23 bp, Artificial Sequence
  HLA-A targeting gRNA
cttagatcacccagcgcaagtgg

SEQ ID NO: 6038 - DNA, 23 bp, Artificial Sequence
  HLA-A targeting gRNA
cttaggagagcagttggtccagg

SEQ ID NO: 6039 - DNA, 23 bp, Artificial Sequence
  HLA-A targeting gRNA
cttaggagggcagttgcttcagg

SEQ ID NO: 6040 - DNA, 23 bp, Artificial Sequence
  HLA-A targeting gRNA
cttaggagggcagttggtccagg

SEQ ID NO: 6041 - DNA, 23 bp, Artificial Sequence
  HLA-A targeting gRNA
cttcaaacacattgagcatgagg

SEQ ID NO: 6042 - DNA, 23 bp, Artificial Sequence
  HLA-A targeting gRNA
cttcaaacacattgagcgtcagg

SEQ ID NO: 6043 - DNA, 23 bp, Artificial Sequence
  HLA-A targeting gRNA
cttcaaacacattgagcgtgagg

SEQ ID NO: 6044 - DNA, 23 bp, Artificial Sequence
  HLA-A targeting gRNA
cttcacaaaagagtaagtgctgg

SEQ ID NO: 6045 - DNA, 23 bp, Artificial Sequence
  HLA-A targeting gRNA
cttcacaacagagtaagtgctgg

SEQ ID NO: 6046 - DNA, 23 bp, Artificial Sequence
  HLA-A targeting gRNA
cttcagacacattgagtatgagg

SEQ ID NO: 6047 - DNA, 23 bp, Artificial Sequence
  HLA-A targeting gRNA
cttcagacacattgagtgtgagg

SEQ ID NO: 6048 - DNA, 23 bp, Artificial Sequence
  HLA-A targeting gRNA
cttcagccaggtcagggctgagg

SEQ ID NO: 6049 - DNA, 23 bp, Artificial Sequence
  HLA-A targeting gRNA
cttcagccgggtcagggctgagg

SEQ ID NO: 6050 - DNA, 23 bp, Artificial Sequence
  HLA-A targeting gRNA
cttcagctgggtcagggctgagg

SEQ ID NO: 6051 - DNA, 23 bp, Artificial Sequence
  HLA-A targeting gRNA
cttcatcaccgtgggctacgtgg

SEQ ID NO: 6052 - DNA, 23 bp, Artificial Sequence
  HLA-A targeting gRNA
cttcatcaccgtgggctatgtgg

SEQ ID NO: 6053 - DNA, 23 bp, Artificial Sequence
  HLA-A targeting gRNA
cttcatctcagtgcgctacgtgg

SEQ ID NO: 6054 - DNA, 23 bp, Artificial Sequence
  HLA-A targeting gRNA
cttcatctcagtgggctacgtgg

SEQ ID NO: 6055 - DNA, 23 bp, Artificial Sequence
  HLA-A targeting gRNA
cttcatctcagtgggttacgtgg

SEQ ID NO: 6056 - DNA, 23 bp, Artificial Sequence
  HLA-A targeting gRNA
cttcatggagtgggagcctgggg

SEQ ID NO: 6057 - DNA, 23 bp, Artificial Sequence
  HLA-A targeting gRNA
cttcatggagtgggaggctgggg

SEQ ID NO: 6058 - DNA, 23 bp, Artificial Sequence
  HLA-A targeting gRNA
cttcattaccgtgggctacgtgg

SEQ ID NO: 6059 - DNA, 23 bp, Artificial Sequence
  HLA-A targeting gRNA
cttcattgcagtgggctacgtgg

SEQ ID NO: 6060 - DNA, 23 bp, Artificial Sequence
  HLA-A targeting gRNA
cttccagaagtggacagctgtgg

SEQ ID NO: 6061 - DNA, 23 bp, Artificial Sequence
  HLA-A targeting gRNA
cttcccacaggtggaaaaggagg

SEQ ID NO: 6062 - DNA, 23 bp, Artificial Sequence
  HLA-A targeting gRNA
cttcccctgactcatgatgctgg

SEQ ID NO: 6063 - DNA, 23 bp, Artificial Sequence
  HLA-A targeting gRNA
cttcctcccagtcccctcacagg

SEQ ID NO: 6064 - DNA, 23 bp, Artificial Sequence
  HLA-A targeting gRNA
cttcctcccagtgccctcacagg

SEQ ID NO: 6065 - DNA, 23 bp, Artificial Sequence
  HLA-A targeting gRNA
cttcctcctacacatcatagcgg

SEQ ID NO: 6066 - DNA, 23 bp, Artificial Sequence
  HLA-A targeting gRNA
cttcctcctacacatcttagcgg

SEQ ID NO: 6067 - DNA, 23 bp, Artificial Sequence
  HLA-A targeting gRNA
cttcggcctccactcaggtcagg

SEQ ID NO: 6068 - DNA, 23 bp, Artificial Sequence
  HLA-A targeting gRNA
cttcggtaaggagggggatgagg

SEQ ID NO: 6069 - DNA, 23 bp, Artificial Sequence
  HLA-A targeting gRNA
cttcgtctcagtgggctacgtgg

SEQ ID NO: 6070 - DNA, 23 bp, Artificial Sequence
  HLA-A targeting gRNA
cttctctctaggacaattaaggg

SEQ ID NO: 6071 - DNA, 23 bp, Artificial Sequence
  HLA-A targeting gRNA
cttctcttgggtccaagactagg

SEQ ID NO: 6072 - DNA, 23 bp, Artificial Sequence
  HLA-A targeting gRNA
cttcttctcccaacctatgtcgg

SEQ ID NO: 6073 - DNA, 23 bp, Artificial Sequence
  HLA-A targeting gRNA
cttcttctcccaacctgcgacgg

SEQ ID NO: 6074 - DNA, 23 bp, Artificial Sequence
  HLA-A targeting gRNA
cttcttctcccaacctgcgtcgg

SEQ ID NO: 6075 - DNA, 23 bp, Artificial Sequence
  HLA-A targeting gRNA
cttcttctcccaacctgtgtcgg

SEQ ID NO: 6076 - DNA, 23 bp, Artificial Sequence
  HLA-A targeting gRNA
cttcttctcccaacttgtgtcgg

SEQ ID NO: 6077 - DNA, 23 bp, Artificial Sequence
  HLA-A targeting gRNA
cttcttcttccaacctgcgtcgg

SEQ ID NO: 6078 - DNA, 23 bp, Artificial Sequence
  HLA-A targeting gRNA
cttgaaaaggtgagattcttggg

SEQ ID NO: 6079 - DNA, 23 bp, Artificial Sequence
  HLA-A targeting gRNA
cttgctctatccacggcgcccgg

SEQ ID NO: 6080 - DNA, 23 bp, Artificial Sequence
  HLA-A targeting gRNA
cttgctctatccatggcgcccgg

SEQ ID NO: 6081 - DNA, 23 bp, Artificial Sequence
  HLA-A targeting gRNA
cttggggtctagagtgggcaggg

SEQ ID NO: 6082 - DNA, 23 bp, Artificial Sequence
  HLA-A targeting gRNA
cttggggtctagagtgggcgggg

SEQ ID NO: 6083 - DNA, 23 bp, Artificial Sequence
  HLA-A targeting gRNA
cttggggtctagagtgggtgggg

SEQ ID NO: 6084 - DNA, 23 bp, Artificial Sequence
  HLA-A targeting gRNA
cttggggtggatctcagacgggg

SEQ ID NO: 6085 - DNA, 23 bp, Artificial Sequence
  HLA-A targeting gRNA
cttgtaaaggtgagattctgggg

SEQ ID NO: 6086 - DNA, 23 bp, Artificial Sequence
  HLA-A targeting gRNA
cttgtgagggaccgagatgcagg

SEQ ID NO: 6087 - DNA, 23 bp, Artificial Sequence
  HLA-A targeting gRNA
cttgtgagggactgagatgcagg

SEQ ID NO: 6088 - DNA, 23 bp, Artificial Sequence
  HLA-A targeting gRNA
cttgtggagaccagaccagcagg

SEQ ID NO: 6089 - DNA, 23 bp, Artificial Sequence
  HLA-A targeting gRNA
cttgtggagaccagaccggcagg

SEQ ID NO: 6090 - DNA, 23 bp, Artificial Sequence
  HLA-A targeting gRNA
cttgtggagaccagacctgcagg

SEQ ID NO: 6091 - DNA, 23 bp, Artificial Sequence
  HLA-A targeting gRNA
cttgtggagaccaggccagcagg

SEQ ID NO: 6092 - DNA, 23 bp, Artificial Sequence
  HLA-A targeting gRNA
cttgtggagaccaggcgagcagg

SEQ ID NO: 6093 - DNA, 23 bp, Artificial Sequence
  HLA-A targeting gRNA
cttgtgtcgggtccttcttccgg

SEQ ID NO: 6094 - DNA, 23 bp, Artificial Sequence
  HLA-A targeting gRNA
ctttaaacacattgagcgtgagg

SEQ ID NO: 6095 - DNA, 23 bp, Artificial Sequence
  HLA-A targeting gRNA
ctttgccgtcgtaggcgtactgg

SEQ ID NO: 6096 - DNA, 23 bp, Artificial Sequence
  HLA-A targeting gRNA
ctttgccgtcgtaggcgtcctgg

SEQ ID NO: 6097 - DNA, 23 bp, Artificial Sequence
  HLA-A targeting gRNA
cttttgggtccaagacgaggagg

SEQ ID NO: 6098 - DNA, 23 bp, Artificial Sequence
  HLA-A targeting gRNA
cttttgggtccaagactaggagg

SEQ ID NO: 6099 - DNA, 23 bp, Artificial Sequence
  HLA-A targeting gRNA
cttttggttccaagacgaggagg

SEQ ID NO: 6100 - DNA, 23 bp, Artificial Sequence
  HLA-A targeting gRNA
ctttttttttgttctaccccagg

SEQ ID NO: 6101 - DNA, 23 bp, Artificial Sequence
  HLA-A targeting gRNA
gaaaccgggtaaacgcgcctggg

SEQ ID NO: 6102 - DNA, 23 bp, Artificial Sequence
  HLA-A targeting gRNA
gaaaccgggtaaaggcgactagg

SEQ ID NO: 6103 - DNA, 23 bp, Artificial Sequence
  HLA-A targeting gRNA
gaaaccgggtaaaggcgactggg

SEQ ID NO: 6104 - DNA, 23 bp, Artificial Sequence
  HLA-A targeting gRNA
gaaaccgggtaaaggtgactggg

SEQ ID NO: 6105 - DNA, 23 bp, Artificial Sequence
  HLA-A targeting gRNA
gaaaccgggtaaagtcgcctggg

SEQ ID NO: 6106 - DNA, 23 bp, Artificial Sequence
  HLA-A targeting gRNA
gaaactcaggggagtgggagtgg

SEQ ID NO: 6107 - DNA, 23 bp, Artificial Sequence
  HLA-A targeting gRNA
gaaagcaggagcccttcagcagg

SEQ ID NO: 6108 - DNA, 23 bp, Artificial Sequence
  HLA-A targeting gRNA
gaaagttcgagtctctgagcggg

SEQ ID NO: 6109 - DNA, 23 bp, Artificial Sequence
  HLA-A targeting gRNA
gaaagttcgagtctctgagtggg

SEQ ID NO: 6110 - DNA, 23 bp, Artificial Sequence
  HLA-A targeting gRNA
gaaatacttcatggagtgggagg

SEQ ID NO: 6111 - DNA, 23 bp, Artificial Sequence
  HLA-A targeting gRNA
gaacaaattcaggtcagtcatgg

SEQ ID NO: 6112 - DNA, 23 bp, Artificial Sequence
  HLA-A targeting gRNA
gaacaaattctggtgagtcatgg

SEQ ID NO: 6113 - DNA, 23 bp, Artificial Sequence
  HLA-A targeting gRNA
gaacaaattctggttagtcatgg

SEQ ID NO: 6114 - DNA, 23 bp, Artificial Sequence
  HLA-A targeting gRNA
gaaccatgacttttcctctcagg

SEQ ID NO: 6115 - DNA, 23 bp, Artificial Sequence
  HLA-A targeting gRNA
gaaccatgacttttcttctcagg

SEQ ID NO: 6116 - DNA, 23 bp, Artificial Sequence
  HLA-A targeting gRNA
gaaccctcctcctgctgctctgg

SEQ ID NO: 6117 - DNA, 23 bp, Artificial Sequence
  HLA-A targeting gRNA
gaaccgtcctcctgctgctctgg

SEQ ID NO: 6118 - DNA, 23 bp, Artificial Sequence
  HLA-A targeting gRNA
gaaccgtgacctttcctctcagg

SEQ ID NO: 6119 - DNA, 23 bp, Artificial Sequence
  HLA-A targeting gRNA
gaaccgtgacttttcctctcagg

SEQ ID NO: 6120 - DNA, 23 bp, Artificial Sequence
  HLA-A targeting gRNA
gaactacaagcgccaggcacagg

SEQ ID NO: 6121 - DNA, 23 bp, Artificial Sequence
  HLA-A targeting gRNA
gaactacgactgcagacccaggg

SEQ ID NO: 6122 - DNA, 23 bp, Artificial Sequence
  HLA-A targeting gRNA
gaactatgactgcagacccaggg

SEQ ID NO: 6123 - DNA, 23 bp, Artificial Sequence
  HLA-A targeting gRNA
gaagaaatacttcatggagtggg

SEQ ID NO: 6124 - DNA, 23 bp, Artificial Sequence
  HLA-A targeting gRNA
gaagaagaagtgaaactcagggg

SEQ ID NO: 6125 - DNA, 23 bp, Artificial Sequence
  HLA-A targeting gRNA
gaagaagacgctgcagcgcgcgg

SEQ ID NO: 6126 - DNA, 23 bp, Artificial Sequence
  HLA-A targeting gRNA
gaagaaggaccccacaagttggg

SEQ ID NO: 6127 - DNA, 23 bp, Artificial Sequence
  HLA-A targeting gRNA
gaagacggctctgggaaaggagg

SEQ ID NO: 6128 - DNA, 23 bp, Artificial Sequence
  HLA-A targeting gRNA
gaagagctcaggtagggaagggg

SEQ ID NO: 6129 - DNA, 23 bp, Artificial Sequence
  HLA-A targeting gRNA
gaagagttcaggtagggaagggg

SEQ ID NO: 6130 - DNA, 23 bp, Artificial Sequence
  HLA-A targeting gRNA
gaagagttctggtagggaagggg

SEQ ID NO: 6131 - DNA, 23 bp, Artificial Sequence
  HLA-A targeting gRNA
gaagatggccctgggaaaggagg

SEQ ID NO: 6132 - DNA, 23 bp, Artificial Sequence
  HLA-A targeting gRNA
gaagatggctctgggaaaggagg

SEQ ID NO: 6133 - DNA, 23 bp, Artificial Sequence
  HLA-A targeting gRNA
gaagcacaagcgccaggcacagg

SEQ ID NO: 6134 - DNA, 23 bp, Artificial Sequence
  HLA-A targeting gRNA
gaagccaatcagcgtcgccgcgg

SEQ ID NO: 6135 - DNA, 23 bp, Artificial Sequence
  HLA-A targeting gRNA
gaagccaatcagcgtcgccgggg

SEQ ID NO: 6136 - DNA, 23 bp, Artificial Sequence
  HLA-A targeting gRNA
gaagccaatcagcgtcgccgtgg

SEQ ID NO: 6137 - DNA, 23 bp, Artificial Sequence
  HLA-A targeting gRNA
gaagccaatcagcgttgccgcgg

SEQ ID NO: 6138 - DNA, 23 bp, Artificial Sequence
  HLA-A targeting gRNA
gaagccaatcagtgtcgccgggg

SEQ ID NO: 6139 - DNA, 23 bp, Artificial Sequence
  HLA-A targeting gRNA
gaagcccctcaccctgagatggg

SEQ ID NO: 6140 - DNA, 23 bp, Artificial Sequence
  HLA-A targeting gRNA
gaagcccctcatgctgtacatgg

SEQ ID NO: 6141 - DNA, 23 bp, Artificial Sequence
  HLA-A targeting gRNA
gaagcggagctccccgcggccgg

SEQ ID NO: 6142 - DNA, 23 bp, Artificial Sequence
  HLA-A targeting gRNA
gaagcgggactctccgcggccgg

SEQ ID NO: 6143 - DNA, 23 bp, Artificial Sequence
  HLA-A targeting gRNA
gaagcggggctccccacggccgg

SEQ ID NO: 6144 - DNA, 23 bp, Artificial Sequence
  HLA-A targeting gRNA
gaagcggggctccccgcagccgg

SEQ ID NO: 6145 - DNA, 23 bp, Artificial Sequence
  HLA-A targeting gRNA
gaagcggggctccccgctgccgg

SEQ ID NO: 6146 - DNA, 23 bp, Artificial Sequence
  HLA-A targeting gRNA
gaagcggggctctccgcggccgg

SEQ ID NO: 6147 - DNA, 23 bp, Artificial Sequence
  HLA-A targeting gRNA
gaaggaaacgctgcagcgcgcgg

SEQ ID NO: 6148 - DNA, 23 bp, Artificial Sequence
  HLA-A targeting gRNA
gaaggacacgctggagcgcgcgg

SEQ ID NO: 6149 - DNA, 23 bp, Artificial Sequence
  HLA-A targeting gRNA
gaaggacggatgtatcaccgtgg

SEQ ID NO: 6150 - DNA, 23 bp, Artificial Sequence
  HLA-A targeting gRNA
gaaggacggatgtatcaccttgg

SEQ ID NO: 6151 - DNA, 23 bp, Artificial Sequence
  HLA-A targeting gRNA
gaaggagaccctgcagcgcgcgg

SEQ ID NO: 6152 - DNA, 23 bp, Artificial Sequence
  HLA-A targeting gRNA
gaaggagacgctgcaacgcgcgg

SEQ ID NO: 6153 - DNA, 23 bp, Artificial Sequence
  HLA-A targeting gRNA
gaaggagacgctgcagagcgcgg

SEQ ID NO: 6154 - DNA, 23 bp, Artificial Sequence
  HLA-A targeting gRNA
gaaggagacgctgcagcacgcgg

SEQ ID NO: 6155 - DNA, 23 bp, Artificial Sequence
  HLA-A targeting gRNA
gaaggagacgctggagcgcgcgg

SEQ ID NO: 6156 - DNA, 23 bp, Artificial Sequence
  HLA-A targeting gRNA
gaaggaggggccggagtattggg

SEQ ID NO: 6157 - DNA, 23 bp, Artificial Sequence
  HLA-A targeting gRNA
gaagtacaagcgccaggcacagg

SEQ ID NO: 6158 - DNA, 23 bp, Artificial Sequence
  HLA-A targeting gRNA
gaagtatgactacagacccaagg

SEQ ID NO: 6159 - DNA, 23 bp, Artificial Sequence
  HLA-A targeting gRNA
gaagtatgactacagacccaggg

SEQ ID NO: 6160 - DNA, 23 bp, Artificial Sequence
  HLA-A targeting gRNA
gaagtcccaggccccgggcgggg

SEQ ID NO: 6161 - DNA, 23 bp, Artificial Sequence
  HLA-A targeting gRNA
gaagtcccaggtcccggacgggg

SEQ ID NO: 6162 - DNA, 23 bp, Artificial Sequence
  HLA-A targeting gRNA
gaagtcccaggtcccgggcgggg

SEQ ID NO: 6163 - DNA, 23 bp, Artificial Sequence
  HLA-A targeting gRNA
gaagtcccatgtcccggacgggg

SEQ ID NO: 6164 - DNA, 23 bp, Artificial Sequence
  HLA-A targeting gRNA
gaagtccccagtcacccacccgg

SEQ ID NO: 6165 - DNA, 23 bp, Artificial Sequence
  HLA-A targeting gRNA
gaagtccctgaggaaatggaggg

SEQ ID NO: 6166 - DNA, 23 bp, Artificial Sequence
  HLA-A targeting gRNA
gaagtccttgaggaaatggaggg

SEQ ID NO: 6167 - DNA, 23 bp, Artificial Sequence
  HLA-A targeting gRNA
gaagtctctgaggaaatggaggg

SEQ ID NO: 6168 - DNA, 23 bp, Artificial Sequence
  HLA-A targeting gRNA
gaagtgaaactcagggaagtggg

SEQ ID NO: 6169 - DNA, 23 bp, Artificial Sequence
  HLA-A targeting gRNA
gaagtgaaactcaggggagtggg

SEQ ID NO: 6170 - DNA, 23 bp, Artificial Sequence
  HLA-A targeting gRNA
gaagtgaaactcgtgggagtggg

SEQ ID NO: 6171 - DNA, 23 bp, Artificial Sequence
  HLA-A targeting gRNA
gaagtgaaactcttgggagtggg

SEQ ID NO: 6172 - DNA, 23 bp, Artificial Sequence
  HLA-A targeting gRNA
gaagtgggagcctgggggcgagg

SEQ ID NO: 6173 - DNA, 23 bp, Artificial Sequence
  HLA-A targeting gRNA
gaagtggggctccccgcggccgg

SEQ ID NO: 6174 - DNA, 23 bp, Artificial Sequence
  HLA-A targeting gRNA
gaagtggggctctccgcggccgg

SEQ ID NO: 6175 - DNA, 23 bp, Artificial Sequence
  HLA-A targeting gRNA
gaagtggggctctccgcggctgg

SEQ ID NO: 6176 - DNA, 23 bp, Artificial Sequence
  HLA-A targeting gRNA
gaatatcgccctcccttgaatgg

SEQ ID NO: 6177 - DNA, 23 bp, Artificial Sequence
  HLA-A targeting gRNA
gaatatgtatggctgcgacgtgg

SEQ ID NO: 6178 - DNA, 23 bp, Artificial Sequence
  HLA-A targeting gRNA
gaatgacgtctctgaggaaatgg

SEQ ID NO: 6179 - DNA, 23 bp, Artificial Sequence
  HLA-A targeting gRNA
gaatgtcgccctcccttgaatgg

SEQ ID NO: 6180 - DNA, 23 bp, Artificial Sequence
  HLA-A targeting gRNA
gaatgtcgccctccgttgaatgg

SEQ ID NO: 6181 - DNA, 23 bp, Artificial Sequence
  HLA-A targeting gRNA
gacaagaggaattatggagtagg

SEQ ID NO: 6182 - DNA, 23 bp, Artificial Sequence
  HLA-A targeting gRNA
gacaagaggaattatggggcggg

SEQ ID NO: 6183 - DNA, 23 bp, Artificial Sequence
  HLA-A targeting gRNA
gacaagaggaattatggggtagg

SEQ ID NO: 6184 - DNA, 23 bp, Artificial Sequence
  HLA-A targeting gRNA
gacaagaggaattatggggtggg

SEQ ID NO: 6185 - DNA, 23 bp, Artificial Sequence
  HLA-A targeting gRNA
gacacaaaagtacaagcgccagg

SEQ ID NO: 6186 - DNA, 23 bp, Artificial Sequence
  HLA-A targeting gRNA
gacacagaactacaagcgccagg

SEQ ID NO: 6187 - DNA, 23 bp, Artificial Sequence
  HLA-A targeting gRNA
gacacagaagaacaagcgccagg

SEQ ID NO: 6188 - DNA, 23 bp, Artificial Sequence
  HLA-A targeting gRNA
gacacagaagcacaagcgccagg

SEQ ID NO: 6189 - DNA, 23 bp, Artificial Sequence
  HLA-A targeting gRNA
gacacagaagtacaagcgccagg

SEQ ID NO: 6190 - DNA, 23 bp, Artificial Sequence
  HLA-A targeting gRNA
gacacagatctgcaaggccaagg

SEQ ID NO: 6191 - DNA, 23 bp, Artificial Sequence
  HLA-A targeting gRNA
gacacagatctgcaaggcccagg

SEQ ID NO: 6192 - DNA, 23 bp, Artificial Sequence
  HLA-A targeting gRNA
gacaccgccacgtcccggcccgg

SEQ ID NO: 6193 - DNA, 23 bp, Artificial Sequence
  HLA-A targeting gRNA
gacaccgccatgtcccggcccgg

SEQ ID NO: 6194 - DNA, 23 bp, Artificial Sequence
  HLA-A targeting gRNA
gacaccgccgtgtcccggcccgg

SEQ ID NO: 6195 - DNA, 23 bp, Artificial Sequence
  HLA-A targeting gRNA
gacaccgccgtgtcctggcccgg

SEQ ID NO: 6196 - DNA, 23 bp, Artificial Sequence
  HLA-A targeting gRNA
gacacctgatcagtattctaggg

SEQ ID NO: 6197 - DNA, 23 bp, Artificial Sequence
  HLA-A targeting gRNA
gacacctggggtagggaaggggg

SEQ ID NO: 6198 - DNA, 23 bp, Artificial Sequence
  HLA-A targeting gRNA
gacacctggggtggggaaggcgg

SEQ ID NO: 6199 - DNA, 23 bp, Artificial Sequence
  HLA-A targeting gRNA
gacacctggggtggggaaggggg

SEQ ID NO: 6200 - DNA, 23 bp, Artificial Sequence
  HLA-A targeting gRNA
gacaggaggaattagggggtggg

SEQ ID NO: 6201 - DNA, 23 bp, Artificial Sequence
  HLA-A targeting gRNA
gacaggaggaattatggggtggg

SEQ ID NO: 6202 - DNA, 23 bp, Artificial Sequence
  HLA-A targeting gRNA
gacatctctgaggaaatggaggg

SEQ ID NO: 6203 - DNA, 23 bp, Artificial Sequence
  HLA-A targeting gRNA
gaccacagcgaccacagctacgg

SEQ ID NO: 6204 - DNA, 23 bp, Artificial Sequence
  HLA-A targeting gRNA
gaccagcatctcggcgtctgagg

SEQ ID NO: 6205 - DNA, 23 bp, Artificial Sequence
  HLA-A targeting gRNA
gaccagcatcttggcgtctgagg

SEQ ID NO: 6206 - DNA, 23 bp, Artificial Sequence
  HLA-A targeting gRNA
gacccaggacaccgagcttgtgg

SEQ ID NO: 6207 - DNA, 23 bp, Artificial Sequence
  HLA-A targeting gRNA
gaccccgcactcaccagcccagg

SEQ ID NO: 6208 - DNA, 23 bp, Artificial Sequence
  HLA-A targeting gRNA
gaccccgcactcaccggcccagg

SEQ ID NO: 6209 - DNA, 23 bp, Artificial Sequence
  HLA-A targeting gRNA
gacccctgatcactatcctaggg

SEQ ID NO: 6210 - DNA, 23 bp, Artificial Sequence
  HLA-A targeting gRNA
gacccctgatcagtattataggg

SEQ ID NO: 6211 - DNA, 23 bp, Artificial Sequence
  HLA-A targeting gRNA
gacccctgatcagtattccaggg

SEQ ID NO: 6212 - DNA, 23 bp, Artificial Sequence
  HLA-A targeting gRNA
gacccctgatcagtattctaggg

SEQ ID NO: 6213 - DNA, 23 bp, Artificial Sequence
  HLA-A targeting gRNA
gacccgcatctcggcctctgggg

SEQ ID NO: 6214 - DNA, 23 bp, Artificial Sequence
  HLA-A targeting gRNA
gacccgcatctcggcgtctgagg

SEQ ID NO: 6215 - DNA, 23 bp, Artificial Sequence
  HLA-A targeting gRNA
gacccgcatctcggcgtctgggg

SEQ ID NO: 6216 - DNA, 23 bp, Artificial Sequence
  HLA-A targeting gRNA
gacccgcatctcggtgtctgagg

SEQ ID NO: 6217 - DNA, 23 bp, Artificial Sequence
  HLA-A targeting gRNA
gacccgccagaccctcctcccgg

SEQ ID NO: 6218 - DNA, 23 bp, Artificial Sequence
  HLA-A targeting gRNA
gacccgcccaaaccctcgaccgg

SEQ ID NO: 6219 - DNA, 23 bp, Artificial Sequence
  HLA-A targeting gRNA
gacccgcccagaccctcgaccgg

SEQ ID NO: 6220 - DNA, 23 bp, Artificial Sequence
  HLA-A targeting gRNA
gacccgcccgacccacctcccgg

SEQ ID NO: 6221 - DNA, 23 bp, Artificial Sequence
  HLA-A targeting gRNA
gacccgcccgaccctcctaccgg

SEQ ID NO: 6222 - DNA, 23 bp, Artificial Sequence
  HLA-A targeting gRNA
gaccctgagagccccgcccgggg

SEQ ID NO: 6223 - DNA, 23 bp, Artificial Sequence
  HLA-A targeting gRNA
gaccgggctgaccacgggggcgg

SEQ ID NO: 6224 - DNA, 23 bp, Artificial Sequence
  HLA-A targeting gRNA
gaccgtgagtgaccccggcccgg

SEQ ID NO: 6225 - DNA, 23 bp, Artificial Sequence
  HLA-A targeting gRNA
gacctgcgctcctggaccgccgg

SEQ ID NO: 6226 - DNA, 23 bp, Artificial Sequence
  HLA-A targeting gRNA
gacctggaccggtgagtgcgggg

SEQ ID NO: 6227 - DNA, 23 bp, Artificial Sequence
  HLA-A targeting gRNA
gacctggcagcgggatggcaagg

SEQ ID NO: 6228 - DNA, 23 bp, Artificial Sequence
  HLA-A targeting gRNA
gacctggcagcgggatggcgagg

SEQ ID NO: 6229 - DNA, 23 bp, Artificial Sequence
  HLA-A targeting gRNA
gacctggcagtgggatggggagg

SEQ ID NO: 6230 - DNA, 23 bp, Artificial Sequence
  HLA-A targeting gRNA
gacctgggccggtgagtgcgggg

SEQ ID NO: 6231 - DNA, 23 bp, Artificial Sequence
  HLA-A targeting gRNA
gacctgggcctgtgagtgcgagg

SEQ ID NO: 6232 - DNA, 23 bp, Artificial Sequence
  HLA-A targeting gRNA
gacctgggcctgtgagtgcgggg

SEQ ID NO: 6233 - DNA, 23 bp, Artificial Sequence
  HLA-A targeting gRNA
gacctgggctggtgagtgcgggg

SEQ ID NO: 6234 - DNA, 23 bp, Artificial Sequence
  HLA-A targeting gRNA
gacctggtagcgggatggcgagg

SEQ ID NO: 6235 - DNA, 23 bp, Artificial Sequence
  HLA-A targeting gRNA
gacgatgtacggctgcgacgtgg

SEQ ID NO: 6236 - DNA, 23 bp, Artificial Sequence
  HLA-A targeting gRNA
gacgatgtatggctgcgacatgg

SEQ ID NO: 6237 - DNA, 23 bp, Artificial Sequence
  HLA-A targeting gRNA
gacgatgtatggctgcgacctgg

SEQ ID NO: 6238 - DNA, 23 bp, Artificial Sequence
  HLA-A targeting gRNA
gacgatgtatggctgcgacgtgg

SEQ ID NO: 6239 - DNA, 23 bp, Artificial Sequence
  HLA-A targeting gRNA
gacgcagaagtacaagcgccagg

SEQ ID NO: 6240 - DNA, 23 bp, Artificial Sequence
  HLA-A targeting gRNA
gacgccgcgagtccgagaagggg

SEQ ID NO: 6241 - DNA, 23 bp, Artificial Sequence
  HLA-A targeting gRNA
gacggagccccgggcgccgtggg

SEQ ID NO: 6242 - DNA, 23 bp, Artificial Sequence
  HLA-A targeting gRNA
gacgggctgaccacgggggcggg

SEQ ID NO: 6243 - DNA, 23 bp, Artificial Sequence
  HLA-A targeting gRNA
gacggggctctcagggtctcagg

SEQ ID NO: 6244 - DNA, 23 bp, Artificial Sequence
  HLA-A targeting gRNA
gacggggctctcagtgtctcagg

SEQ ID NO: 6245 - DNA, 23 bp, Artificial Sequence
  HLA-A targeting gRNA
gacggggctgaccacgggggcgg

SEQ ID NO: 6246 - DNA, 23 bp, Artificial Sequence
  HLA-A targeting gRNA
gacggggctgaccgcggggccgg

SEQ ID NO: 6247 - DNA, 23 bp, Artificial Sequence
  HLA-A targeting gRNA
gacggggctgaccgcgggggcgg

SEQ ID NO: 6248 - DNA, 23 bp, Artificial Sequence
  HLA-A targeting gRNA
gacggggctggccgcggggccgg

SEQ ID NO: 6249 - DNA, 23 bp, Artificial Sequence
  HLA-A targeting gRNA
gacggtgagtgaccccggcctgg

SEQ ID NO: 6250 - DNA, 23 bp, Artificial Sequence
  HLA-A targeting gRNA
gacggtgctgaccgcggggccgg

SEQ ID NO: 6251 - DNA, 23 bp, Artificial Sequence
  HLA-A targeting gRNA
gacgtctctgaggaaatggaggg

SEQ ID NO: 6252 - DNA, 23 bp, Artificial Sequence
  HLA-A targeting gRNA
gacgtctctgaggaaatgtaggg

SEQ ID NO: 6253 - DNA, 23 bp, Artificial Sequence
  HLA-A targeting gRNA
gacgtgggacaggaggaattagg

SEQ ID NO: 6254 - DNA, 23 bp, Artificial Sequence
  HLA-A targeting gRNA
gactcacgaatgctggaatcagg

SEQ ID NO: 6255 - DNA, 23 bp, Artificial Sequence
  HLA-A targeting gRNA
gactcatgaatgctgaaatcagg

SEQ ID NO: 6256 - DNA, 23 bp, Artificial Sequence
  HLA-A targeting gRNA
gactcatgaatgctggaatcagg

SEQ ID NO: 6257 - DNA, 23 bp, Artificial Sequence
  HLA-A targeting gRNA
gactccccatcccccacggacgg

SEQ ID NO: 6258 - DNA, 23 bp, Artificial Sequence
  HLA-A targeting gRNA
gactccccatcccccacgtacgg

SEQ ID NO: 6259 - DNA, 23 bp, Artificial Sequence
  HLA-A targeting gRNA
gactgggctgaccacgggggcgg

SEQ ID NO: 6260 - DNA, 23 bp, Artificial Sequence
  HLA-A targeting gRNA
gactgggctgaccgcggggccgg

SEQ ID NO: 6261 - DNA, 23 bp, Artificial Sequence
  HLA-A targeting gRNA
gactgggctgaccgcgggggcgg

SEQ ID NO: 6262 - DNA, 23 bp, Artificial Sequence
  HLA-A targeting gRNA
gagaacaaggcctgagagaaagg

SEQ ID NO: 6263 - DNA, 23 bp, Artificial Sequence
  HLA-A targeting gRNA
gagaaccccgcccgggacctggg

SEQ ID NO: 6264 - DNA, 23 bp, Artificial Sequence
  HLA-A targeting gRNA
gagaacctgcggaacctgcgcgg

SEQ ID NO: 6265 - DNA, 23 bp, Artificial Sequence
  HLA-A targeting gRNA
gagaacggacaggacacctgggg

SEQ ID NO: 6266 - DNA, 23 bp, Artificial Sequence
  HLA-A targeting gRNA
gagaagccaatcagcgtcgccgg

SEQ ID NO: 6267 - DNA, 23 bp, Artificial Sequence
  HLA-A targeting gRNA
gagaagccaatcagtgtcgccgg

SEQ ID NO: 6268 - DNA, 23 bp, Artificial Sequence
  HLA-A targeting gRNA
gagaatggacaggacacctgggg

SEQ ID NO: 6269 - DNA, 23 bp, Artificial Sequence
  HLA-A targeting gRNA
gagaatggacgggacacctgggg

SEQ ID NO: 6270 - DNA, 23 bp, Artificial Sequence
  HLA-A targeting gRNA
gagaatgggcaggacacctgggg

SEQ ID NO: 6271 - DNA, 23 bp, Artificial Sequence
  HLA-A targeting gRNA
gagacactgagagccccgtccgg

SEQ ID NO: 6272 - DNA, 23 bp, Artificial Sequence
  HLA-A targeting gRNA
gagacagaaccttccagaagtgg

SEQ ID NO: 6273 - DNA, 23 bp, Artificial Sequence
  HLA-A targeting gRNA
gagaccaggccagcaggagatgg

SEQ ID NO: 6274 - DNA, 23 bp, Artificial Sequence
  HLA-A targeting gRNA
gagaccaggcgagcaggagatgg

SEQ ID NO: 6275 - DNA, 23 bp, Artificial Sequence
  HLA-A targeting gRNA
gagacccagagagccccgcccgg

SEQ ID NO: 6276 - DNA, 23 bp, Artificial Sequence
  HLA-A targeting gRNA
gagacccgggccgtacgtcgggg

SEQ ID NO: 6277 - DNA, 23 bp, Artificial Sequence
  HLA-A targeting gRNA
gagaccctgagaaccccgcccgg

SEQ ID NO: 6278 - DNA, 23 bp, Artificial Sequence
  HLA-A targeting gRNA
gagaccctgagagccccgcccgg

SEQ ID NO: 6279 - DNA, 23 bp, Artificial Sequence
  HLA-A targeting gRNA
gagaccctgagagccccgtccgg

SEQ ID NO: 6280 - DNA, 23 bp, Artificial Sequence
  HLA-A targeting gRNA
gagacctggaccggtgagtgcgg

SEQ ID NO: 6281 - DNA, 23 bp, Artificial Sequence
  HLA-A targeting gRNA
gagacctgggccggtgagtgcgg

SEQ ID NO: 6282 - DNA, 23 bp, Artificial Sequence
  HLA-A targeting gRNA
gagacctgggcctgtgagtgcgg

SEQ ID NO: 6283 - DNA, 23 bp, Artificial Sequence
  HLA-A targeting gRNA
gagacctgggcgggtgagtgcgg

SEQ ID NO: 6284 - DNA, 23 bp, Artificial Sequence
  HLA-A targeting gRNA
gagacctgggctggtgagtgcgg

SEQ ID NO: 6285 - DNA, 23 bp, Artificial Sequence
  HLA-A targeting gRNA
gagagactcatcagagccctggg

SEQ ID NO: 6286 - DNA, 23 bp, Artificial Sequence
  HLA-A targeting gRNA
gagagaggggaccgcaggcgggg

SEQ ID NO: 6287 - DNA, 23 bp, Artificial Sequence
  HLA-A targeting gRNA
gagagccccgcccgggacctggg

SEQ ID NO: 6288 - DNA, 23 bp, Artificial Sequence
  HLA-A targeting gRNA
gagagccccgcccggggcctggg

SEQ ID NO: 6289 - DNA, 23 bp, Artificial Sequence
  HLA-A targeting gRNA
gagagccccgtccgggacatggg

SEQ ID NO: 6290 - DNA, 23 bp, Artificial Sequence
  HLA-A targeting gRNA
gagagccccgtccgggacctggg

SEQ ID NO: 6291 - DNA, 23 bp, Artificial Sequence
  HLA-A targeting gRNA
gagagcctgcgaaacctgcgcgg

SEQ ID NO: 6292 - DNA, 23 bp, Artificial Sequence
  HLA-A targeting gRNA
gagagcctgcggaacctgcgcgg

SEQ ID NO: 6293 - DNA, 23 bp, Artificial Sequence
  HLA-A targeting gRNA
gagagcctgcggaccctgcgcgg

SEQ ID NO: 6294 - DNA, 23 bp, Artificial Sequence
  HLA-A targeting gRNA
gagagcctgcggatcctgcgcgg

SEQ ID NO: 6295 - DNA, 23 bp, Artificial Sequence
  HLA-A targeting gRNA
gagaggagccgcgggcgccgtgg

SEQ ID NO: 6296 - DNA, 23 bp, Artificial Sequence
  HLA-A targeting gRNA
gagaggagccgcgggcgcggtgg

SEQ ID NO: 6297 - DNA, 23 bp, Artificial Sequence
  HLA-A targeting gRNA
gagatagaaccttccagaagtgg

SEQ ID NO: 6298 - DNA, 23 bp, Artificial Sequence
  HLA-A targeting gRNA
gagatccgcccccgaggccgcgg

SEQ ID NO: 6299 - DNA, 23 bp, Artificial Sequence
  HLA-A targeting gRNA
gagatccgccccgaggccgcggg

SEQ ID NO: 6300 - DNA, 23 bp, Artificial Sequence
  HLA-A targeting gRNA
gagatggaaccttccagaagtgg

SEQ ID NO: 6301 - DNA, 23 bp, Artificial Sequence
  HLA-A targeting gRNA
gagattctggggagctgaagtgg

SEQ ID NO: 6302 - DNA, 23 bp, Artificial Sequence
  HLA-A targeting gRNA
gagattcttggggtctagagtgg

SEQ ID NO: 6303 - DNA, 23 bp, Artificial Sequence
  HLA-A targeting gRNA
gagcaaggggaccgcaggcgggg

SEQ ID NO: 6304 - DNA, 23 bp, Artificial Sequence
  HLA-A targeting gRNA
gagcaccgcttcatctcagtggg

SEQ ID NO: 6305 - DNA, 23 bp, Artificial Sequence
  HLA-A targeting gRNA
gagcagcaggaggacggttcggg

SEQ ID NO: 6306 - DNA, 23 bp, Artificial Sequence
  HLA-A targeting gRNA
gagcagcaggaggagagttcggg

SEQ ID NO: 6307 - DNA, 23 bp, Artificial Sequence
  HLA-A targeting gRNA
gagcagcaggaggagggctcggg

SEQ ID NO: 6308 - DNA, 23 bp, Artificial Sequence
  HLA-A targeting gRNA
gagcagcaggaggagggcttggg

SEQ ID NO: 6309 - DNA, 23 bp, Artificial Sequence
  HLA-A targeting gRNA
gagcagcaggaggagggttcggg

SEQ ID NO: 6310 - DNA, 23 bp, Artificial Sequence
  HLA-A targeting gRNA
gagcagcaggatgagggttcagg

SEQ ID NO: 6311 - DNA, 23 bp, Artificial Sequence
  HLA-A targeting gRNA
gagcagcaggatgagggttcggg

SEQ ID NO: 6312 - DNA, 23 bp, Artificial Sequence
  HLA-A targeting gRNA
gagcatgtacggctgcgacctgg

SEQ ID NO: 6313 - DNA, 23 bp, Artificial Sequence
  HLA-A targeting gRNA
gagcatgtacggctgcgacgtgg

SEQ ID NO: 6314 - DNA, 23 bp, Artificial Sequence
  HLA-A targeting gRNA
gagcatgtatggctgcgacgtgg

SEQ ID NO: 6315 - DNA, 23 bp, Artificial Sequence
  HLA-A targeting gRNA
gagccatggatagagcaggaggg

SEQ ID NO: 6316 - DNA, 23 bp, Artificial Sequence
  HLA-A targeting gRNA
gagccccaaacactgagtgtggg

SEQ ID NO: 6317 - DNA, 23 bp, Artificial Sequence
  HLA-A targeting gRNA
gagccccacttcatcgcagtggg

SEQ ID NO: 6318 - DNA, 23 bp, Artificial Sequence
  HLA-A targeting gRNA
gagccccaggcgactttacccgg

SEQ ID NO: 6319 - DNA, 23 bp, Artificial Sequence
  HLA-A targeting gRNA
gagccccaggcgcctttacccgg

SEQ ID NO: 6320 - DNA, 23 bp, Artificial Sequence
  HLA-A targeting gRNA
gagccccaggcgcgtttacccgg

SEQ ID NO: 6321 - DNA, 23 bp, Artificial Sequence
  HLA-A targeting gRNA
gagccccagtcacctttacccgg

SEQ ID NO: 6322 - DNA, 23 bp, Artificial Sequence
  HLA-A targeting gRNA
gagccccagtcgcctttacccgg

SEQ ID NO: 6323 - DNA, 23 bp, Artificial Sequence
  HLA-A targeting gRNA
gagccccgcttcatcaccgtggg

SEQ ID NO: 6324 - DNA, 23 bp, Artificial Sequence
  HLA-A targeting gRNA
gagccccgcttcatctcagtggg

SEQ ID NO: 6325 - DNA, 23 bp, Artificial Sequence
  HLA-A targeting gRNA
gagccccgcttcattaccgtggg

SEQ ID NO: 6326 - DNA, 23 bp, Artificial Sequence
  HLA-A targeting gRNA
gagccccgcttcattgcagtggg

SEQ ID NO: 6327 - DNA, 23 bp, Artificial Sequence
  HLA-A targeting gRNA
gagccccgcttcgtctcagtggg

SEQ ID NO: 6328 - DNA, 23 bp, Artificial Sequence
  HLA-A targeting gRNA
gagcccctcaccctgagctgggg

SEQ ID NO: 6329 - DNA, 23 bp, Artificial Sequence
  HLA-A targeting gRNA
gagccctagtcgcctttacccgg

SEQ ID NO: 6330 - DNA, 23 bp, Artificial Sequence
  HLA-A targeting gRNA
gagccgcctcccacttgcgctgg

SEQ ID NO: 6331 - DNA, 23 bp, Artificial Sequence
  HLA-A targeting gRNA
gagccgtggatggagcaggaggg

SEQ ID NO: 6332 - DNA, 23 bp, Artificial Sequence
  HLA-A targeting gRNA
gagccgtgggtggagcaggaggg

SEQ ID NO: 6333 - DNA, 23 bp, Artificial Sequence
  HLA-A targeting gRNA
gagccttccccatctcctatagg

SEQ ID NO: 6334 - DNA, 23 bp, Artificial Sequence
  HLA-A targeting gRNA
gagccttgtctgcattggggagg

SEQ ID NO: 6335 - DNA, 23 bp, Artificial Sequence
  HLA-A targeting gRNA
gagcgaggggaccgcaggcgggg

SEQ ID NO: 6336 - DNA, 23 bp, Artificial Sequence
  HLA-A targeting gRNA
gagctcaggtagggaaggggtgg

SEQ ID NO: 6337 - DNA, 23 bp, Artificial Sequence
  HLA-A targeting gRNA
gagctccccgcggccgggccagg

SEQ ID NO: 6338 - DNA, 23 bp, Artificial Sequence
  HLA-A targeting gRNA
gagctccgcttcatcgcagtggg

SEQ ID NO: 6339 - DNA, 23 bp, Artificial Sequence
  HLA-A targeting gRNA
gagctcctccacacgcccaccgg

SEQ ID NO: 6340 - DNA, 23 bp, Artificial Sequence
  HLA-A targeting gRNA
gagctgaagtggtcgggggtggg

SEQ ID NO: 6341 - DNA, 23 bp, Artificial Sequence
  HLA-A targeting gRNA
gagctgaagtggtctggggtggg

SEQ ID NO: 6342 - DNA, 23 bp, Artificial Sequence
  HLA-A targeting gRNA
gagctgggtgatctgagccgcgg

SEQ ID NO: 6343 - DNA, 23 bp, Artificial Sequence
  HLA-A targeting gRNA
gagcttgtacggctgcgacgtgg

SEQ ID NO: 6344 - DNA, 23 bp, Artificial Sequence
  HLA-A targeting gRNA
gaggaaaatgggatcagcactgg

SEQ ID NO: 6345 - DNA, 23 bp, Artificial Sequence
  HLA-A targeting gRNA
gaggaaaatgggatcagcgctgg

SEQ ID NO: 6346 - DNA, 23 bp, Artificial Sequence
  HLA-A targeting gRNA
gaggaaagtcacggttcccaagg

SEQ ID NO: 6347 - DNA, 23 bp, Artificial Sequence
  HLA-A targeting gRNA
gaggacctgcggaacctgcgcgg

SEQ ID NO: 6348 - DNA, 23 bp, Artificial Sequence
  HLA-A targeting gRNA
gaggacctgcggaccctgcgcgg

SEQ ID NO: 6349 - DNA, 23 bp, Artificial Sequence
  HLA-A targeting gRNA
gaggagactctgagtccgggtgg

SEQ ID NO: 6350 - DNA, 23 bp, Artificial Sequence
  HLA-A targeting gRNA
gaggagattctgagtccgggtgg

SEQ ID NO: 6351 - DNA, 23 bp, Artificial Sequence
  HLA-A targeting gRNA
gaggagattttgagtccgggtgg

SEQ ID NO: 6352 - DNA, 23 bp, Artificial Sequence
  HLA-A targeting gRNA
gaggagccgcgccgggaggaggg

SEQ ID NO: 6353 - DNA, 23 bp, Artificial Sequence
  HLA-A targeting gRNA
gaggatgtaaggctgcgacgtgg

SEQ ID NO: 6354 - DNA, 23 bp, Artificial Sequence
  HLA-A targeting gRNA
gaggatgtacggctgcgacctgg

SEQ ID NO: 6355 - DNA, 23 bp, Artificial Sequence
  HLA-A targeting gRNA
gaggatgtacggctgcgacgtgg

SEQ ID NO: 6356 - DNA, 23 bp, Artificial Sequence
  HLA-A targeting gRNA
gaggatgtacggctgggacctgg

SEQ ID NO: 6357 - DNA, 23 bp, Artificial Sequence
  HLA-A targeting gRNA
gaggatgtatggctgcgacctgg

SEQ ID NO: 6358 - DNA, 23 bp, Artificial Sequence
  HLA-A targeting gRNA
gaggatgtctggctgcgacccgg

SEQ ID NO: 6359 - DNA, 23 bp, Artificial Sequence
  HLA-A targeting gRNA
gaggatgtctggctgcgacctgg

SEQ ID NO: 6360 - DNA, 23 bp, Artificial Sequence
  HLA-A targeting gRNA
gaggatgtctggctgcgacgtgg

SEQ ID NO: 6361 - DNA, 23 bp, Artificial Sequence
  HLA-A targeting gRNA
gaggatgtttggctgcgacctgg

SEQ ID NO: 6362 - DNA, 23 bp, Artificial Sequence
  HLA-A targeting gRNA
gaggcccttgaagtcacaaaggg

SEQ ID NO: 6363 - DNA, 23 bp, Artificial Sequence
  HLA-A targeting gRNA
gaggctcttgaagtcacaaaggg

SEQ ID NO: 6364 - DNA, 23 bp, Artificial Sequence
  HLA-A targeting gRNA
gagggaaaaggcctaggtaatgg

SEQ ID NO: 6365 - DNA, 23 bp, Artificial Sequence
  HLA-A targeting gRNA
gagggaaaaggcctgggtaatgg

SEQ ID NO: 6366 - DNA, 23 bp, Artificial Sequence
  HLA-A targeting gRNA
gagggagcctgggggcgaggagg

SEQ ID NO: 6367 - DNA, 23 bp, Artificial Sequence
  HLA-A targeting gRNA
gagggaggaacagcgacttctgg

SEQ ID NO: 6368 - DNA, 23 bp, Artificial Sequence
  HLA-A targeting gRNA
gagggcaccgcagatacctgtgg

SEQ ID NO: 6369 - DNA, 23 bp, Artificial Sequence
  HLA-A targeting gRNA
gagggcactgggaggaagcaggg

SEQ ID NO: 6370 - DNA, 23 bp, Artificial Sequence
  HLA-A targeting gRNA
gagggccccctctgctctctagg

SEQ ID NO: 6371 - DNA, 23 bp, Artificial Sequence
  HLA-A targeting gRNA
gagggccccctctgctgtctagg

SEQ ID NO: 6372 - DNA, 23 bp, Artificial Sequence
  HLA-A targeting gRNA
gagggccccctcttctctctagg

SEQ ID NO: 6373 - DNA, 23 bp, Artificial Sequence
  HLA-A targeting gRNA
gagggccccgtctgctctctagg

SEQ ID NO: 6374 - DNA, 23 bp, Artificial Sequence
  HLA-A targeting gRNA
gaggggaaaggcctgggtaatgg

SEQ ID NO: 6375 - DNA, 23 bp, Artificial Sequence
  HLA-A targeting gRNA
gaggggacagggaggaggcaggg

SEQ ID NO: 6376 - DNA, 23 bp, Artificial Sequence
  HLA-A targeting gRNA
gaggggacagggaggagtcaggg

SEQ ID NO: 6377 - DNA, 23 bp, Artificial Sequence
  HLA-A targeting gRNA
gaggggactgggaggaagcaggg

SEQ ID NO: 6378 - DNA, 23 bp, Artificial Sequence
  HLA-A targeting gRNA
gaggggactgggaggaggcaggg

SEQ ID NO: 6379 - DNA, 23 bp, Artificial Sequence
  HLA-A targeting gRNA
gaggggagccccgggcgccgtgg

SEQ ID NO: 6380 - DNA, 23 bp, Artificial Sequence
  HLA-A targeting gRNA
gaggggagccgcaggcgccgtgg

SEQ ID NO: 6381 - DNA, 23 bp, Artificial Sequence
  HLA-A targeting gRNA
gaggggagccgcgggagccgtgg

SEQ ID NO: 6382 - DNA, 23 bp, Artificial Sequence
  HLA-A targeting gRNA
gaggggagccgcgggcgccgtgg

SEQ ID NO: 6383 - DNA, 23 bp, Artificial Sequence
  HLA-A targeting gRNA
gaggggcccgaccctcctcccgg

SEQ ID NO: 6384 - DNA, 23 bp, Artificial Sequence
  HLA-A targeting gRNA
gaggggccggaatattgggacgg

SEQ ID NO: 6385 - DNA, 23 bp, Artificial Sequence
  HLA-A targeting gRNA
gaggggccggacggagtattggg

SEQ ID NO: 6386 - DNA, 23 bp, Artificial Sequence
  HLA-A targeting gRNA
gaggggcttcggtaaggaggggg

SEQ ID NO: 6387 - DNA, 23 bp, Artificial Sequence
  HLA-A targeting gRNA
gaggggtcatatctcttctcagg

SEQ ID NO: 6388 - DNA, 23 bp, Artificial Sequence
  HLA-A targeting gRNA
gaggggtcatatctgttctcagg

SEQ ID NO: 6389 - DNA, 23 bp, Artificial Sequence
  HLA-A targeting gRNA
gaggggtcatgtgtcttctcagg

SEQ ID NO: 6390 - DNA, 23 bp, Artificial Sequence
  HLA-A targeting gRNA
gaggggtgatgtgtcttctcagg

SEQ ID NO: 6391 - DNA, 23 bp, Artificial Sequence
  HLA-A targeting gRNA
gagggtctgggcgggtcccgcgg

SEQ ID NO: 6392 - DNA, 23 bp, Artificial Sequence
  HLA-A targeting gRNA
gagggtttgggcgggtcccgcgg

SEQ ID NO: 6393 - DNA, 23 bp, Artificial Sequence
  HLA-A targeting gRNA
gaggttcccctaaaatcacatgg

SEQ ID NO: 6394 - DNA, 23 bp, Artificial Sequence
  HLA-A targeting gRNA
gaggttcccctaagatcacatgg

SEQ ID NO: 6395 - DNA, 23 bp, Artificial Sequence
  HLA-A targeting gRNA
gaggttcccctaagatcgcatgg

SEQ ID NO: 6396 - DNA, 23 bp, Artificial Sequence
  HLA-A targeting gRNA
gaggttcccctaagattgcatgg

SEQ ID NO: 6397 - DNA, 23 bp, Artificial Sequence
  HLA-A targeting gRNA
gaggttcctctaagatctcatgg

SEQ ID NO: 6398 - DNA, 23 bp, Artificial Sequence
  HLA-A targeting gRNA
gaggttctgggcgggtcccgcgg

SEQ ID NO: 6399 - DNA, 23 bp, Artificial Sequence
  HLA-A targeting gRNA
gagtccaagaggggagccgcagg

SEQ ID NO: 6400 - DNA, 23 bp, Artificial Sequence
  HLA-A targeting gRNA
gagtccaagaggggagccgcggg

SEQ ID NO: 6401 - DNA, 23 bp, Artificial Sequence
  HLA-A targeting gRNA
gagtcccgcttcatctcagtggg

SEQ ID NO: 6402 - DNA, 23 bp, Artificial Sequence
  HLA-A targeting gRNA
gagtccgagaaggggagccgcgg

SEQ ID NO: 6403 - DNA, 23 bp, Artificial Sequence
  HLA-A targeting gRNA
gagtccgagagaggagccgcggg

SEQ ID NO: 6404 - DNA, 23 bp, Artificial Sequence
  HLA-A targeting gRNA
gagtccgagaggggagccccggg

SEQ ID NO: 6405 - DNA, 23 bp, Artificial Sequence
  HLA-A targeting gRNA
gagtccgagaggggagccgcggg

SEQ ID NO: 6406 - DNA, 23 bp, Artificial Sequence
  HLA-A targeting gRNA
gagtccgaggaaggagccgcggg

SEQ ID NO: 6407 - DNA, 23 bp, Artificial Sequence
  HLA-A targeting gRNA
gagtccgaggacggagccccggg

SEQ ID NO: 6408 - DNA, 23 bp, Artificial Sequence
  HLA-A targeting gRNA
gagtccgaggacggagccctggg

SEQ ID NO: 6409 - DNA, 23 bp, Artificial Sequence
  HLA-A targeting gRNA
gagtccgaggatggagccccggg

SEQ ID NO: 6410 - DNA, 23 bp, Artificial Sequence
  HLA-A targeting gRNA
gagtccgaggatggcgccccggg

SEQ ID NO: 6411 - DNA, 23 bp, Artificial Sequence
  HLA-A targeting gRNA
gagtccgaggatggcgccctggg

SEQ ID NO: 6412 - DNA, 23 bp, Artificial Sequence
  HLA-A targeting gRNA
gagtccgaggggggagccgcggg

SEQ ID NO: 6413 - DNA, 23 bp, Artificial Sequence
  HLA-A targeting gRNA
gagtcctgcagcctccactcagg

SEQ ID NO: 6414 - DNA, 23 bp, Artificial Sequence
  HLA-A targeting gRNA
gagtccttcggcctccactcagg

SEQ ID NO: 6415 - DNA, 23 bp, Artificial Sequence
  HLA-A targeting gRNA
gagtctctcatcacttgtaaagg

SEQ ID NO: 6416 - DNA, 23 bp, Artificial Sequence
  HLA-A targeting gRNA
gagtctctcatcgcttgtaaagg

SEQ ID NO: 6417 - DNA, 23 bp, Artificial Sequence
  HLA-A targeting gRNA
gagtctctgagcggggaacaggg

SEQ ID NO: 6418 - DNA, 23 bp, Artificial Sequence
  HLA-A targeting gRNA
gagtctctgagtggggaacaggg

SEQ ID NO: 6419 - DNA, 23 bp, Artificial Sequence
  HLA-A targeting gRNA
gagtgcgtggagtggctccgcgg

SEQ ID NO: 6420 - DNA, 23 bp, Artificial Sequence
  HLA-A targeting gRNA
gagtggctccgcagatacctggg

SEQ ID NO: 6421 - DNA, 23 bp, Artificial Sequence
  HLA-A targeting gRNA
gagtgggcaggggggtggtgggg

SEQ ID NO: 6422 - DNA, 23 bp, Artificial Sequence
  HLA-A targeting gRNA
gagtgggcgggggggcggggagg

SEQ ID NO: 6423 - DNA, 23 bp, Artificial Sequence
  HLA-A targeting gRNA
gagtgggcggggggggggtgggg

SEQ ID NO: 6424 - DNA, 23 bp, Artificial Sequence
  HLA-A targeting gRNA
gagtgggcggggggggtggtggg

SEQ ID NO: 6425 - DNA, 23 bp, Artificial Sequence
  HLA-A targeting gRNA
gagttcttcagcctccactcagg

SEQ ID NO: 6426 - DNA, 23 bp, Artificial Sequence
  HLA-A targeting gRNA
gagttttcttgtcccactggggg

SEQ ID NO: 6427 - DNA, 23 bp, Artificial Sequence
  HLA-A targeting gRNA
gatagagcaggaggtgccggagg

SEQ ID NO: 6428 - DNA, 23 bp, Artificial Sequence
  HLA-A targeting gRNA
gatagtcacatgggcgctgttgg

SEQ ID NO: 6429 - DNA, 23 bp, Artificial Sequence
  HLA-A targeting gRNA
gatcacactgacctggcagtggg

SEQ ID NO: 6430 - DNA, 23 bp, Artificial Sequence
  HLA-A targeting gRNA
gatcacactgacctggtagcggg

SEQ ID NO: 6431 - DNA, 23 bp, Artificial Sequence
  HLA-A targeting gRNA
gatcacactgatctggcagtggg

SEQ ID NO: 6432 - DNA, 23 bp, Artificial Sequence
  HLA-A targeting gRNA
gatcacccagcacaagttggagg

SEQ ID NO: 6433 - DNA, 23 bp, Artificial Sequence
  HLA-A targeting gRNA
gatcacccagcccaagtgggagg

SEQ ID NO: 6434 - DNA, 23 bp, Artificial Sequence
  HLA-A targeting gRNA
gatcacccagcccaagttggagg

SEQ ID NO: 6435 - DNA, 23 bp, Artificial Sequence
  HLA-A targeting gRNA
gatcacccagcgcaaatgggagg

SEQ ID NO: 6436 - DNA, 23 bp, Artificial Sequence
  HLA-A targeting gRNA
gatcacccagcgcaagttggagg

SEQ ID NO: 6437 - DNA, 23 bp, Artificial Sequence
  HLA-A targeting gRNA
gatcacccagcgtaagtgggagg

SEQ ID NO: 6438 - DNA, 23 bp, Artificial Sequence
  HLA-A targeting gRNA
gatcacccagctcaagtgggagg

SEQ ID NO: 6439 - DNA, 23 bp, Artificial Sequence
  HLA-A targeting gRNA
gatcactcagcgcaagttggagg

SEQ ID NO: 6440 - DNA, 23 bp, Artificial Sequence
  HLA-A targeting gRNA
gatcatccagcgcaagtgggagg

SEQ ID NO: 6441 - DNA, 23 bp, Artificial Sequence
  HLA-A targeting gRNA
gatccacccccctgaggccgcgg

SEQ ID NO: 6442 - DNA, 23 bp, Artificial Sequence
  HLA-A targeting gRNA
gatcccgcactcaccggcccagg

SEQ ID NO: 6443 - DNA, 23 bp, Artificial Sequence
  HLA-A targeting gRNA
gatccgaccccctgaggccgcgg

SEQ ID NO: 6444 - DNA, 23 bp, Artificial Sequence
  HLA-A targeting gRNA
gatccgcccccctgaggccgcgg

SEQ ID NO: 6445 - DNA, 23 bp, Artificial Sequence
  HLA-A targeting gRNA
gatccgccccctgaggccgcggg

SEQ ID NO: 6446 - DNA, 23 bp, Artificial Sequence
  HLA-A targeting gRNA
gatccgcctccctgaggccgcgg

SEQ ID NO: 6447 - DNA, 23 bp, Artificial Sequence
  HLA-A targeting gRNA
gatctcagacccggagactcggg

SEQ ID NO: 6448 - DNA, 23 bp, Artificial Sequence
  HLA-A targeting gRNA
gatctcagaccgggagactcggg

SEQ ID NO: 6449 - DNA, 23 bp, Artificial Sequence
  HLA-A targeting gRNA
gatctcagaccgggagacttggg

SEQ ID NO: 6450 - DNA, 23 bp, Artificial Sequence
  HLA-A targeting gRNA
gatctcagacggggagactcggg

SEQ ID NO: 6451 - DNA, 23 bp, Artificial Sequence
  HLA-A targeting gRNA
gatctcagacggggagactctgg

SEQ ID NO: 6452 - DNA, 23 bp, Artificial Sequence
  HLA-A targeting gRNA
gatctcccagcgcaagtgggagg

SEQ ID NO: 6453 - DNA, 23 bp, Artificial Sequence
  HLA-A targeting gRNA
gatctcccagcgcaagttggagg

SEQ ID NO: 6454 - DNA, 23 bp, Artificial Sequence
  HLA-A targeting gRNA
gatctcggacccggagactcggg

SEQ ID NO: 6455 - DNA, 23 bp, Artificial Sequence
  HLA-A targeting gRNA
gatctcggaccctgagactcggg

SEQ ID NO: 6456 - DNA, 23 bp, Artificial Sequence
  HLA-A targeting gRNA
gatctgagccgccgtgtccgcgg

SEQ ID NO: 6457 - DNA, 23 bp, Artificial Sequence
  HLA-A targeting gRNA
gatctgagccgccttgtccgcgg

SEQ ID NO: 6458 - DNA, 23 bp, Artificial Sequence
  HLA-A targeting gRNA
gatctgagccgcggtatccgcgg

SEQ ID NO: 6459 - DNA, 23 bp, Artificial Sequence
  HLA-A targeting gRNA
gatctgagccgcggtgtccgcgg

SEQ ID NO: 6460 - DNA, 23 bp, Artificial Sequence
  HLA-A targeting gRNA
gatctgagccgctgtgtccccgg

SEQ ID NO: 6461 - DNA, 23 bp, Artificial Sequence
  HLA-A targeting gRNA
gatctgagccgctgtgtccgcgg

SEQ ID NO: 6462 - DNA, 23 bp, Artificial Sequence
  HLA-A targeting gRNA
gatctggcagtgggatggggagg

SEQ ID NO: 6463 - DNA, 23 bp, Artificial Sequence
  HLA-A targeting gRNA
gatcttcaagaccaacacacagg

SEQ ID NO: 6464 - DNA, 23 bp, Artificial Sequence
  HLA-A targeting gRNA
gatgcccaagttggggatggtgg

SEQ ID NO: 6465 - DNA, 23 bp, Artificial Sequence
  HLA-A targeting gRNA
gatgcccatgatggggatggtgg

SEQ ID NO: 6466 - DNA, 23 bp, Artificial Sequence
  HLA-A targeting gRNA
gatgctgcatcccagtaatgagg

SEQ ID NO: 6467 - DNA, 23 bp, Artificial Sequence
  HLA-A targeting gRNA
gatgctgcttcccagtaatgagg

SEQ ID NO: 6468 - DNA, 23 bp, Artificial Sequence
  HLA-A targeting gRNA
gatggtcacatgggcactgttgg

SEQ ID NO: 6469 - DNA, 23 bp, Artificial Sequence
  HLA-A targeting gRNA
gatggtcacatgggcgctgctgg

SEQ ID NO: 6470 - DNA, 23 bp, Artificial Sequence
  HLA-A targeting gRNA
gatggtcacatgggcgctgttgg

SEQ ID NO: 6471 - DNA, 23 bp, Artificial Sequence
  HLA-A targeting gRNA
gatggtcacatgggtgctgttgg

SEQ ID NO: 6472 - DNA, 23 bp, Artificial Sequence
  HLA-A targeting gRNA
gatgtaagccttgccgtcgtagg

SEQ ID NO: 6473 - DNA, 23 bp, Artificial Sequence
  HLA-A targeting gRNA
gatgtaatccctgccgtcgtagg

SEQ ID NO: 6474 - DNA, 23 bp, Artificial Sequence
  HLA-A targeting gRNA
gatgtaatccttgccatcgtagg

SEQ ID NO: 6475 - DNA, 23 bp, Artificial Sequence
  HLA-A targeting gRNA
gatgtaatccttgccgtcctagg

SEQ ID NO: 6476 - DNA, 23 bp, Artificial Sequence
  HLA-A targeting gRNA
gatgtaatccttgccgtcgcagg

SEQ ID NO: 6477 - DNA, 23 bp, Artificial Sequence
  HLA-A targeting gRNA
gatgtaatctttgccgtcgtagg

SEQ ID NO: 6478 - DNA, 23 bp, Artificial Sequence
  HLA-A targeting gRNA
gatgtatcaccttgatattatgg

SEQ ID NO: 6479 - DNA, 23 bp, Artificial Sequence
  HLA-A targeting gRNA
gatgtcatccttgccgtcgtagg

SEQ ID NO: 6480 - DNA, 23 bp, Artificial Sequence
  HLA-A targeting gRNA
gattacccagcgcaagttggagg

SEQ ID NO: 6481 - DNA, 23 bp, Artificial Sequence
  HLA-A targeting gRNA
gattccagcatcatgagtcaggg

SEQ ID NO: 6482 - DNA, 23 bp, Artificial Sequence
  HLA-A targeting gRNA
gattccagcattcatgagtcagg

SEQ ID NO: 6483 - DNA, 23 bp, Artificial Sequence
  HLA-A targeting gRNA
gattccagcattcatgagtcggg

SEQ ID NO: 6484 - DNA, 23 bp, Artificial Sequence
  HLA-A targeting gRNA
gattccagcattcgtgagtcagg

SEQ ID NO: 6485 - DNA, 23 bp, Artificial Sequence
  HLA-A targeting gRNA
gatttcagcattcatgagtcagg

SEQ ID NO: 6486 - DNA, 23 bp, Artificial Sequence
  HLA-A targeting gRNA
gcaacggagagcctacctggagg

SEQ ID NO: 6487 - DNA, 23 bp, Artificial Sequence
  HLA-A targeting gRNA
gcaagaggggccggagtattggg

SEQ ID NO: 6488 - DNA, 23 bp, Artificial Sequence
  HLA-A targeting gRNA
gcaagttggaggcggcccgtggg

SEQ ID NO: 6489 - DNA, 23 bp, Artificial Sequence
  HLA-A targeting gRNA
gcaatggggaggcgcagcgttgg

SEQ ID NO: 6490 - DNA, 23 bp, Artificial Sequence
  HLA-A targeting gRNA
gcacagaacccagacaccagcgg

SEQ ID NO: 6491 - DNA, 23 bp, Artificial Sequence
  HLA-A targeting gRNA
gcacagggcccagcacctcaggg

SEQ ID NO: 6492 - DNA, 23 bp, Artificial Sequence
  HLA-A targeting gRNA
gcacatgtgacaatgaaagacgg

SEQ ID NO: 6493 - DNA, 23 bp, Artificial Sequence
  HLA-A targeting gRNA
gcacatgtgacaatgaagcacgg

SEQ ID NO: 6494 - DNA, 23 bp, Artificial Sequence
  HLA-A targeting gRNA
gcacatgtgacaatgaaggacgg

SEQ ID NO: 6495 - DNA, 23 bp, Artificial Sequence
  HLA-A targeting gRNA
gcacatgtgacaatgaaggatgg

SEQ ID NO: 6496 - DNA, 23 bp, Artificial Sequence
  HLA-A targeting gRNA
gcaccgtgacttttcctctcagg

SEQ ID NO: 6497 - DNA, 23 bp, Artificial Sequence
  HLA-A targeting gRNA
gcacggatgtatcaccttgatgg

SEQ ID NO: 6498 - DNA, 23 bp, Artificial Sequence
  HLA-A targeting gRNA
gcacgggccgcctccaacttggg

SEQ ID NO: 6499 - DNA, 23 bp, Artificial Sequence
  HLA-A targeting gRNA
gcactcacaggcccaggtctcgg

SEQ ID NO: 6500 - DNA, 23 bp, Artificial Sequence
  HLA-A targeting gRNA
gcactcaccagcccaggtctcgg

SEQ ID NO: 6501 - DNA, 23 bp, Artificial Sequence
  HLA-A targeting gRNA
gcactcacccgcccaggtctcgg

SEQ ID NO: 6502 - DNA, 23 bp, Artificial Sequence
  HLA-A targeting gRNA
gcactcaccggcccaggtctcgg

SEQ ID NO: 6503 - DNA, 23 bp, Artificial Sequence
  HLA-A targeting gRNA
gcactggggaggcgccgcgttgg

SEQ ID NO: 6504 - DNA, 23 bp, Artificial Sequence
  HLA-A targeting gRNA
gcagccaaacatccactggaggg

SEQ ID NO: 6505 - DNA, 23 bp, Artificial Sequence
  HLA-A targeting gRNA
gcagccaaacatcctctggaggg

SEQ ID NO: 6506 - DNA, 23 bp, Artificial Sequence
  HLA-A targeting gRNA
gcagccacacatccactggaggg

SEQ ID NO: 6507 - DNA, 23 bp, Artificial Sequence
  HLA-A targeting gRNA
gcagccagacatcctctggaggg

SEQ ID NO: 6508 - DNA, 23 bp, Artificial Sequence
  HLA-A targeting gRNA
gcagccagacatcctctggatgg

SEQ ID NO: 6509 - DNA, 23 bp, Artificial Sequence
  HLA-A targeting gRNA
gcagccatacatattctggaggg

SEQ ID NO: 6510 - DNA, 23 bp, Artificial Sequence
  HLA-A targeting gRNA
gcagccatacatccactggaggg

SEQ ID NO: 6511 - DNA, 23 bp, Artificial Sequence
  HLA-A targeting gRNA
gcagccatacatccgctggaggg

SEQ ID NO: 6512 - DNA, 23 bp, Artificial Sequence
  HLA-A targeting gRNA
gcagccatacatcctctggaagg

SEQ ID NO: 6513 - DNA, 23 bp, Artificial Sequence
  HLA-A targeting gRNA
gcagccatacatgctctggaggg

SEQ ID NO: 6514 - DNA, 23 bp, Artificial Sequence
  HLA-A targeting gRNA
gcagcccctcatgctgcacatgg

SEQ ID NO: 6515 - DNA, 23 bp, Artificial Sequence
  HLA-A targeting gRNA
gcagcccctcatgctgtacatgg

SEQ ID NO: 6516 - DNA, 23 bp, Artificial Sequence
  HLA-A targeting gRNA
gcagcccctcatgctgtacctgg

SEQ ID NO: 6517 - DNA, 23 bp, Artificial Sequence
  HLA-A targeting gRNA
gcagcccctcgtgctgaacatgg

SEQ ID NO: 6518 - DNA, 23 bp, Artificial Sequence
  HLA-A targeting gRNA
gcagcccctcgtgctgcacatgg

SEQ ID NO: 6519 - DNA, 23 bp, Artificial Sequence
  HLA-A targeting gRNA
gcagcccctcgtgctgcatatgg

SEQ ID NO: 6520 - DNA, 23 bp, Artificial Sequence
  HLA-A targeting gRNA
gcagccgggccgggacatggcgg

SEQ ID NO: 6521 - DNA, 23 bp, Artificial Sequence
  HLA-A targeting gRNA
gcagccgtacaagctctggaggg

SEQ ID NO: 6522 - DNA, 23 bp, Artificial Sequence
  HLA-A targeting gRNA
gcagccgtacatccactggaggg

SEQ ID NO: 6523 - DNA, 23 bp, Artificial Sequence
  HLA-A targeting gRNA
gcagccgtacatcctctggaggg

SEQ ID NO: 6524 - DNA, 23 bp, Artificial Sequence
  HLA-A targeting gRNA
gcagccgtacatcctctggatgg

SEQ ID NO: 6525 - DNA, 23 bp, Artificial Sequence
  HLA-A targeting gRNA
gcagccgtacatcctctggcggg

SEQ ID NO: 6526 - DNA, 23 bp, Artificial Sequence
  HLA-A targeting gRNA
gcagccgtacatcgtctggaggg

SEQ ID NO: 6527 - DNA, 23 bp, Artificial Sequence
  HLA-A targeting gRNA
gcagccgtacatgctctggaggg

SEQ ID NO: 6528 - DNA, 23 bp, Artificial Sequence
  HLA-A targeting gRNA
gcagcggagaacctacctggagg

SEQ ID NO: 6529 - DNA, 23 bp, Artificial Sequence
  HLA-A targeting gRNA
gcagcggagagcctacctggagg

SEQ ID NO: 6530 - DNA, 23 bp, Artificial Sequence
  HLA-A targeting gRNA
gcagctaagagcctacctggagg

SEQ ID NO: 6531 - DNA, 23 bp, Artificial Sequence
  HLA-A targeting gRNA
gcagctgagaacctacctggagg

SEQ ID NO: 6532 - DNA, 23 bp, Artificial Sequence
  HLA-A targeting gRNA
gcagctgagagcctaccgggagg

SEQ ID NO: 6533 - DNA, 23 bp, Artificial Sequence
  HLA-A targeting gRNA
gcagctgagagcctacctggtgg

SEQ ID NO: 6534 - DNA, 23 bp, Artificial Sequence
  HLA-A targeting gRNA
gcagctgagagcctgcctggagg

SEQ ID NO: 6535 - DNA, 23 bp, Artificial Sequence
  HLA-A targeting gRNA
gcagctgtgatggtgccttctgg

SEQ ID NO: 6536 - DNA, 23 bp, Artificial Sequence
  HLA-A targeting gRNA
gcagctgtggtggtgccttctgg

SEQ ID NO: 6537 - DNA, 23 bp, Artificial Sequence
  HLA-A targeting gRNA
gcaggacagagcctacctggagg

SEQ ID NO: 6538 - DNA, 23 bp, Artificial Sequence
  HLA-A targeting gRNA
gcaggaccatgagatcttagagg

SEQ ID NO: 6539 - DNA, 23 bp, Artificial Sequence
  HLA-A targeting gRNA
gcaggaggggccagagtattggg

SEQ ID NO: 6540 - DNA, 23 bp, Artificial Sequence
  HLA-A targeting gRNA
gcaggaggggccggaatattggg

SEQ ID NO: 6541 - DNA, 23 bp, Artificial Sequence
  HLA-A targeting gRNA
gcaggaggggccggagcattggg

SEQ ID NO: 6542 - DNA, 23 bp, Artificial Sequence
  HLA-A targeting gRNA
gcaggaggggccggagtactggg

SEQ ID NO: 6543 - DNA, 23 bp, Artificial Sequence
  HLA-A targeting gRNA
gcaggaggggccggagtattagg

SEQ ID NO: 6544 - DNA, 23 bp, Artificial Sequence
  HLA-A targeting gRNA
gcaggaggggccggagtgttggg

SEQ ID NO: 6545 - DNA, 23 bp, Artificial Sequence
  HLA-A targeting gRNA
gcaggaggggctggagtattggg

SEQ ID NO: 6546 - DNA, 23 bp, Artificial Sequence
  HLA-A targeting gRNA
gcaggaggtgccggaggattggg

SEQ ID NO: 6547 - DNA, 23 bp, Artificial Sequence
  HLA-A targeting gRNA
gcaggatccgcaggctctctcgg

SEQ ID NO: 6548 - DNA, 23 bp, Artificial Sequence
  HLA-A targeting gRNA
gcaggcgccgtgggtggagcagg

SEQ ID NO: 6549 - DNA, 23 bp, Artificial Sequence
  HLA-A targeting gRNA
gcaggcgggggcgcaggacccgg

SEQ ID NO: 6550 - DNA, 23 bp, Artificial Sequence
  HLA-A targeting gRNA
gcaggcgggggctcaggacccgg

SEQ ID NO: 6551 - DNA, 23 bp, Artificial Sequence
  HLA-A targeting gRNA
gcagggaaatggcctctgtaggg

SEQ ID NO: 6552 - DNA, 23 bp, Artificial Sequence
  HLA-A targeting gRNA
gcagggaaatggcctctgtgggg

SEQ ID NO: 6553 - DNA, 23 bp, Artificial Sequence
  HLA-A targeting gRNA
gcagggaacacttctacctgggg

SEQ ID NO: 6554 - DNA, 23 bp, Artificial Sequence
  HLA-A targeting gRNA
gcagggccatgagatcttagagg

SEQ ID NO: 6555 - DNA, 23 bp, Artificial Sequence
  HLA-A targeting gRNA
gcagggccatgcaatcttagggg

SEQ ID NO: 6556 - DNA, 23 bp, Artificial Sequence
  HLA-A targeting gRNA
gcagggccatgcgatcttagggg

SEQ ID NO: 6557 - DNA, 23 bp, Artificial Sequence
  HLA-A targeting gRNA
gcagggccatgtgatcttagggg

SEQ ID NO: 6558 - DNA, 23 bp, Artificial Sequence
  HLA-A targeting gRNA
gcagggccatgtgattttagggg

SEQ ID NO: 6559 - DNA, 23 bp, Artificial Sequence
  HLA-A targeting gRNA
gcaggggggtggtggggcagagg

SEQ ID NO: 6560 - DNA, 23 bp, Artificial Sequence
  HLA-A targeting gRNA
gcagggtccgcaggctctctcgg

SEQ ID NO: 6561 - DNA, 23 bp, Artificial Sequence
  HLA-A targeting gRNA
gcagggtccgcaggtcctctcgg

SEQ ID NO: 6562 - DNA, 23 bp, Artificial Sequence
  HLA-A targeting gRNA
gcaggttccgcaggcccactcgg

SEQ ID NO: 6563 - DNA, 23 bp, Artificial Sequence
  HLA-A targeting gRNA
gcaggttccgcaggctcactcgg

SEQ ID NO: 6564 - DNA, 23 bp, Artificial Sequence
  HLA-A targeting gRNA
gcaggttccgcaggctctctcgg

SEQ ID NO: 6565 - DNA, 23 bp, Artificial Sequence
  HLA-A targeting gRNA
gcaggttccgcaggtcctctcgg

SEQ ID NO: 6566 - DNA, 23 bp, Artificial Sequence
  HLA-A targeting gRNA
gcaggttccgcaggttcactcgg

SEQ ID NO: 6567 - DNA, 23 bp, Artificial Sequence
  HLA-A targeting gRNA
gcaggttccgcaggttctctcgg

SEQ ID NO: 6568 - DNA, 23 bp, Artificial Sequence
  HLA-A targeting gRNA
gcaggtttcgcaggctctctcgg

SEQ ID NO: 6569 - DNA, 23 bp, Artificial Sequence
  HLA-A targeting gRNA
gcagtatgcctacgacggcaagg

SEQ ID NO: 6570 - DNA, 23 bp, Artificial Sequence
  HLA-A targeting gRNA
gcagtgcagagcctacctggagg

SEQ ID NO: 6571 - DNA, 23 bp, Artificial Sequence
  HLA-A targeting gRNA
gcagtggagagcccacctggagg

SEQ ID NO: 6572 - DNA, 23 bp, Artificial Sequence
  HLA-A targeting gRNA
gcagtggagagtctacctggagg

SEQ ID NO: 6573 - DNA, 23 bp, Artificial Sequence
  HLA-A targeting gRNA
gcagtggtcaaagtggtcaaagg

SEQ ID NO: 6574 - DNA, 23 bp, Artificial Sequence
  HLA-A targeting gRNA
gcagtggtcgaagtggtcaaagg

SEQ ID NO: 6575 - DNA, 23 bp, Artificial Sequence
  HLA-A targeting gRNA
gcagttgccgcaggttcactcgg

SEQ ID NO: 6576 - DNA, 23 bp, Artificial Sequence
  HLA-A targeting gRNA
gcagtttccgcaggctcactcgg

SEQ ID NO: 6577 - DNA, 23 bp, Artificial Sequence
  HLA-A targeting gRNA
gcagtttccgcaggttcactcgg

SEQ ID NO: 6578 - DNA, 23 bp, Artificial Sequence
  HLA-A targeting gRNA
gcagtttccgcaggttcattcgg

SEQ ID NO: 6579 - DNA, 23 bp, Artificial Sequence
  HLA-A targeting gRNA
gcatggcctcccacgaggagggg

SEQ ID NO: 6580 - DNA, 23 bp, Artificial Sequence
  HLA-A targeting gRNA
gcatgtacggctgcgacctgggg

SEQ ID NO: 6581 - DNA, 23 bp, Artificial Sequence
  HLA-A targeting gRNA
gcatgtacggctgcgacgtgggg

SEQ ID NO: 6582 - DNA, 23 bp, Artificial Sequence
  HLA-A targeting gRNA
gcatgtatggctgcgacgtgggg

SEQ ID NO: 6583 - DNA, 23 bp, Artificial Sequence
  HLA-A targeting gRNA
gcattggggaggcgcagcattgg

SEQ ID NO: 6584 - DNA, 23 bp, Artificial Sequence
  HLA-A targeting gRNA
gcattggggaggcgcagcgttgg

SEQ ID NO: 6585 - DNA, 23 bp, Artificial Sequence
  HLA-A targeting gRNA
gcattggggaggcgccgcgttgg

SEQ ID NO: 6586 - DNA, 23 bp, Artificial Sequence
  HLA-A targeting gRNA
gccacgtcccggcccggccgcgg

SEQ ID NO: 6587 - DNA, 23 bp, Artificial Sequence
  HLA-A targeting gRNA
gccagaaacgatgcccaagttgg

SEQ ID NO: 6588 - DNA, 23 bp, Artificial Sequence
  HLA-A targeting gRNA
gccagaccctcctcccggcgcgg

SEQ ID NO: 6589 - DNA, 23 bp, Artificial Sequence
  HLA-A targeting gRNA
gccagcaacaatgcccacgatgg

SEQ ID NO: 6590 - DNA, 23 bp, Artificial Sequence
  HLA-A targeting gRNA
gccagcaacgatgcccacgatgg

SEQ ID NO: 6591 - DNA, 23 bp, Artificial Sequence
  HLA-A targeting gRNA
gccagcaacgatgcccatgatgg

SEQ ID NO: 6592 - DNA, 23 bp, Artificial Sequence
  HLA-A targeting gRNA
gccaggacagccaggacagctgg

SEQ ID NO: 6593 - DNA, 23 bp, Artificial Sequence
  HLA-A targeting gRNA
gccagggtctcacatcatccagg

SEQ ID NO: 6594 - DNA, 23 bp, Artificial Sequence
  HLA-A targeting gRNA
gccaggtcagggctgaggcttgg

SEQ ID NO: 6595 - DNA, 23 bp, Artificial Sequence
  HLA-A targeting gRNA
gccagtgagtgaccccggcccgg

SEQ ID NO: 6596 - DNA, 23 bp, Artificial Sequence
  HLA-A targeting gRNA
gccatgacccggcccggccgcgg

SEQ ID NO: 6597 - DNA, 23 bp, Artificial Sequence
  HLA-A targeting gRNA
gccatgtcccggcccggccgcgg

SEQ ID NO: 6598 - DNA, 23 bp, Artificial Sequence
  HLA-A targeting gRNA
gccatgtcccggcccggccgtgg

SEQ ID NO: 6599 - DNA, 23 bp, Artificial Sequence
  HLA-A targeting gRNA
gccatgtcccggcccggctgcgg

SEQ ID NO: 6600 - DNA, 23 bp, Artificial Sequence
  HLA-A targeting gRNA
gccatgtcccggcctggccgcgg

SEQ ID NO: 6601 - DNA, 23 bp, Artificial Sequence
  HLA-A targeting gRNA
gccattctccattcaacggaggg

SEQ ID NO: 6602 - DNA, 23 bp, Artificial Sequence
  HLA-A targeting gRNA
gccattctccattcaagggaggg

SEQ ID NO: 6603 - DNA, 23 bp, Artificial Sequence
  HLA-A targeting gRNA
gcccacaggagacgtgggacagg

SEQ ID NO: 6604 - DNA, 23 bp, Artificial Sequence
  HLA-A targeting gRNA
gcccatggcccagcacctcaggg

SEQ ID NO: 6605 - DNA, 23 bp, Artificial Sequence
  HLA-A targeting gRNA
gccccgccccgaccaacccgcgg

SEQ ID NO: 6606 - DNA, 23 bp, Artificial Sequence
  HLA-A targeting gRNA
gccccgccccgcccaacccgcgg

SEQ ID NO: 6607 - DNA, 23 bp, Artificial Sequence
  HLA-A targeting gRNA
gccccgccctgaccaacccgcgg

SEQ ID NO: 6608 - DNA, 23 bp, Artificial Sequence
  HLA-A targeting gRNA
gcccgacccacctcccggcgcgg

SEQ ID NO: 6609 - DNA, 23 bp, Artificial Sequence
  HLA-A targeting gRNA
gcccgacccacctccctgcgcgg

SEQ ID NO: 6610 - DNA, 23 bp, Artificial Sequence
  HLA-A targeting gRNA
gcccgaccctcctaccggcgcgg

SEQ ID NO: 6611 - DNA, 23 bp, Artificial Sequence
  HLA-A targeting gRNA
gcccgaccctcctccctgcgcgg

SEQ ID NO: 6612 - DNA, 23 bp, Artificial Sequence
  HLA-A targeting gRNA
gcccgcaggagacgtgggacagg

SEQ ID NO: 6613 - DNA, 23 bp, Artificial Sequence
  HLA-A targeting gRNA
gcccgcaggagacgttggacagg

SEQ ID NO: 6614 - DNA, 23 bp, Artificial Sequence
  HLA-A targeting gRNA
gcccgggatggcctcccacgagg

SEQ ID NO: 6615 - DNA, 23 bp, Artificial Sequence
  HLA-A targeting gRNA
gccctcaggagacgtgggacagg

SEQ ID NO: 6616 - DNA, 23 bp, Artificial Sequence
  HLA-A targeting gRNA
gccctcccttgaatggaaaatgg

SEQ ID NO: 6617 - DNA, 23 bp, Artificial Sequence
  HLA-A targeting gRNA
gccctcccttgaatggagaatgg

SEQ ID NO: 6618 - DNA, 23 bp, Artificial Sequence
  HLA-A targeting gRNA
gccctccgttgaatggagaatgg

SEQ ID NO: 6619 - DNA, 23 bp, Artificial Sequence
  HLA-A targeting gRNA
gccctcctcctgctgctctcggg

SEQ ID NO: 6620 - DNA, 23 bp, Artificial Sequence
  HLA-A targeting gRNA
gccctgaccgagacctgggccgg

SEQ ID NO: 6621 - DNA, 23 bp, Artificial Sequence
  HLA-A targeting gRNA
gccctgaccgagacctgggcggg

SEQ ID NO: 6622 - DNA, 23 bp, Artificial Sequence
  HLA-A targeting gRNA
gccctgaccgagacctgggctgg

SEQ ID NO: 6623 - DNA, 23 bp, Artificial Sequence
  HLA-A targeting gRNA
gccctgatcgagacctggaccgg

SEQ ID NO: 6624 - DNA, 23 bp, Artificial Sequence
  HLA-A targeting gRNA
gccctgatcgagacctgggccgg

SEQ ID NO: 6625 - DNA, 23 bp, Artificial Sequence
  HLA-A targeting gRNA
gccgaaggactcagaaaagctgg

SEQ ID NO: 6626 - DNA, 23 bp, Artificial Sequence
  HLA-A targeting gRNA
gccgaaggactcagaaaagttgg

SEQ ID NO: 6627 - DNA, 23 bp, Artificial Sequence
  HLA-A targeting gRNA
gccgcgcagggaggagggtcggg

SEQ ID NO: 6628 - DNA, 23 bp, Artificial Sequence
  HLA-A targeting gRNA
gccgcgcagggaggtgggtcggg

SEQ ID NO: 6629 - DNA, 23 bp, Artificial Sequence
  HLA-A targeting gRNA
gccgcgccgggaggagggtctgg

SEQ ID NO: 6630 - DNA, 23 bp, Artificial Sequence
  HLA-A targeting gRNA
gccgcgccgggaggtgggtcggg

SEQ ID NO: 6631 - DNA, 23 bp, Artificial Sequence
  HLA-A targeting gRNA
gccgcgccggtaggagggtcggg

SEQ ID NO: 6632 - DNA, 23 bp, Artificial Sequence
  HLA-A targeting gRNA
gccgcgggcgccgtgggtggagg

SEQ ID NO: 6633 - DNA, 23 bp, Artificial Sequence
  HLA-A targeting gRNA
gccggacggagtattgggaccgg

SEQ ID NO: 6634 - DNA, 23 bp, Artificial Sequence
  HLA-A targeting gRNA
gccgggagatctacgggagatgg

SEQ ID NO: 6635 - DNA, 23 bp, Artificial Sequence
  HLA-A targeting gRNA
gccgggccaggacacggatgtgg

SEQ ID NO: 6636 - DNA, 23 bp, Artificial Sequence
  HLA-A targeting gRNA
gccgggtcagggctgaggcttgg

SEQ ID NO: 6637 - DNA, 23 bp, Artificial Sequence
  HLA-A targeting gRNA
gccggtgagtgaccccggcctgg

SEQ ID NO: 6638 - DNA, 23 bp, Artificial Sequence
  HLA-A targeting gRNA
gccggtgagtgcgggtcggcagg

SEQ ID NO: 6639 - DNA, 23 bp, Artificial Sequence
  HLA-A targeting gRNA
gccggtgagtgcgggtcgggagg

SEQ ID NO: 6640 - DNA, 23 bp, Artificial Sequence
  HLA-A targeting gRNA
gccgtacgtcggggttggggagg

SEQ ID NO: 6641 - DNA, 23 bp, Artificial Sequence
  HLA-A targeting gRNA
gccgtccgtgggggatgaggagg

SEQ ID NO: 6642 - DNA, 23 bp, Artificial Sequence
  HLA-A targeting gRNA
gccgtccgtgggggatggggagg

SEQ ID NO: 6643 - DNA, 23 bp, Artificial Sequence
  HLA-A targeting gRNA
gccgtgggtggaggaggggccgg

SEQ ID NO: 6644 - DNA, 23 bp, Artificial Sequence
  HLA-A targeting gRNA
gccgtgtcccggccaggccgcgg

SEQ ID NO: 6645 - DNA, 23 bp, Artificial Sequence
  HLA-A targeting gRNA
gccgtgtcccggcccggccgcgg

SEQ ID NO: 6646 - DNA, 23 bp, Artificial Sequence
  HLA-A targeting gRNA
gccgtgtcccggcctggccgcgg

SEQ ID NO: 6647 - DNA, 23 bp, Artificial Sequence
  HLA-A targeting gRNA
gccgtgtccgccaggagctcagg

SEQ ID NO: 6648 - DNA, 23 bp, Artificial Sequence
  HLA-A targeting gRNA
gccgtgtccgggcccggccgcgg

SEQ ID NO: 6649 - DNA, 23 bp, Artificial Sequence
  HLA-A targeting gRNA
gccgtgtcctggcccggccgcgg

SEQ ID NO: 6650 - DNA, 23 bp, Artificial Sequence
  HLA-A targeting gRNA
gcctaaaccgaaaatgaaaccgg

SEQ ID NO: 6651 - DNA, 23 bp, Artificial Sequence
  HLA-A targeting gRNA
gcctaaactgaaaacgaaaccgg

SEQ ID NO: 6652 - DNA, 23 bp, Artificial Sequence
  HLA-A targeting gRNA
gcctcaactgaaaatgaaaccgg

SEQ ID NO: 6653 - DNA, 23 bp, Artificial Sequence
  HLA-A targeting gRNA
gcctcacactcagtgtgtttggg

SEQ ID NO: 6654 - DNA, 23 bp, Artificial Sequence
  HLA-A targeting gRNA
gcctcctccgcgggtatgaccgg

SEQ ID NO: 6655 - DNA, 23 bp, Artificial Sequence
  HLA-A targeting gRNA
gcctcggggtggatctcagacgg

SEQ ID NO: 6656 - DNA, 23 bp, Artificial Sequence
  HLA-A targeting gRNA
gcctctatggagaggagcgaggg

SEQ ID NO: 6657 - DNA, 23 bp, Artificial Sequence
  HLA-A targeting gRNA
gcctctgccgggaggagcgaggg

SEQ ID NO: 6658 - DNA, 23 bp, Artificial Sequence
  HLA-A targeting gRNA
gcctctgcggagaggagcgaggg

SEQ ID NO: 6659 - DNA, 23 bp, Artificial Sequence
  HLA-A targeting gRNA
gcctctgcggagaggagggaggg

SEQ ID NO: 6660 - DNA, 23 bp, Artificial Sequence
  HLA-A targeting gRNA
gcctctgctgagaggagcgaggg

SEQ ID NO: 6661 - DNA, 23 bp, Artificial Sequence
  HLA-A targeting gRNA
gcctctggggagaggagcgaggg

SEQ ID NO: 6662 - DNA, 23 bp, Artificial Sequence
  HLA-A targeting gRNA
gcctctgtagggaggagcaaggg

SEQ ID NO: 6663 - DNA, 23 bp, Artificial Sequence
  HLA-A targeting gRNA
gcctctgtggggaggagagaggg

SEQ ID NO: 6664 - DNA, 23 bp, Artificial Sequence
  HLA-A targeting gRNA
gcctctgtggggaggagcgaggg

SEQ ID NO: 6665 - DNA, 23 bp, Artificial Sequence
  HLA-A targeting gRNA
gcctgagacagctgcctgtgtgg

SEQ ID NO: 6666 - DNA, 23 bp, Artificial Sequence
  HLA-A targeting gRNA
gcctgcatccgctggtgtctggg

SEQ ID NO: 6667 - DNA, 23 bp, Artificial Sequence
  HLA-A targeting gRNA
gcctgcgtccgctggtgtctggg

SEQ ID NO: 6668 - DNA, 23 bp, Artificial Sequence
  HLA-A targeting gRNA
gcctggagtagaacaaaaacagg

SEQ ID NO: 6669 - DNA, 23 bp, Artificial Sequence
  HLA-A targeting gRNA
gcctggagtagaaccaaaacagg

SEQ ID NO: 6670 - DNA, 23 bp, Artificial Sequence
  HLA-A targeting gRNA
gcctggccctgaccgagacctgg

SEQ ID NO: 6671 - DNA, 23 bp, Artificial Sequence
  HLA-A targeting gRNA
gccttgatggttgtggtgttggg

SEQ ID NO: 6672 - DNA, 23 bp, Artificial Sequence
  HLA-A targeting gRNA
gcgaccccgcgagtccgagaggg

SEQ ID NO: 6673 - DNA, 23 bp, Artificial Sequence
  HLA-A targeting gRNA
gcgaccccggccgtacgtggggg

SEQ ID NO: 6674 - DNA, 23 bp, Artificial Sequence
  HLA-A targeting gRNA
gcgacccgggccgtacgtggggg

SEQ ID NO: 6675 - DNA, 23 bp, Artificial Sequence
  HLA-A targeting gRNA
gcgacccgggccgtccgtggggg

SEQ ID NO: 6676 - DNA, 23 bp, Artificial Sequence
  HLA-A targeting gRNA
gcgacgccgcaagtccgagaggg

SEQ ID NO: 6677 - DNA, 23 bp, Artificial Sequence
  HLA-A targeting gRNA
gcgacgccgcgagtccaagaggg

SEQ ID NO: 6678 - DNA, 23 bp, Artificial Sequence
  HLA-A targeting gRNA
gcgacgccgcgagtccgagaagg

SEQ ID NO: 6679 - DNA, 23 bp, Artificial Sequence
  HLA-A targeting gRNA
gcgacgccgcgagtccgagaggg

SEQ ID NO: 6680 - DNA, 23 bp, Artificial Sequence
  HLA-A targeting gRNA
gcgacgccgcgagtccgaggggg

SEQ ID NO: 6681 - DNA, 23 bp, Artificial Sequence
  HLA-A targeting gRNA
gcgactccgcgagtccaagaggg

SEQ ID NO: 6682 - DNA, 23 bp, Artificial Sequence
  HLA-A targeting gRNA
gcgagaccggtgagtgaccccgg

SEQ ID NO: 6683 - DNA, 23 bp, Artificial Sequence
  HLA-A targeting gRNA
gcgaggaccgtgagtgaccccgg

SEQ ID NO: 6684 - DNA, 23 bp, Artificial Sequence
  HLA-A targeting gRNA
gcgaggccagtgagtgaccccgg

SEQ ID NO: 6685 - DNA, 23 bp, Artificial Sequence
  HLA-A targeting gRNA
gcgaggggcccgcccggcgaggg

SEQ ID NO: 6686 - DNA, 23 bp, Artificial Sequence
  HLA-A targeting gRNA
gcgaggggccctcccggcgaggg

SEQ ID NO: 6687 - DNA, 23 bp, Artificial Sequence
  HLA-A targeting gRNA
gcgcaagtgggaggcggcccggg

SEQ ID NO: 6688 - DNA, 23 bp, Artificial Sequence
  HLA-A targeting gRNA
gcgcagggaggagggtcgggcgg

SEQ ID NO: 6689 - DNA, 23 bp, Artificial Sequence
  HLA-A targeting gRNA
gcgcagggaggtgggtcgggcgg

SEQ ID NO: 6690 - DNA, 23 bp, Artificial Sequence
  HLA-A targeting gRNA
gcgcaggtaccaggggcagtggg

SEQ ID NO: 6691 - DNA, 23 bp, Artificial Sequence
  HLA-A targeting gRNA
gcgccatggatagagcaagaggg

SEQ ID NO: 6692 - DNA, 23 bp, Artificial Sequence
  HLA-A targeting gRNA
gcgccatggatagagcaggaggg

SEQ ID NO: 6693 - DNA, 23 bp, Artificial Sequence
  HLA-A targeting gRNA
gcgcccgcggctccccttctcgg

SEQ ID NO: 6694 - DNA, 23 bp, Artificial Sequence
  HLA-A targeting gRNA
gcgccctggatagagcaggaggg

SEQ ID NO: 6695 - DNA, 23 bp, Artificial Sequence
  HLA-A targeting gRNA
gcgccgggaggagggtctggcgg

SEQ ID NO: 6696 - DNA, 23 bp, Artificial Sequence
  HLA-A targeting gRNA
gcgccgggaggtgggtcgggcgg

SEQ ID NO: 6697 - DNA, 23 bp, Artificial Sequence
  HLA-A targeting gRNA
gcgccggtaggagggtcgggcgg

SEQ ID NO: 6698 - DNA, 23 bp, Artificial Sequence
  HLA-A targeting gRNA
gcgccgtggatagagcaagaggg

SEQ ID NO: 6699 - DNA, 23 bp, Artificial Sequence
  HLA-A targeting gRNA
gcgccgtgggtggagaaggaggg

SEQ ID NO: 6700 - DNA, 23 bp, Artificial Sequence
  HLA-A targeting gRNA
gcgccgtgggtggagcaggaggg

SEQ ID NO: 6701 - DNA, 23 bp, Artificial Sequence
  HLA-A targeting gRNA
gcgcctccccaatgcagacaagg

SEQ ID NO: 6702 - DNA, 23 bp, Artificial Sequence
  HLA-A targeting gRNA
gcgcctccccaatgcagacacgg

SEQ ID NO: 6703 - DNA, 23 bp, Artificial Sequence
  HLA-A targeting gRNA
gcgcctccccaatgcagacgcgg

SEQ ID NO: 6704 - DNA, 23 bp, Artificial Sequence
  HLA-A targeting gRNA
gcgcctccccagtgcagacacgg

SEQ ID NO: 6705 - DNA, 23 bp, Artificial Sequence
  HLA-A targeting gRNA
gcgcctccccattgcagacgcgg

SEQ ID NO: 6706 - DNA, 23 bp, Artificial Sequence
  HLA-A targeting gRNA
gcgcgatcctcaggttctctcgg

SEQ ID NO: 6707 - DNA, 23 bp, Artificial Sequence
  HLA-A targeting gRNA
gcgcgcgggtaccggggcagtgg

SEQ ID NO: 6708 - DNA, 23 bp, Artificial Sequence
  HLA-A targeting gRNA
gcgcggctacaaccagagcgagg

SEQ ID NO: 6709 - DNA, 23 bp, Artificial Sequence
  HLA-A targeting gRNA
gcgcgggtaccaagggcagtggg

SEQ ID NO: 6710 - DNA, 23 bp, Artificial Sequence
  HLA-A targeting gRNA
gcgcgggtaccaggggcagtggg

SEQ ID NO: 6711 - DNA, 23 bp, Artificial Sequence
  HLA-A targeting gRNA
gcgcgggtaccggggcagtgggg

SEQ ID NO: 6712 - DNA, 23 bp, Artificial Sequence
  HLA-A targeting gRNA
gcgcggtgcgcaggctctctcgg

SEQ ID NO: 6713 - DNA, 23 bp, Artificial Sequence
  HLA-A targeting gRNA
gcgcggtgcgcaggttctctcgg

SEQ ID NO: 6714 - DNA, 23 bp, Artificial Sequence
  HLA-A targeting gRNA
gcgcggtggatagagcaggaggg

SEQ ID NO: 6715 - DNA, 23 bp, Artificial Sequence
  HLA-A targeting gRNA
gcgctgagtgatctgagccgcgg

SEQ ID NO: 6716 - DNA, 23 bp, Artificial Sequence
  HLA-A targeting gRNA
gcgctgggtaatctgagccgcgg

SEQ ID NO: 6717 - DNA, 23 bp, Artificial Sequence
  HLA-A targeting gRNA
gcgctgggtgatctaagccgcgg

SEQ ID NO: 6718 - DNA, 23 bp, Artificial Sequence
  HLA-A targeting gRNA
gcgctgggtgatctgagccgcgg

SEQ ID NO: 6719 - DNA, 23 bp, Artificial Sequence
  HLA-A targeting gRNA
gcgctggtaccaggggcagtggg

SEQ ID NO: 6720 - DNA, 23 bp, Artificial Sequence
  HLA-A targeting gRNA
gcggaacccgcccagaccctcgg

SEQ ID NO: 6721 - DNA, 23 bp, Artificial Sequence
  HLA-A targeting gRNA
gcggatgtatggctgcgacctgg

SEQ ID NO: 6722 - DNA, 23 bp, Artificial Sequence
  HLA-A targeting gRNA
gcggccaggccgggacacggagg

SEQ ID NO: 6723 - DNA, 23 bp, Artificial Sequence
  HLA-A targeting gRNA
gcggccaggccgggacacggcgg

SEQ ID NO: 6724 - DNA, 23 bp, Artificial Sequence
  HLA-A targeting gRNA
gcggccaggccgggacatggcgg

SEQ ID NO: 6725 - DNA, 23 bp, Artificial Sequence
  HLA-A targeting gRNA
gcggccgggccaggacacggcgg

SEQ ID NO: 6726 - DNA, 23 bp, Artificial Sequence
  HLA-A targeting gRNA
gcggccgggcccggacacggcgg

SEQ ID NO: 6727 - DNA, 23 bp, Artificial Sequence
  HLA-A targeting gRNA
gcggccgggccgggacacagcgg

SEQ ID NO: 6728 - DNA, 23 bp, Artificial Sequence
  HLA-A targeting gRNA
gcggccgggccgggacacggcgg

SEQ ID NO: 6729 - DNA, 23 bp, Artificial Sequence
  HLA-A targeting gRNA
gcggccgggccgggacatagcgg

SEQ ID NO: 6730 - DNA, 23 bp, Artificial Sequence
  HLA-A targeting gRNA
gcggccgggccgggacatggcgg

SEQ ID NO: 6731 - DNA, 23 bp, Artificial Sequence
  HLA-A targeting gRNA
gcggccgggccgggacgtggcgg

SEQ ID NO: 6732 - DNA, 23 bp, Artificial Sequence
  HLA-A targeting gRNA
gcggccgggccgggtcatggcgg

SEQ ID NO: 6733 - DNA, 23 bp, Artificial Sequence
  HLA-A targeting gRNA
gcggcctcgggggcggatctcgg

SEQ ID NO: 6734 - DNA, 23 bp, Artificial Sequence
  HLA-A targeting gRNA
gcggcctggccgggacacggcgg

SEQ ID NO: 6735 - DNA, 23 bp, Artificial Sequence
  HLA-A targeting gRNA
gcggcgcagggaggagggtcggg

SEQ ID NO: 6736 - DNA, 23 bp, Artificial Sequence
  HLA-A targeting gRNA
gcggcgcagggaggtgggtcggg

SEQ ID NO: 6737 - DNA, 23 bp, Artificial Sequence
  HLA-A targeting gRNA
gcggctgggccgggacacagcgg

SEQ ID NO: 6738 - DNA, 23 bp, Artificial Sequence
  HLA-A targeting gRNA
gcgggacggggctgaccacgggg

SEQ ID NO: 6739 - DNA, 23 bp, Artificial Sequence
  HLA-A targeting gRNA
gcgggagccgtggatggagcagg

SEQ ID NO: 6740 - DNA, 23 bp, Artificial Sequence
  HLA-A targeting gRNA
gcgggagccgtgggtggagcagg

SEQ ID NO: 6741 - DNA, 23 bp, Artificial Sequence
  HLA-A targeting gRNA
gcgggcgccatggatagagcagg

SEQ ID NO: 6742 - DNA, 23 bp, Artificial Sequence
  HLA-A targeting gRNA
gcgggcgccctggatagagcagg

SEQ ID NO: 6743 - DNA, 23 bp, Artificial Sequence
  HLA-A targeting gRNA
gcgggcgccgtgggtggagaagg

SEQ ID NO: 6744 - DNA, 23 bp, Artificial Sequence
  HLA-A targeting gRNA
gcgggcgccgtgggtggagcagg

SEQ ID NO: 6745 - DNA, 23 bp, Artificial Sequence
  HLA-A targeting gRNA
gcgggcgccgtgggtggaggagg

SEQ ID NO: 6746 - DNA, 23 bp, Artificial Sequence
  HLA-A targeting gRNA
gcgggcgcggtggatagagcagg

SEQ ID NO: 6747 - DNA, 23 bp, Artificial Sequence
  HLA-A targeting gRNA
gcggggcacacttctacctgggg

SEQ ID NO: 6748 - DNA, 23 bp, Artificial Sequence
  HLA-A targeting gRNA
gcggggcggggccggggggacgg

SEQ ID NO: 6749 - DNA, 23 bp, Artificial Sequence
  HLA-A targeting gRNA
gcggggcggggcggggccggggg

SEQ ID NO: 6750 - DNA, 23 bp, Artificial Sequence
  HLA-A targeting gRNA
gcggggcggggcggggctcgggg

SEQ ID NO: 6751 - DNA, 23 bp, Artificial Sequence
  HLA-A targeting gRNA
gcggggcggggctcgggggacgg

SEQ ID NO: 6752 - DNA, 23 bp, Artificial Sequence
  HLA-A targeting gRNA
gcggggggggtggggtggggagg

SEQ ID NO: 6753 - DNA, 23 bp, Artificial Sequence
  HLA-A targeting gRNA
gcgggtcccgcggcctcaggggg

SEQ ID NO: 6754 - DNA, 23 bp, Artificial Sequence
  HLA-A targeting gRNA
gcgggtgagtgcgggtcggcagg

SEQ ID NO: 6755 - DNA, 23 bp, Artificial Sequence
  HLA-A targeting gRNA
gcgggttgggcggggcggggcgg

SEQ ID NO: 6756 - DNA, 23 bp, Artificial Sequence
  HLA-A targeting gRNA
gcgggttggtcagggcggggcgg

SEQ ID NO: 6757 - DNA, 23 bp, Artificial Sequence
  HLA-A targeting gRNA
gcgggttggtcggggcggggcgg

SEQ ID NO: 6758 - DNA, 23 bp, Artificial Sequence
  HLA-A targeting gRNA
gcgtccagcgacagtgcccaggg

SEQ ID NO: 6759 - DNA, 23 bp, Artificial Sequence
  HLA-A targeting gRNA
gcgtctccttcccattctccagg

SEQ ID NO: 6760 - DNA, 23 bp, Artificial Sequence
  HLA-A targeting gRNA
gcgtctccttcccattcttcagg

SEQ ID NO: 6761 - DNA, 23 bp, Artificial Sequence
  HLA-A targeting gRNA
gcgtctccttccctttctccagg

SEQ ID NO: 6762 - DNA, 23 bp, Artificial Sequence
  HLA-A targeting gRNA
gcgtctccttccctttcttcagg

SEQ ID NO: 6763 - DNA, 23 bp, Artificial Sequence
  HLA-A targeting gRNA
gcgtctccttccggttctccagg

SEQ ID NO: 6764 - DNA, 23 bp, Artificial Sequence
  HLA-A targeting gRNA
gcgtctccttcctgttctccagg

SEQ ID NO: 6765 - DNA, 23 bp, Artificial Sequence
  HLA-A targeting gRNA
gcgtctctgaggaaatggagggg

SEQ ID NO: 6766 - DNA, 23 bp, Artificial Sequence
  HLA-A targeting gRNA
gcgtctctttcccgttctccagg

SEQ ID NO: 6767 - DNA, 23 bp, Artificial Sequence
  HLA-A targeting gRNA
gcgtcttcttcccgttccccagg

SEQ ID NO: 6768 - DNA, 23 bp, Artificial Sequence
  HLA-A targeting gRNA
gcgtcttcttcccgttctccagg

SEQ ID NO: 6769 - DNA, 23 bp, Artificial Sequence
  HLA-A targeting gRNA
gcgtcttcttcctgttctccagg

SEQ ID NO: 6770 - DNA, 23 bp, Artificial Sequence
  HLA-A targeting gRNA
gcgtgtccttcccgttctccagg

SEQ ID NO: 6771 - DNA, 23 bp, Artificial Sequence
  HLA-A targeting gRNA
gctaaggacagaccttaggaggg

SEQ ID NO: 6772 - DNA, 23 bp, Artificial Sequence
  HLA-A targeting gRNA
gctacgccgcgagtccaagaggg

SEQ ID NO: 6773 - DNA, 23 bp, Artificial Sequence
  HLA-A targeting gRNA
gctatgtcccggcccggccgcgg

SEQ ID NO: 6774 - DNA, 23 bp, Artificial Sequence
  HLA-A targeting gRNA
gctcaggtagggaaggggtgagg

SEQ ID NO: 6775 - DNA, 23 bp, Artificial Sequence
  HLA-A targeting gRNA
gctcaggtagggaaggggtgggg

SEQ ID NO: 6776 - DNA, 23 bp, Artificial Sequence
  HLA-A targeting gRNA
gctcccctctcggactcgcgggg

SEQ ID NO: 6777 - DNA, 23 bp, Artificial Sequence
  HLA-A targeting gRNA
gctccctccttttccacctgtgg

SEQ ID NO: 6778 - DNA, 23 bp, Artificial Sequence
  HLA-A targeting gRNA
gctctcgccggtcgagggtctgg

SEQ ID NO: 6779 - DNA, 23 bp, Artificial Sequence
  HLA-A targeting gRNA
gctctcgccggtcgagggtttgg

SEQ ID NO: 6780 - DNA, 23 bp, Artificial Sequence
  HLA-A targeting gRNA
gctctctccggccgagggtctgg

SEQ ID NO: 6781 - DNA, 23 bp, Artificial Sequence
  HLA-A targeting gRNA
gctctctccggtcgagggtctgg

SEQ ID NO: 6782 - DNA, 23 bp, Artificial Sequence
  HLA-A targeting gRNA
gctctctgcggtcgaggttctgg

SEQ ID NO: 6783 - DNA, 23 bp, Artificial Sequence
  HLA-A targeting gRNA
gctctgaccaggtcctgttttgg

SEQ ID NO: 6784 - DNA, 23 bp, Artificial Sequence
  HLA-A targeting gRNA
gctgaagaactcagaaaagctgg

SEQ ID NO: 6785 - DNA, 23 bp, Artificial Sequence
  HLA-A targeting gRNA
gctgcaacctggggcccgacggg

SEQ ID NO: 6786 - DNA, 23 bp, Artificial Sequence
  HLA-A targeting gRNA
gctgcaacgcgcgggtaccaggg

SEQ ID NO: 6787 - DNA, 23 bp, Artificial Sequence
  HLA-A targeting gRNA
gctgcagagcgcgggtaccaggg

SEQ ID NO: 6788 - DNA, 23 bp, Artificial Sequence
  HLA-A targeting gRNA
gctgcagcacgcgggtaccaggg

SEQ ID NO: 6789 - DNA, 23 bp, Artificial Sequence
  HLA-A targeting gRNA
gctgcagcgcgcaggtaccaggg

SEQ ID NO: 6790 - DNA, 23 bp, Artificial Sequence
  HLA-A targeting gRNA
gctgcagcgcgcgggtaccaagg

SEQ ID NO: 6791 - DNA, 23 bp, Artificial Sequence
  HLA-A targeting gRNA
gctgcagcgcgcgggtaccgggg

SEQ ID NO: 6792 - DNA, 23 bp, Artificial Sequence
  HLA-A targeting gRNA
gctgcaggactcagaaaagctgg

SEQ ID NO: 6793 - DNA, 23 bp, Artificial Sequence
  HLA-A targeting gRNA
gctgcgacatggggccggacggg

SEQ ID NO: 6794 - DNA, 23 bp, Artificial Sequence
  HLA-A targeting gRNA
gctgcgacccggggcccgacggg

SEQ ID NO: 6795 - DNA, 23 bp, Artificial Sequence
  HLA-A targeting gRNA
gctgcgacctggggccccacggg

SEQ ID NO: 6796 - DNA, 23 bp, Artificial Sequence
  HLA-A targeting gRNA
gctgcgacctggggcccgaccgg

SEQ ID NO: 6797 - DNA, 23 bp, Artificial Sequence
  HLA-A targeting gRNA
gctgcgacctggggcccgacggg

SEQ ID NO: 6798 - DNA, 23 bp, Artificial Sequence
  HLA-A targeting gRNA
gctgcgacctggggccctacggg

SEQ ID NO: 6799 - DNA, 23 bp, Artificial Sequence
  HLA-A targeting gRNA
gctgcgacctggggccggacggg

SEQ ID NO: 6800 - DNA, 23 bp, Artificial Sequence
  HLA-A targeting gRNA
gctgcgacctggggctcgacggg

SEQ ID NO: 6801 - DNA, 23 bp, Artificial Sequence
  HLA-A targeting gRNA
gctgcgacctgggtcccgacggg

SEQ ID NO: 6802 - DNA, 23 bp, Artificial Sequence
  HLA-A targeting gRNA
gctgcgaccttgggcccgacggg

SEQ ID NO: 6803 - DNA, 23 bp, Artificial Sequence
  HLA-A targeting gRNA
gctgcgacgtggagccggacggg

SEQ ID NO: 6804 - DNA, 23 bp, Artificial Sequence
  HLA-A targeting gRNA
gctgcgacgtggggcccgacggg

SEQ ID NO: 6805 - DNA, 23 bp, Artificial Sequence
  HLA-A targeting gRNA
gctgcgacgtggggcccggcggg

SEQ ID NO: 6806 - DNA, 23 bp, Artificial Sequence
  HLA-A targeting gRNA
gctgcgacgtggggccggatggg

SEQ ID NO: 6807 - DNA, 23 bp, Artificial Sequence
  HLA-A targeting gRNA
gctggagcgcgcgggtaccaggg

SEQ ID NO: 6808 - DNA, 23 bp, Artificial Sequence
  HLA-A targeting gRNA
gctggagcgcgctggtaccaggg

SEQ ID NO: 6809 - DNA, 23 bp, Artificial Sequence
  HLA-A targeting gRNA
gctgggacctggggcccgacggg

SEQ ID NO: 6810 - DNA, 23 bp, Artificial Sequence
  HLA-A targeting gRNA
gctggggtaaggaggggaatggg

SEQ ID NO: 6811 - DNA, 23 bp, Artificial Sequence
  HLA-A targeting gRNA
gctgggtcagggctgaggcttgg

SEQ ID NO: 6812 - DNA, 23 bp, Artificial Sequence
  HLA-A targeting gRNA
gctgtcgaacctcacgaactggg

SEQ ID NO: 6813 - DNA, 23 bp, Artificial Sequence
  HLA-A targeting gRNA
gctgtgtcccggcccagccgcgg

SEQ ID NO: 6814 - DNA, 23 bp, Artificial Sequence
  HLA-A targeting gRNA
gctgtgtcccggcccggccgcgg

SEQ ID NO: 6815 - DNA, 23 bp, Artificial Sequence
  HLA-A targeting gRNA
gcttgaaaaggtgagattcttgg

SEQ ID NO: 6816 - DNA, 23 bp, Artificial Sequence
  HLA-A targeting gRNA
gcttgtaaaggtgagattctggg

SEQ ID NO: 6817 - DNA, 23 bp, Artificial Sequence
  HLA-A targeting gRNA
gcttgtaaggtgagattctgggg

SEQ ID NO: 6818 - DNA, 23 bp, Artificial Sequence
  HLA-A targeting gRNA
gcttgtacggctgcgacgtgggg

SEQ ID NO: 6819 - DNA, 23 bp, Artificial Sequence
  HLA-A targeting gRNA
gcttgtacttctgcgtctcccgg

SEQ ID NO: 6820 - DNA, 23 bp, Artificial Sequence
  HLA-A targeting gRNA
gcttgtacttctgtgtctcccgg

SEQ ID NO: 6821 - DNA, 23 bp, Artificial Sequence
  HLA-A targeting gRNA
gcttgtacttttgtgtctcccgg

SEQ ID NO: 6822 - DNA, 23 bp, Artificial Sequence
  HLA-A targeting gRNA
gcttgtagttctgtgtctcccgg

SEQ ID NO: 6823 - DNA, 23 bp, Artificial Sequence
  HLA-A targeting gRNA
gcttgtccttcccgttctccagg

SEQ ID NO: 6824 - DNA, 23 bp, Artificial Sequence
  HLA-A targeting gRNA
gcttgtgcttctgtgtctcccgg

SEQ ID NO: 6825 - DNA, 23 bp, Artificial Sequence
  HLA-A targeting gRNA
gcttgttcttctgtgtctcccgg

SEQ ID NO: 6826 - DNA, 23 bp, Artificial Sequence
  HLA-A targeting gRNA
ggaaaagaggagaaggtgagggg

SEQ ID NO: 6827 - DNA, 23 bp, Artificial Sequence
  HLA-A targeting gRNA
ggaaaggaagggaagatgagggg

SEQ ID NO: 6828 - DNA, 23 bp, Artificial Sequence
  HLA-A targeting gRNA
ggaaaggaggagaaggtgagggg

SEQ ID NO: 6829 - DNA, 23 bp, Artificial Sequence
  HLA-A targeting gRNA
ggaaaggaggggaagacgagggg

SEQ ID NO: 6830 - DNA, 23 bp, Artificial Sequence
  HLA-A targeting gRNA
ggaaaggaggggaagatgagggg

SEQ ID NO: 6831 - DNA, 23 bp, Artificial Sequence
  HLA-A targeting gRNA
ggaaaggaggggaaggtgagggg

SEQ ID NO: 6832 - DNA, 23 bp, Artificial Sequence
  HLA-A targeting gRNA
ggaaagttcgagtctctgagcgg

SEQ ID NO: 6833 - DNA, 23 bp, Artificial Sequence
  HLA-A targeting gRNA
ggaaagttcgagtctctgagtgg

SEQ ID NO: 6834 - DNA, 23 bp, Artificial Sequence
  HLA-A targeting gRNA
ggaaccgtgactttcctctcagg

SEQ ID NO: 6835 - DNA, 23 bp, Artificial Sequence
  HLA-A targeting gRNA
ggaacgcagatcctcgttcaggg

SEQ ID NO: 6836 - DNA, 23 bp, Artificial Sequence
  HLA-A targeting gRNA
ggaagaaaatgccctatgagggg

SEQ ID NO: 6837 - DNA, 23 bp, Artificial Sequence
  HLA-A targeting gRNA
ggaagaaaatgccctgtgagggg

SEQ ID NO: 6838 - DNA, 23 bp, Artificial Sequence
  HLA-A targeting gRNA
ggaagaaaatgtcctgtgagggg

SEQ ID NO: 6839 - DNA, 23 bp, Artificial Sequence
  HLA-A targeting gRNA
ggaagaagaagtgaaactcaggg

SEQ ID NO: 6840 - DNA, 23 bp, Artificial Sequence
  HLA-A targeting gRNA
ggaagaaggaccccacaagttgg

SEQ ID NO: 6841 - DNA, 23 bp, Artificial Sequence
  HLA-A targeting gRNA
ggaagagctcaggtagggaaggg

SEQ ID NO: 6842 - DNA, 23 bp, Artificial Sequence
  HLA-A targeting gRNA
ggaagagttcaggtagggaaggg

SEQ ID NO: 6843 - DNA, 23 bp, Artificial Sequence
  HLA-A targeting gRNA
ggaagagttctggtagggaaggg

SEQ ID NO: 6844 - DNA, 23 bp, Artificial Sequence
  HLA-A targeting gRNA
ggaagatggctcccatctcaggg

SEQ ID NO: 6845 - DNA, 23 bp, Artificial Sequence
  HLA-A targeting gRNA
ggaagcctgggggcgaggagggg

SEQ ID NO: 6846 - DNA, 23 bp, Artificial Sequence
  HLA-A targeting gRNA
ggaagcgcccgtcgggccccagg

SEQ ID NO: 6847 - DNA, 23 bp, Artificial Sequence
  HLA-A targeting gRNA
ggaaggagccgcgggcgccatgg

SEQ ID NO: 6848 - DNA, 23 bp, Artificial Sequence
  HLA-A targeting gRNA
ggaaggagccgcgggcgccctgg

SEQ ID NO: 6849 - DNA, 23 bp, Artificial Sequence
  HLA-A targeting gRNA
ggaaggagccgcgggcgccgtgg

SEQ ID NO: 6850 - DNA, 23 bp, Artificial Sequence
  HLA-A targeting gRNA
ggaaggctccccactgcccctgg

SEQ ID NO: 6851 - DNA, 23 bp, Artificial Sequence
  HLA-A targeting gRNA
ggaaggctccccactgcccttgg

SEQ ID NO: 6852 - DNA, 23 bp, Artificial Sequence
  HLA-A targeting gRNA
ggacaagaggaattatggggcgg

SEQ ID NO: 6853 - DNA, 23 bp, Artificial Sequence
  HLA-A targeting gRNA
ggacaagaggaattatggggtgg

SEQ ID NO: 6854 - DNA, 23 bp, Artificial Sequence
  HLA-A targeting gRNA
ggacacctgatcagtattctagg

SEQ ID NO: 6855 - DNA, 23 bp, Artificial Sequence
  HLA-A targeting gRNA
ggacacctggggtagggaagggg

SEQ ID NO: 6856 - DNA, 23 bp, Artificial Sequence
  HLA-A targeting gRNA
ggacacctggggtggggaagggg

SEQ ID NO: 6857 - DNA, 23 bp, Artificial Sequence
  HLA-A targeting gRNA
ggacacctggtgtggggaagggg

SEQ ID NO: 6858 - DNA, 23 bp, Artificial Sequence
  HLA-A targeting gRNA
ggacagatgtatcgccttgatgg

SEQ ID NO: 6859 - DNA, 23 bp, Artificial Sequence
  HLA-A targeting gRNA
ggacaggaggaattagggggtgg

SEQ ID NO: 6860 - DNA, 23 bp, Artificial Sequence
  HLA-A targeting gRNA
ggacaggaggaattatggggtgg

SEQ ID NO: 6861 - DNA, 23 bp, Artificial Sequence
  HLA-A targeting gRNA
ggacatttgcttcccacaggtgg

SEQ ID NO: 6862 - DNA, 23 bp, Artificial Sequence
  HLA-A targeting gRNA
ggacattttcttcccacaggtgg

SEQ ID NO: 6863 - DNA, 23 bp, Artificial Sequence
  HLA-A targeting gRNA
ggacccctgatcactatcctagg

SEQ ID NO: 6864 - DNA, 23 bp, Artificial Sequence
  HLA-A targeting gRNA
ggacccctgatcagtattatagg

SEQ ID NO: 6865 - DNA, 23 bp, Artificial Sequence
  HLA-A targeting gRNA
ggacccctgatcagtattccagg

SEQ ID NO: 6866 - DNA, 23 bp, Artificial Sequence
  HLA-A targeting gRNA
ggacccctgatcagtattctagg

SEQ ID NO: 6867 - DNA, 23 bp, Artificial Sequence
  HLA-A targeting gRNA
ggaccggtgagtgcggggttggg

SEQ ID NO: 6868 - DNA, 23 bp, Artificial Sequence
  HLA-A targeting gRNA
ggacctaagctcctggaccgcgg

SEQ ID NO: 6869 - DNA, 23 bp, Artificial Sequence
  HLA-A targeting gRNA
ggacctgagctcccggaccgcgg

SEQ ID NO: 6870 - DNA, 23 bp, Artificial Sequence
  HLA-A targeting gRNA
ggacctgagctcctggaccgcgg

SEQ ID NO: 6871 - DNA, 23 bp, Artificial Sequence
  HLA-A targeting gRNA
ggacctgagctcctggatcgcgg

SEQ ID NO: 6872 - DNA, 23 bp, Artificial Sequence
  HLA-A targeting gRNA
ggacctggtcaagagcccgcagg

SEQ ID NO: 6873 - DNA, 23 bp, Artificial Sequence
  HLA-A targeting gRNA
ggacggagccccgggagccatgg

SEQ ID NO: 6874 - DNA, 23 bp, Artificial Sequence
  HLA-A targeting gRNA
ggacggagccccgggcgccatgg

SEQ ID NO: 6875 - DNA, 23 bp, Artificial Sequence
  HLA-A targeting gRNA
ggacggagccccgggcgccgtgg

SEQ ID NO: 6876 - DNA, 23 bp, Artificial Sequence
  HLA-A targeting gRNA
ggacggagccctgggcgccatgg

SEQ ID NO: 6877 - DNA, 23 bp, Artificial Sequence
  HLA-A targeting gRNA
ggacggatgtatcaccgtggtgg

SEQ ID NO: 6878 - DNA, 23 bp, Artificial Sequence
  HLA-A targeting gRNA
ggacggatgtatcacctcgatgg

SEQ ID NO: 6879 - DNA, 23 bp, Artificial Sequence
  HLA-A targeting gRNA
ggacggatgtatcaccttgatgg

SEQ ID NO: 6880 - DNA, 23 bp, Artificial Sequence
  HLA-A targeting gRNA
ggacggatgtatcaccttggtgg

SEQ ID NO: 6881 - DNA, 23 bp, Artificial Sequence
  HLA-A targeting gRNA
ggacggatgtatcgccttgatgg

SEQ ID NO: 6882 - DNA, 23 bp, Artificial Sequence
  HLA-A targeting gRNA
ggacgggctgaccacgggggcgg

SEQ ID NO: 6883 - DNA, 23 bp, Artificial Sequence
  HLA-A targeting gRNA
ggacgtttcgagtgtgtggtggg

SEQ ID NO: 6884 - DNA, 23 bp, Artificial Sequence
  HLA-A targeting gRNA
ggactcccgagagcagcaggagg

SEQ ID NO: 6885 - DNA, 23 bp, Artificial Sequence
  HLA-A targeting gRNA
ggactctccgcggccgggccggg

SEQ ID NO: 6886 - DNA, 23 bp, Artificial Sequence
  HLA-A targeting gRNA
ggacttcagaaccgggactgcgg

SEQ ID NO: 6887 - DNA, 23 bp, Artificial Sequence
  HLA-A targeting gRNA
ggacttcagaaccggtactgcgg

SEQ ID NO: 6888 - DNA, 23 bp, Artificial Sequence
  HLA-A targeting gRNA
ggactttagaaccgggactgcgg

SEQ ID NO: 6889 - DNA, 23 bp, Artificial Sequence
  HLA-A targeting gRNA
ggactttagaacctggactgcgg

SEQ ID NO: 6890 - DNA, 23 bp, Artificial Sequence
  HLA-A targeting gRNA
ggactttagaactgggaccacgg

SEQ ID NO: 6891 - DNA, 23 bp, Artificial Sequence
  HLA-A targeting gRNA
ggactttagaactgggaccccgg

SEQ ID NO: 6892 - DNA, 23 bp, Artificial Sequence
  HLA-A targeting gRNA
ggactttagaactgggaccgcgg

SEQ ID NO: 6893 - DNA, 23 bp, Artificial Sequence
  HLA-A targeting gRNA
ggagaaacacctcatggagtggg

SEQ ID NO: 6894 - DNA, 23 bp, Artificial Sequence
  HLA-A targeting gRNA
ggagaaatacgtcatggagtggg

SEQ ID NO: 6895 - DNA, 23 bp, Artificial Sequence
  HLA-A targeting gRNA
ggagaacgggaaggacaagctgg

SEQ ID NO: 6896 - DNA, 23 bp, Artificial Sequence
  HLA-A targeting gRNA
ggagaacgggaaggacacgctgg

SEQ ID NO: 6897 - DNA, 23 bp, Artificial Sequence
  HLA-A targeting gRNA
ggagaacgggaaggagacgctgg

SEQ ID NO: 6898 - DNA, 23 bp, Artificial Sequence
  HLA-A targeting gRNA
ggagaagaagtgaaactcagggg

SEQ ID NO: 6899 - DNA, 23 bp, Artificial Sequence
  HLA-A targeting gRNA
ggagaagaagtgaaactcgtggg

SEQ ID NO: 6900 - DNA, 23 bp, Artificial Sequence
  HLA-A targeting gRNA
ggagaagaagtgaaactcttggg

SEQ ID NO: 6901 - DNA, 23 bp, Artificial Sequence
  HLA-A targeting gRNA
ggagacccgggccgtacgtcggg

SEQ ID NO: 6902 - DNA, 23 bp, Artificial Sequence
  HLA-A targeting gRNA
ggagacgcccgtcgggccccagg

SEQ ID NO: 6903 - DNA, 23 bp, Artificial Sequence
  HLA-A targeting gRNA
ggagagaggggaccgcaggcggg

SEQ ID NO: 6904 - DNA, 23 bp, Artificial Sequence
  HLA-A targeting gRNA
ggagagggagcctgggggcgagg

SEQ ID NO: 6905 - DNA, 23 bp, Artificial Sequence
  HLA-A targeting gRNA
ggagcaacggagagcctacctgg

SEQ ID NO: 6906 - DNA, 23 bp, Artificial Sequence
  HLA-A targeting gRNA
ggagcaaggggaccgcaggcggg

SEQ ID NO: 6907 - DNA, 23 bp, Artificial Sequence
  HLA-A targeting gRNA
ggagcagcggagaacctacctgg

SEQ ID NO: 6908 - DNA, 23 bp, Artificial Sequence
  HLA-A targeting gRNA
ggagcagcggagagcctacctgg

SEQ ID NO: 6909 - DNA, 23 bp, Artificial Sequence
  HLA-A targeting gRNA
ggagcagctaagagcctacctgg

SEQ ID NO: 6910 - DNA, 23 bp, Artificial Sequence
  HLA-A targeting gRNA
ggagcagctgagaacctacctgg

SEQ ID NO: 6911 - DNA, 23 bp, Artificial Sequence
  HLA-A targeting gRNA
ggagcagctgagagcctaccggg

SEQ ID NO: 6912 - DNA, 23 bp, Artificial Sequence
  HLA-A targeting gRNA
ggagcagctgagagcctgcctgg

SEQ ID NO: 6913 - DNA, 23 bp, Artificial Sequence
  HLA-A targeting gRNA
ggagcaggacagagcctacctgg

SEQ ID NO: 6914 - DNA, 23 bp, Artificial Sequence
  HLA-A targeting gRNA
ggagcagtgcagagcctacctgg

SEQ ID NO: 6915 - DNA, 23 bp, Artificial Sequence
  HLA-A targeting gRNA
ggagcagtggagagcccacctgg

SEQ ID NO: 6916 - DNA, 23 bp, Artificial Sequence
  HLA-A targeting gRNA
ggagcagtggagagtctacctgg

SEQ ID NO: 6917 - DNA, 23 bp, Artificial Sequence
  HLA-A targeting gRNA
ggagccatggatagagcaggagg

SEQ ID NO: 6918 - DNA, 23 bp, Artificial Sequence
  HLA-A targeting gRNA
ggagccccacttcatcgcagtgg

SEQ ID NO: 6919 - DNA, 23 bp, Artificial Sequence
  HLA-A targeting gRNA
ggagccccgcttcatcaccgtgg

SEQ ID NO: 6920 - DNA, 23 bp, Artificial Sequence
  HLA-A targeting gRNA
ggagccccgcttcatctcagtgg

SEQ ID NO: 6921 - DNA, 23 bp, Artificial Sequence
  HLA-A targeting gRNA
ggagccccgcttcattaccgtgg

SEQ ID NO: 6922 - DNA, 23 bp, Artificial Sequence
  HLA-A targeting gRNA
ggagccccgcttcattgcagtgg

SEQ ID NO: 6923 - DNA, 23 bp, Artificial Sequence
  HLA-A targeting gRNA
ggagccccgggcgccgtgggtgg

SEQ ID NO: 6924 - DNA, 23 bp, Artificial Sequence
  HLA-A targeting gRNA
ggagcccctcaccctgagatggg

SEQ ID NO: 6925 - DNA, 23 bp, Artificial Sequence
  HLA-A targeting gRNA
ggagcccttcagcagggtcaggg

SEQ ID NO: 6926 - DNA, 23 bp, Artificial Sequence
  HLA-A targeting gRNA
ggagcccttcagcagggtcgggg

SEQ ID NO: 6927 - DNA, 23 bp, Artificial Sequence
  HLA-A targeting gRNA
ggagcccttcagccaggtcaggg

SEQ ID NO: 6928 - DNA, 23 bp, Artificial Sequence
  HLA-A targeting gRNA
ggagcccttcagccgggtcaggg

SEQ ID NO: 6929 - DNA, 23 bp, Artificial Sequence
  HLA-A targeting gRNA
ggagcccttcagctgggtcaggg

SEQ ID NO: 6930 - DNA, 23 bp, Artificial Sequence
  HLA-A targeting gRNA
ggagccgcaggcgccgtgggtgg

SEQ ID NO: 6931 - DNA, 23 bp, Artificial Sequence
  HLA-A targeting gRNA
ggagccgcgggagccgtggatgg

SEQ ID NO: 6932 - DNA, 23 bp, Artificial Sequence
  HLA-A targeting gRNA
ggagccgcgggagccgtgggtgg

SEQ ID NO: 6933 - DNA, 23 bp, Artificial Sequence
  HLA-A targeting gRNA
ggagccgcgggcgccgtgggtgg

SEQ ID NO: 6934 - DNA, 23 bp, Artificial Sequence
  HLA-A targeting gRNA
ggagccgtggatggagcaggagg

SEQ ID NO: 6935 - DNA, 23 bp, Artificial Sequence
  HLA-A targeting gRNA
ggagccgtgggtggagcaggagg

SEQ ID NO: 6936 - DNA, 23 bp, Artificial Sequence
  HLA-A targeting gRNA
ggagcgaggggaccgcaggcggg

SEQ ID NO: 6937 - DNA, 23 bp, Artificial Sequence
  HLA-A targeting gRNA
ggagcgcagatcctcgttcaggg

SEQ ID NO: 6938 - DNA, 23 bp, Artificial Sequence
  HLA-A targeting gRNA
ggagcgcaggtcctcattcaggg

SEQ ID NO: 6939 - DNA, 23 bp, Artificial Sequence
  HLA-A targeting gRNA
ggagcgcaggtcctcgtccaggg

SEQ ID NO: 6940 - DNA, 23 bp, Artificial Sequence
  HLA-A targeting gRNA
ggagcgcaggtcctcgttcacgg

SEQ ID NO: 6941 - DNA, 23 bp, Artificial Sequence
  HLA-A targeting gRNA
ggagcgcaggtcctcgttctggg

SEQ ID NO: 6942 - DNA, 23 bp, Artificial Sequence
  HLA-A targeting gRNA
ggagctcaggtcctcgttcaagg

SEQ ID NO: 6943 - DNA, 23 bp, Artificial Sequence
  HLA-A targeting gRNA
ggagctcaggtcctcgttcaggg

SEQ ID NO: 6944 - DNA, 23 bp, Artificial Sequence
  HLA-A targeting gRNA
ggagctccgcttcatcgcagtgg

SEQ ID NO: 6945 - DNA, 23 bp, Artificial Sequence
  HLA-A targeting gRNA
ggagctgaagtggtcgggggtgg

SEQ ID NO: 6946 - DNA, 23 bp, Artificial Sequence
  HLA-A targeting gRNA
ggagctgaagtggtctggggtgg

SEQ ID NO: 6947 - DNA, 23 bp, Artificial Sequence
  HLA-A targeting gRNA
ggagcttaggtcctcgttcaggg

SEQ ID NO: 6948 - DNA, 23 bp, Artificial Sequence
  HLA-A targeting gRNA
ggaggaggggccggagtattggg

SEQ ID NO: 6949 - DNA, 23 bp, Artificial Sequence
  HLA-A targeting gRNA
ggaggcgcccgtagggccccagg

SEQ ID NO: 6950 - DNA, 23 bp, Artificial Sequence
  HLA-A targeting gRNA
ggaggcgcccgtccggccccagg

SEQ ID NO: 6951 - DNA, 23 bp, Artificial Sequence
  HLA-A targeting gRNA
ggaggcgcccgtcgagccccagg

SEQ ID NO: 6952 - DNA, 23 bp, Artificial Sequence
  HLA-A targeting gRNA
ggaggcgcccgtcgggacccagg

SEQ ID NO: 6953 - DNA, 23 bp, Artificial Sequence
  HLA-A targeting gRNA
ggaggcgcccgtcgggcccaagg

SEQ ID NO: 6954 - DNA, 23 bp, Artificial Sequence
  HLA-A targeting gRNA
ggaggcgcccgtcgggccccagg

SEQ ID NO: 6955 - DNA, 23 bp, Artificial Sequence
  HLA-A targeting gRNA
ggaggcgcccgtcgggccccggg

SEQ ID NO: 6956 - DNA, 23 bp, Artificial Sequence
  HLA-A targeting gRNA
ggaggcgcccgtggggccccagg

SEQ ID NO: 6957 - DNA, 23 bp, Artificial Sequence
  HLA-A targeting gRNA
ggaggcgccggtcgggccccagg

SEQ ID NO: 6958 - DNA, 23 bp, Artificial Sequence
  HLA-A targeting gRNA
ggagggaaatggcctctgccggg

SEQ ID NO: 6959 - DNA, 23 bp, Artificial Sequence
  HLA-A targeting gRNA
ggagggaaatggcctctgtgggg

SEQ ID NO: 6960 - DNA, 23 bp, Artificial Sequence
  HLA-A targeting gRNA
ggagggcaggtcctcgttcaggg

SEQ ID NO: 6961 - DNA, 23 bp, Artificial Sequence
  HLA-A targeting gRNA
ggaggggcccgtcgggccccagg

SEQ ID NO: 6962 - DNA, 23 bp, Artificial Sequence
  HLA-A targeting gRNA
ggaggggccggacggagtattgg

SEQ ID NO: 6963 - DNA, 23 bp, Artificial Sequence
  HLA-A targeting gRNA
ggaggtgtggaaatacctcatgg

SEQ ID NO: 6964 - DNA, 23 bp, Artificial Sequence
  HLA-A targeting gRNA
ggagtaaggagggggatgagggg

SEQ ID NO: 6965 - DNA, 23 bp, Artificial Sequence
  HLA-A targeting gRNA
ggagtcgctccgcagatacctgg

SEQ ID NO: 6966 - DNA, 23 bp, Artificial Sequence
  HLA-A targeting gRNA
ggagtcgtgacctgcgccccagg

SEQ ID NO: 6967 - DNA, 23 bp, Artificial Sequence
  HLA-A targeting gRNA
ggagtcgtgacctgcgccccggg

SEQ ID NO: 6968 - DNA, 23 bp, Artificial Sequence
  HLA-A targeting gRNA
ggagtggaagcctgggggcgagg

SEQ ID NO: 6969 - DNA, 23 bp, Artificial Sequence
  HLA-A targeting gRNA
ggagtggagaatccccaacgcgg

SEQ ID NO: 6970 - DNA, 23 bp, Artificial Sequence
  HLA-A targeting gRNA
ggagtggagaatcctcaacgcgg

SEQ ID NO: 6971 - DNA, 23 bp, Artificial Sequence
  HLA-A targeting gRNA
ggagtggctccgcagatatctgg

SEQ ID NO: 6972 - DNA, 23 bp, Artificial Sequence
  HLA-A targeting gRNA
ggagtggctccgcggatacctgg

SEQ ID NO: 6973 - DNA, 23 bp, Artificial Sequence
  HLA-A targeting gRNA
ggagtgggaacctgggggcgagg

SEQ ID NO: 6974 - DNA, 23 bp, Artificial Sequence
  HLA-A targeting gRNA
ggagtgggagactgggggcgagg

SEQ ID NO: 6975 - DNA, 23 bp, Artificial Sequence
  HLA-A targeting gRNA
ggagtgggagactgggggtgagg

SEQ ID NO: 6976 - DNA, 23 bp, Artificial Sequence
  HLA-A targeting gRNA
ggagtgggagcctgggagcgagg

SEQ ID NO: 6977 - DNA, 23 bp, Artificial Sequence
  HLA-A targeting gRNA
ggagtgggagcctgggggagagg

SEQ ID NO: 6978 - DNA, 23 bp, Artificial Sequence
  HLA-A targeting gRNA
ggagtgggagcctgggggccagg

SEQ ID NO: 6979 - DNA, 23 bp, Artificial Sequence
  HLA-A targeting gRNA
ggagtgggagcctgggggtgagg

SEQ ID NO: 6980 - DNA, 23 bp, Artificial Sequence
  HLA-A targeting gRNA
ggagtgggaggctgggggcgagg

SEQ ID NO: 6981 - DNA, 23 bp, Artificial Sequence
  HLA-A targeting gRNA
ggatctcagacccggagactcgg

SEQ ID NO: 6982 - DNA, 23 bp, Artificial Sequence
  HLA-A targeting gRNA
ggatctcagaccgggagactcgg

SEQ ID NO: 6983 - DNA, 23 bp, Artificial Sequence
  HLA-A targeting gRNA
ggatctcagaccgggagacttgg

SEQ ID NO: 6984 - DNA, 23 bp, Artificial Sequence
  HLA-A targeting gRNA
ggatctcagacggggagactcgg

SEQ ID NO: 6985 - DNA, 23 bp, Artificial Sequence
  HLA-A targeting gRNA
ggatctcggacccggagactcgg

SEQ ID NO: 6986 - DNA, 23 bp, Artificial Sequence
  HLA-A targeting gRNA
ggatctcggaccctgagactcgg

SEQ ID NO: 6987 - DNA, 23 bp, Artificial Sequence
  HLA-A targeting gRNA
ggatgaagtccctgaggaaatgg

SEQ ID NO: 6988 - DNA, 23 bp, Artificial Sequence
  HLA-A targeting gRNA
ggatgaagtccttgaggaaatgg

SEQ ID NO: 6989 - DNA, 23 bp, Artificial Sequence
  HLA-A targeting gRNA
ggatgaagtctctgaggaaatgg

SEQ ID NO: 6990 - DNA, 23 bp, Artificial Sequence
  HLA-A targeting gRNA
ggatgacatcgccctgaacgagg

SEQ ID NO: 6991 - DNA, 23 bp, Artificial Sequence
  HLA-A targeting gRNA
ggatgacatctctgaggaaatgg

SEQ ID NO: 6992 - DNA, 23 bp, Artificial Sequence
  HLA-A targeting gRNA
ggatgacgtctctgaggaaatgg

SEQ ID NO: 6993 - DNA, 23 bp, Artificial Sequence
  HLA-A targeting gRNA
ggatggagccccgggcgccatgg

SEQ ID NO: 6994 - DNA, 23 bp, Artificial Sequence
  HLA-A targeting gRNA
ggatggatgtatcaccttgatgg

SEQ ID NO: 6995 - DNA, 23 bp, Artificial Sequence
  HLA-A targeting gRNA
ggatggcaaggaccaaactcagg

SEQ ID NO: 6996 - DNA, 23 bp, Artificial Sequence
  HLA-A targeting gRNA
ggatggcctcccacgagaagagg

SEQ ID NO: 6997 - DNA, 23 bp, Artificial Sequence
  HLA-A targeting gRNA
ggatggcctcccacgaggaaggg

SEQ ID NO: 6998 - DNA, 23 bp, Artificial Sequence
  HLA-A targeting gRNA
ggatggcctcccacgaggagggg

SEQ ID NO: 6999 - DNA, 23 bp, Artificial Sequence
  HLA-A targeting gRNA
ggatggccttccacgaggagggg

SEQ ID NO: 7000 - DNA, 23 bp, Artificial Sequence
  HLA-A targeting gRNA
ggatggcgaggaccaaactcagg

SEQ ID NO: 7001 - DNA, 23 bp, Artificial Sequence
  HLA-A targeting gRNA
ggatggcgaggactaaactcagg

SEQ ID NO: 7002 - DNA, 23 bp, Artificial Sequence
  HLA-A targeting gRNA
ggatggcgccccgggcgccatgg

SEQ ID NO: 7003 - DNA, 23 bp, Artificial Sequence
  HLA-A targeting gRNA
ggatggcgccctgggcgccatgg

SEQ ID NO: 7004 - DNA, 23 bp, Artificial Sequence
  HLA-A targeting gRNA
ggatggcgtctctgaggaaatgg

SEQ ID NO: 7005 - DNA, 23 bp, Artificial Sequence
  HLA-A targeting gRNA
ggatggggaagaccagacccagg

SEQ ID NO: 7006 - DNA, 23 bp, Artificial Sequence
  HLA-A targeting gRNA
ggatggggaggaccaaactcagg

SEQ ID NO: 7007 - DNA, 23 bp, Artificial Sequence
  HLA-A targeting gRNA
ggatggggaggaccaaattcagg

SEQ ID NO: 7008 - DNA, 23 bp, Artificial Sequence
  HLA-A targeting gRNA
ggatggtgcttccagtaacaagg

SEQ ID NO: 7009 - DNA, 23 bp, Artificial Sequence
  HLA-A targeting gRNA
ggatggtgcttccagtaacgagg

SEQ ID NO: 7010 - DNA, 23 bp, Artificial Sequence
  HLA-A targeting gRNA
ggatgtaaggctgcgacgtgggg

SEQ ID NO: 7011 - DNA, 23 bp, Artificial Sequence
  HLA-A targeting gRNA
ggatgtacggctgcgacctgggg

SEQ ID NO: 7012 - DNA, 23 bp, Artificial Sequence
  HLA-A targeting gRNA
ggatgtacggctgcgacgtgggg

SEQ ID NO: 7013 - DNA, 23 bp, Artificial Sequence
  HLA-A targeting gRNA
ggatgtacggctgggacctgggg

SEQ ID NO: 7014 - DNA, 23 bp, Artificial Sequence
  HLA-A targeting gRNA
ggatgtatggctgcgacctgggg

SEQ ID NO: 7015 - DNA, 23 bp, Artificial Sequence
  HLA-A targeting gRNA
ggatgtctggctgcgacccgggg

SEQ ID NO: 7016 - DNA, 23 bp, Artificial Sequence
  HLA-A targeting gRNA
ggatgtctggctgcgacctgggg

SEQ ID NO: 7017 - DNA, 23 bp, Artificial Sequence
  HLA-A targeting gRNA
ggatgtctggctgcgacgtgggg

SEQ ID NO: 7018 - DNA, 23 bp, Artificial Sequence
  HLA-A targeting gRNA
ggatgtgaagaaatacttcatgg

SEQ ID NO: 7019 - DNA, 23 bp, Artificial Sequence
  HLA-A targeting gRNA
ggatgtggagaaacacctcatgg

SEQ ID NO: 7020 - DNA, 23 bp, Artificial Sequence
  HLA-A targeting gRNA
ggatgtggagaaatacgtcatgg

SEQ ID NO: 7021 - DNA, 23 bp, Artificial Sequence
  HLA-A targeting gRNA
ggatgtgtggctgcaacctgggg

SEQ ID NO: 7022 - DNA, 23 bp, Artificial Sequence
  HLA-A targeting gRNA
ggatgtgtggctgcgacctgggg

SEQ ID NO: 7023 - DNA, 23 bp, Artificial Sequence
  HLA-A targeting gRNA
ggatgttacgcgtgtgtggtggg

SEQ ID NO: 7024 - DNA, 23 bp, Artificial Sequence
  HLA-A targeting gRNA
ggatgtttcgcgtgtgtcgtggg

SEQ ID NO: 7025 - DNA, 23 bp, Artificial Sequence
  HLA-A targeting gRNA
ggatgtttcgcgtgtgtgatggg

SEQ ID NO: 7026 - DNA, 23 bp, Artificial Sequence
  HLA-A targeting gRNA
ggatgtttcgcgtgtgtggtggg

SEQ ID NO: 7027 - DNA, 23 bp, Artificial Sequence
  HLA-A targeting gRNA
ggatgtttggctgcgacctgggg

SEQ ID NO: 7028 - DNA, 23 bp, Artificial Sequence
  HLA-A targeting gRNA
ggatgtttggctgcgaccttggg

SEQ ID NO: 7029 - DNA, 23 bp, Artificial Sequence
  HLA-A targeting gRNA
ggattacaacgccctgaatgagg

SEQ ID NO: 7030 - DNA, 23 bp, Artificial Sequence
  HLA-A targeting gRNA
ggattacatagccctgaacgagg

SEQ ID NO: 7031 - DNA, 23 bp, Artificial Sequence
  HLA-A targeting gRNA
ggattacatcgcccagaacgagg

SEQ ID NO: 7032 - DNA, 23 bp, Artificial Sequence
  HLA-A targeting gRNA
ggattacatcgccctgaatgagg

SEQ ID NO: 7033 - DNA, 23 bp, Artificial Sequence
  HLA-A targeting gRNA
ggattacatcgccctggacgagg

SEQ ID NO: 7034 - DNA, 23 bp, Artificial Sequence
  HLA-A targeting gRNA
ggattacatcgccgtgaacgagg

SEQ ID NO: 7035 - DNA, 23 bp, Artificial Sequence
  HLA-A targeting gRNA
ggcacacagggtcccaggctggg

SEQ ID NO: 7036 - DNA, 23 bp, Artificial Sequence
  HLA-A targeting gRNA
ggcacctcctgctctatccatgg

SEQ ID NO: 7037 - DNA, 23 bp, Artificial Sequence
  HLA-A targeting gRNA
ggcagagaacaaggcctgagagg

SEQ ID NO: 7038 - DNA, 23 bp, Artificial Sequence
  HLA-A targeting gRNA
ggcagggaaatggcctctgtagg

SEQ ID NO: 7039 - DNA, 23 bp, Artificial Sequence
  HLA-A targeting gRNA
ggcagggaaatggcctctgtggg

SEQ ID NO: 7040 - DNA, 23 bp, Artificial Sequence
  HLA-A targeting gRNA
ggcagggaacacttctacctggg

SEQ ID NO: 7041 - DNA, 23 bp, Artificial Sequence
  HLA-A targeting gRNA
ggcagggccatgcaatcttaggg

SEQ ID NO: 7042 - DNA, 23 bp, Artificial Sequence
  HLA-A targeting gRNA
ggcagggccatgcgatcttaggg

SEQ ID NO: 7043 - DNA, 23 bp, Artificial Sequence
  HLA-A targeting gRNA
ggcagggccatgtgatcttaggg

SEQ ID NO: 7044 - DNA, 23 bp, Artificial Sequence
  HLA-A targeting gRNA
ggcagggccatgtgattttaggg

SEQ ID NO: 7045 - DNA, 23 bp, Artificial Sequence
  HLA-A targeting gRNA
ggcaggtctgggggtgggtgggg

SEQ ID NO: 7046 - DNA, 23 bp, Artificial Sequence
  HLA-A targeting gRNA
ggcatggcctcccacgaggaggg

SEQ ID NO: 7047 - DNA, 23 bp, Artificial Sequence
  HLA-A targeting gRNA
ggccaaaatccccgcgggttggg

SEQ ID NO: 7048 - DNA, 23 bp, Artificial Sequence
  HLA-A targeting gRNA
ggccagggtctcacatcatccgg

SEQ ID NO: 7049 - DNA, 23 bp, Artificial Sequence
  HLA-A targeting gRNA
ggccagggtctcacatccagagg

SEQ ID NO: 7050 - DNA, 23 bp, Artificial Sequence
  HLA-A targeting gRNA
ggccatccccggcgacctatagg

SEQ ID NO: 7051 - DNA, 23 bp, Artificial Sequence
  HLA-A targeting gRNA
ggccatcccgggagatctacagg

SEQ ID NO: 7052 - DNA, 23 bp, Artificial Sequence
  HLA-A targeting gRNA
ggccatcccgggagatctacggg

SEQ ID NO: 7053 - DNA, 23 bp, Artificial Sequence
  HLA-A targeting gRNA
ggccatcccgggagatctatagg

SEQ ID NO: 7054 - DNA, 23 bp, Artificial Sequence
  HLA-A targeting gRNA
ggccatcccgggcgatctatagg

SEQ ID NO: 7055 - DNA, 23 bp, Artificial Sequence
  HLA-A targeting gRNA
ggccatgccgggagatctacggg

SEQ ID NO: 7056 - DNA, 23 bp, Artificial Sequence
  HLA-A targeting gRNA
ggccatgggcttctaccctgcgg

SEQ ID NO: 7057 - DNA, 23 bp, Artificial Sequence
  HLA-A targeting gRNA
ggccccgggcggggctctcaggg

SEQ ID NO: 7058 - DNA, 23 bp, Artificial Sequence
  HLA-A targeting gRNA
ggcccctcctgctccacccacgg

SEQ ID NO: 7059 - DNA, 23 bp, Artificial Sequence
  HLA-A targeting gRNA
ggcccctcctgctccatccacgg

SEQ ID NO: 7060 - DNA, 23 bp, Artificial Sequence
  HLA-A targeting gRNA
ggcccctcctgctctatccaggg

SEQ ID NO: 7061 - DNA, 23 bp, Artificial Sequence
  HLA-A targeting gRNA
ggcccctcctgctctatccatgg

SEQ ID NO: 7062 - DNA, 23 bp, Artificial Sequence
  HLA-A targeting gRNA
ggcccctccttctccacccacgg

SEQ ID NO: 7063 - DNA, 23 bp, Artificial Sequence
  HLA-A targeting gRNA
ggcccctcttgctctatccacgg

SEQ ID NO: 7064 - DNA, 23 bp, Artificial Sequence
  HLA-A targeting gRNA
ggcccctcttgctctatccatgg

SEQ ID NO: 7065 - DNA, 23 bp, Artificial Sequence
  HLA-A targeting gRNA
ggcccgcccggcgagggcgcagg

SEQ ID NO: 7066 - DNA, 23 bp, Artificial Sequence
  HLA-A targeting gRNA
ggccctcccggcgagggcgcagg

SEQ ID NO: 7067 - DNA, 23 bp, Artificial Sequence
  HLA-A targeting gRNA
ggccctgaccgagacctgggcgg

SEQ ID NO: 7068 - DNA, 23 bp, Artificial Sequence
  HLA-A targeting gRNA
ggccctgggaaaggaggggaagg

SEQ ID NO: 7069 - DNA, 23 bp, Artificial Sequence
  HLA-A targeting gRNA
ggccctgggcttctaccctacgg

SEQ ID NO: 7070 - DNA, 23 bp, Artificial Sequence
  HLA-A targeting gRNA
ggccctgggcttctaccctgggg

SEQ ID NO: 7071 - DNA, 23 bp, Artificial Sequence
  HLA-A targeting gRNA
ggccctgggcttctaccctgtgg

SEQ ID NO: 7072 - DNA, 23 bp, Artificial Sequence
  HLA-A targeting gRNA
ggccctgggtttctaccctgcgg

SEQ ID NO: 7073 - DNA, 23 bp, Artificial Sequence
  HLA-A targeting gRNA
ggccctgggtttctaccctgtgg

SEQ ID NO: 7074 - DNA, 23 bp, Artificial Sequence
  HLA-A targeting gRNA
ggccctgtgcttctaccctgcgg

SEQ ID NO: 7075 - DNA, 23 bp, Artificial Sequence
  HLA-A targeting gRNA
ggccgcctccaacttgcgctggg

SEQ ID NO: 7076 - DNA, 23 bp, Artificial Sequence
  HLA-A targeting gRNA
ggccgcctccaacttgggctggg

SEQ ID NO: 7077 - DNA, 23 bp, Artificial Sequence
  HLA-A targeting gRNA
ggccgcctccaacttgtgctggg

SEQ ID NO: 7078 - DNA, 23 bp, Artificial Sequence
  HLA-A targeting gRNA
ggccgcctcccacttacgctggg

SEQ ID NO: 7079 - DNA, 23 bp, Artificial Sequence
  HLA-A targeting gRNA
ggccgcctcccacttgagctggg

SEQ ID NO: 7080 - DNA, 23 bp, Artificial Sequence
  HLA-A targeting gRNA
ggccgcctcccacttgggctggg

SEQ ID NO: 7081 - DNA, 23 bp, Artificial Sequence
  HLA-A targeting gRNA
ggccgcctcccatttgcgctggg

SEQ ID NO: 7082 - DNA, 23 bp, Artificial Sequence
  HLA-A targeting gRNA
ggcctcagggaggcggatctcgg

SEQ ID NO: 7083 - DNA, 23 bp, Artificial Sequence
  HLA-A targeting gRNA
ggcctcaggggggcggatctcgg

SEQ ID NO: 7084 - DNA, 23 bp, Artificial Sequence
  HLA-A targeting gRNA
ggcctcaggggggtggatctcgg

SEQ ID NO: 7085 - DNA, 23 bp, Artificial Sequence
  HLA-A targeting gRNA
ggcctcagggggtcggatctcgg

SEQ ID NO: 7086 - DNA, 23 bp, Artificial Sequence
  HLA-A targeting gRNA
ggcctcccgagagcagcaggagg

SEQ ID NO: 7087 - DNA, 23 bp, Artificial Sequence
  HLA-A targeting gRNA
ggcctctatggagaggagcgagg

SEQ ID NO: 7088 - DNA, 23 bp, Artificial Sequence
  HLA-A targeting gRNA
ggcctctgccgggaggagcgagg

SEQ ID NO: 7089 - DNA, 23 bp, Artificial Sequence
  HLA-A targeting gRNA
ggcctctgcggagaggaacgagg

SEQ ID NO: 7090 - DNA, 23 bp, Artificial Sequence
  HLA-A targeting gRNA
ggcctctgcggagaggagcgagg

SEQ ID NO: 7091 - DNA, 23 bp, Artificial Sequence
  HLA-A targeting gRNA
ggcctctgcggagaggagggagg

SEQ ID NO: 7092 - DNA, 23 bp, Artificial Sequence
  HLA-A targeting gRNA
ggcctctgctgagaggagcgagg

SEQ ID NO: 7093 - DNA, 23 bp, Artificial Sequence
  HLA-A targeting gRNA
ggcctctggggagaggagcgagg

SEQ ID NO: 7094 - DNA, 23 bp, Artificial Sequence
  HLA-A targeting gRNA
ggcctctgtagggaggagcaagg

SEQ ID NO: 7095 - DNA, 23 bp, Artificial Sequence
  HLA-A targeting gRNA
ggcctctgtggggaggagagagg

SEQ ID NO: 7096 - DNA, 23 bp, Artificial Sequence
  HLA-A targeting gRNA
ggcctctgtggggaggagcgagg

SEQ ID NO: 7097 - DNA, 23 bp, Artificial Sequence
  HLA-A targeting gRNA
ggcgaccccggccgtacgtgggg

SEQ ID NO: 7098 - DNA, 23 bp, Artificial Sequence
  HLA-A targeting gRNA
ggcgacccgggccgtacgtgggg

SEQ ID NO: 7099 - DNA, 23 bp, Artificial Sequence
  HLA-A targeting gRNA
ggcgacccgggccgtccgtgggg

SEQ ID NO: 7100 - DNA, 23 bp, Artificial Sequence
  HLA-A targeting gRNA
ggcgccatggatagagcaagagg

SEQ ID NO: 7101 - DNA, 23 bp, Artificial Sequence
  HLA-A targeting gRNA
ggcgccatggatagagcaggagg

SEQ ID NO: 7102 - DNA, 23 bp, Artificial Sequence
  HLA-A targeting gRNA
ggcgcccagggcgccatcctcgg

SEQ ID NO: 7103 - DNA, 23 bp, Artificial Sequence
  HLA-A targeting gRNA
ggcgcccagggctccgtcctcgg

SEQ ID NO: 7104 - DNA, 23 bp, Artificial Sequence
  HLA-A targeting gRNA
ggcgcccgcggctcccccctcgg

SEQ ID NO: 7105 - DNA, 23 bp, Artificial Sequence
  HLA-A targeting gRNA
ggcgcccgcggctcccctctcgg

SEQ ID NO: 7106 - DNA, 23 bp, Artificial Sequence
  HLA-A targeting gRNA
ggcgcccgcggctcccctcttgg

SEQ ID NO: 7107 - DNA, 23 bp, Artificial Sequence
  HLA-A targeting gRNA
ggcgcccgcggctcctctctcgg

SEQ ID NO: 7108 - DNA, 23 bp, Artificial Sequence
  HLA-A targeting gRNA
ggcgcccgcggctccttcctcgg

SEQ ID NO: 7109 - DNA, 23 bp, Artificial Sequence
  HLA-A targeting gRNA
ggcgcccggggcgccatcctcgg

SEQ ID NO: 7110 - DNA, 23 bp, Artificial Sequence
  HLA-A targeting gRNA
ggcgcccggggctccatcctcgg

SEQ ID NO: 7111 - DNA, 23 bp, Artificial Sequence
  HLA-A targeting gRNA
ggcgcccggggctcccctctcgg

SEQ ID NO: 7112 - DNA, 23 bp, Artificial Sequence
  HLA-A targeting gRNA
ggcgcccggggctccgtcctcgg

SEQ ID NO: 7113 - DNA, 23 bp, Artificial Sequence
  HLA-A targeting gRNA
ggcgccctggatagagcaggagg

SEQ ID NO: 7114 - DNA, 23 bp, Artificial Sequence
  HLA-A targeting gRNA
ggcgccgtggatagagcaagagg

SEQ ID NO: 7115 - DNA, 23 bp, Artificial Sequence
  HLA-A targeting gRNA
ggcgccgtgggtggagaaggagg

SEQ ID NO: 7116 - DNA, 23 bp, Artificial Sequence
  HLA-A targeting gRNA
ggcgccgtgggtggagcaggagg

SEQ ID NO: 7117 - DNA, 23 bp, Artificial Sequence
  HLA-A targeting gRNA
ggcgcctgcggctcccctcttgg

SEQ ID NO: 7118 - DNA, 23 bp, Artificial Sequence
  HLA-A targeting gRNA
ggcgcggtggatagagcaggagg

SEQ ID NO: 7119 - DNA, 23 bp, Artificial Sequence
  HLA-A targeting gRNA
ggcggcccgtatggcggagcagg

SEQ ID NO: 7120 - DNA, 23 bp, Artificial Sequence
  HLA-A targeting gRNA
ggcggcccgtgcggcggagcagg

SEQ ID NO: 7121 - DNA, 23 bp, Artificial Sequence
  HLA-A targeting gRNA
ggcggcccgtgtggcggagcagg

SEQ ID NO: 7122 - DNA, 23 bp, Artificial Sequence
  HLA-A targeting gRNA
ggcggggcacacttctacctggg

SEQ ID NO: 7123 - DNA, 23 bp, Artificial Sequence
  HLA-A targeting gRNA
ggcggggcggggcggggccgggg

SEQ ID NO: 7124 - DNA, 23 bp, Artificial Sequence
  HLA-A targeting gRNA
ggcggggcggggcggggctcggg

SEQ ID NO: 7125 - DNA, 23 bp, Artificial Sequence
  HLA-A targeting gRNA
ggcggggctctcagggtctcagg

SEQ ID NO: 7126 - DNA, 23 bp, Artificial Sequence
  HLA-A targeting gRNA
ggcggggggggggtggggtgggg

SEQ ID NO: 7127 - DNA, 23 bp, Artificial Sequence
  HLA-A targeting gRNA
ggcggggttctcagggtctcagg

SEQ ID NO: 7128 - DNA, 23 bp, Artificial Sequence
  HLA-A targeting gRNA
ggcgggtcccgcggcctcagggg

SEQ ID NO: 7129 - DNA, 23 bp, Artificial Sequence
  HLA-A targeting gRNA
ggcgggtcccgcggcctcggggg

SEQ ID NO: 7130 - DNA, 23 bp, Artificial Sequence
  HLA-A targeting gRNA
ggcgggtctggggcggggtgggg

SEQ ID NO: 7131 - DNA, 23 bp, Artificial Sequence
  HLA-A targeting gRNA
ggcgggtctgggggggggggggg

SEQ ID NO: 7132 - DNA, 23 bp, Artificial Sequence
  HLA-A targeting gRNA
ggcgggtctgggggtgggtgggg

SEQ ID NO: 7133 - DNA, 23 bp, Artificial Sequence
  HLA-A targeting gRNA
ggcggtgtagaaatacctcaagg

SEQ ID NO: 7134 - DNA, 23 bp, Artificial Sequence
  HLA-A targeting gRNA
ggcggtgtagaaatacctcatgg

SEQ ID NO: 7135 - DNA, 23 bp, Artificial Sequence
  HLA-A targeting gRNA
ggcggtgtagaaatacttcatgg

SEQ ID NO: 7136 - DNA, 23 bp, Artificial Sequence
  HLA-A targeting gRNA
ggcggtgtcgaaatacctcatgg

SEQ ID NO: 7137 - DNA, 23 bp, Artificial Sequence
  HLA-A targeting gRNA
ggcggtgtggaaatacctcatgg

SEQ ID NO: 7138 - DNA, 23 bp, Artificial Sequence
  HLA-A targeting gRNA
ggcgtctctgaggaaatggaggg

SEQ ID NO: 7139 - DNA, 23 bp, Artificial Sequence
  HLA-A targeting gRNA
ggctacaaccagagcgaggccgg

SEQ ID NO: 7140 - DNA, 23 bp, Artificial Sequence
  HLA-A targeting gRNA
ggctcccatctcagggtgagggg

SEQ ID NO: 7141 - DNA, 23 bp, Artificial Sequence
  HLA-A targeting gRNA
ggctcccctctcggactcgcggg

SEQ ID NO: 7142 - DNA, 23 bp, Artificial Sequence
  HLA-A targeting gRNA
ggctccccttctcggactcgcgg

SEQ ID NO: 7143 - DNA, 23 bp, Artificial Sequence
  HLA-A targeting gRNA
ggctcccgcggctcccctcttgg

SEQ ID NO: 7144 - DNA, 23 bp, Artificial Sequence
  HLA-A targeting gRNA
ggctcccggggctccgtcctcgg

SEQ ID NO: 7145 - DNA, 23 bp, Artificial Sequence
  HLA-A targeting gRNA
ggctctgggaaaagaggagaagg

SEQ ID NO: 7146 - DNA, 23 bp, Artificial Sequence
  HLA-A targeting gRNA
ggctctgggaaaggaggagaagg

SEQ ID NO: 7147 - DNA, 23 bp, Artificial Sequence
  HLA-A targeting gRNA
ggctctgggaaaggaggggaagg

SEQ ID NO: 7148 - DNA, 23 bp, Artificial Sequence
  HLA-A targeting gRNA
ggctgcaacctggggcccgacgg

SEQ ID NO: 7149 - DNA, 23 bp, Artificial Sequence
  HLA-A targeting gRNA
ggctgcctcccacttgcgctggg

SEQ ID NO: 7150 - DNA, 23 bp, Artificial Sequence
  HLA-A targeting gRNA
ggctgcgacatggggccggacgg

SEQ ID NO: 7151 - DNA, 23 bp, Artificial Sequence
  HLA-A targeting gRNA
ggctgcgacccggggcccgacgg

SEQ ID NO: 7152 - DNA, 23 bp, Artificial Sequence
  HLA-A targeting gRNA
ggctgcgacctgggcccgacggg

SEQ ID NO: 7153 - DNA, 23 bp, Artificial Sequence
  HLA-A targeting gRNA
ggctgcgacctggggccccacgg

SEQ ID NO: 7154 - DNA, 23 bp, Artificial Sequence
  HLA-A targeting gRNA
ggctgcgacctggggcccgacgg

SEQ ID NO: 7155 - DNA, 23 bp, Artificial Sequence
  HLA-A targeting gRNA
ggctgcgacctggggccctacgg

SEQ ID NO: 7156 - DNA, 23 bp, Artificial Sequence
  HLA-A targeting gRNA
ggctgcgacctggggccggacgg

SEQ ID NO: 7157 - DNA, 23 bp, Artificial Sequence
  HLA-A targeting gRNA
ggctgcgacctggggctcgacgg

SEQ ID NO: 7158 - DNA, 23 bp, Artificial Sequence
  HLA-A targeting gRNA
ggctgcgacctgggtcccgacgg

SEQ ID NO: 7159 - DNA, 23 bp, Artificial Sequence
  HLA-A targeting gRNA
ggctgcgaccttgggcccgacgg

SEQ ID NO: 7160 - DNA, 23 bp, Artificial Sequence
  HLA-A targeting gRNA
ggctgcgacgtggagccggacgg

SEQ ID NO: 7161 - DNA, 23 bp, Artificial Sequence
  HLA-A targeting gRNA
ggctgcgacgtggggcccgacgg

SEQ ID NO: 7162 - DNA, 23 bp, Artificial Sequence
  HLA-A targeting gRNA
ggctgcgacgtggggcccggcgg

SEQ ID NO: 7163 - DNA, 23 bp, Artificial Sequence
  HLA-A targeting gRNA
ggctgcgacgtggggccggatgg

SEQ ID NO: 7164 - DNA, 23 bp, Artificial Sequence
  HLA-A targeting gRNA
ggctgctgcaggggtcaaagagg

SEQ ID NO: 7165 - DNA, 23 bp, Artificial Sequence
  HLA-A targeting gRNA
ggctgctgcaggggtcaaagggg

SEQ ID NO: 7166 - DNA, 23 bp, Artificial Sequence
  HLA-A targeting gRNA
ggctggagtagaacaaaaacagg

SEQ ID NO: 7167 - DNA, 23 bp, Artificial Sequence
  HLA-A targeting gRNA
ggctgggacctggggcccgacgg

SEQ ID NO: 7168 - DNA, 23 bp, Artificial Sequence
  HLA-A targeting gRNA
ggctgtcgaacctcacgaactgg

SEQ ID NO: 7169 - DNA, 23 bp, Artificial Sequence
  HLA-A targeting gRNA
ggcttacatcgccctgaacgagg

SEQ ID NO: 7170 - DNA, 23 bp, Artificial Sequence
  HLA-A targeting gRNA
gggaaaagaggagaaggtgaggg

SEQ ID NO: 7171 - DNA, 23 bp, Artificial Sequence
  HLA-A targeting gRNA
gggaaaaggcctaggtaatgggg

SEQ ID NO: 7172 - DNA, 23 bp, Artificial Sequence
  HLA-A targeting gRNA
gggaaaaggcctgggtaatgggg

SEQ ID NO: 7173 - DNA, 23 bp, Artificial Sequence
  HLA-A targeting gRNA
gggaaacggcctctgcggagagg

SEQ ID NO: 7174 - DNA, 23 bp, Artificial Sequence
  HLA-A targeting gRNA
gggaaacggcctctgctgagagg

SEQ ID NO: 7175 - DNA, 23 bp, Artificial Sequence
  HLA-A targeting gRNA
gggaaacggcctctggggagagg

SEQ ID NO: 7176 - DNA, 23 bp, Artificial Sequence
  HLA-A targeting gRNA
gggaaagcagctgtgggttctgg

SEQ ID NO: 7177 - DNA, 23 bp, Artificial Sequence
  HLA-A targeting gRNA
gggaaagcagttgtgggttctgg

SEQ ID NO: 7178 - DNA, 23 bp, Artificial Sequence
  HLA-A targeting gRNA
gggaaaggaagggaagatgaggg

SEQ ID NO: 7179 - DNA, 23 bp, Artificial Sequence
  HLA-A targeting gRNA
gggaaaggaggagaaggtgaggg

SEQ ID NO: 7180 - DNA, 23 bp, Artificial Sequence
  HLA-A targeting gRNA
gggaaaggaggggaagacgaggg

SEQ ID NO: 7181 - DNA, 23 bp, Artificial Sequence
  HLA-A targeting gRNA
gggaaaggaggggaagatgaggg

SEQ ID NO: 7182 - DNA, 23 bp, Artificial Sequence
  HLA-A targeting gRNA
gggaaaggaggggaaggtgaggg

SEQ ID NO: 7183 - DNA, 23 bp, Artificial Sequence
  HLA-A targeting gRNA
gggaaatggcctctgccgggagg

SEQ ID NO: 7184 - DNA, 23 bp, Artificial Sequence
  HLA-A targeting gRNA
gggaaatggcctctgtagggagg

SEQ ID NO: 7185 - DNA, 23 bp, Artificial Sequence
  HLA-A targeting gRNA
gggaaatggcctctgtggggagg

SEQ ID NO: 7186 - DNA, 23 bp, Artificial Sequence
  HLA-A targeting gRNA
gggaacctgggggcgaggagggg

SEQ ID NO: 7187 - DNA, 23 bp, Artificial Sequence
  HLA-A targeting gRNA
gggaagaaaatgccctatgaggg

SEQ ID NO: 7188 - DNA, 23 bp, Artificial Sequence
  HLA-A targeting gRNA
gggaagaaaatgccctgtgaggg

SEQ ID NO: 7189 - DNA, 23 bp, Artificial Sequence
  HLA-A targeting gRNA
gggaagaaaatgtcctgtgaggg

SEQ ID NO: 7190 - DNA, 23 bp, Artificial Sequence
  HLA-A targeting gRNA
gggaagatggctcccatctcagg

SEQ ID NO: 7191 - DNA, 23 bp, Artificial Sequence
  HLA-A targeting gRNA
gggaagcaaatgtcctgtgaggg

SEQ ID NO: 7192 - DNA, 23 bp, Artificial Sequence
  HLA-A targeting gRNA
gggaagcagcatccacacagggg

SEQ ID NO: 7193 - DNA, 23 bp, Artificial Sequence
  HLA-A targeting gRNA
gggaagcagcatcctcacagggg

SEQ ID NO: 7194 - DNA, 23 bp, Artificial Sequence
  HLA-A targeting gRNA
gggaagcagcatgcacacagggg

SEQ ID NO: 7195 - DNA, 23 bp, Artificial Sequence
  HLA-A targeting gRNA
gggaagccgcgcagggaggaggg

SEQ ID NO: 7196 - DNA, 23 bp, Artificial Sequence
  HLA-A targeting gRNA
gggaagcggcctctatggagagg

SEQ ID NO: 7197 - DNA, 23 bp, Artificial Sequence
  HLA-A targeting gRNA
gggaagcggcctctgcggagagg

SEQ ID NO: 7198 - DNA, 23 bp, Artificial Sequence
  HLA-A targeting gRNA
gggaaggctccccactgccccgg

SEQ ID NO: 7199 - DNA, 23 bp, Artificial Sequence
  HLA-A targeting gRNA
gggaatcggcctctgcggagagg

SEQ ID NO: 7200 - DNA, 23 bp, Artificial Sequence
  HLA-A targeting gRNA
gggacacctggggtggggaaggg

SEQ ID NO: 7201 - DNA, 23 bp, Artificial Sequence
  HLA-A targeting gRNA
gggacagtggactgggaagacgg

SEQ ID NO: 7202 - DNA, 23 bp, Artificial Sequence
  HLA-A targeting gRNA
gggaccacggcgacgctgattgg

SEQ ID NO: 7203 - DNA, 23 bp, Artificial Sequence
  HLA-A targeting gRNA
gggaccccggcgacactgattgg

SEQ ID NO: 7204 - DNA, 23 bp, Artificial Sequence
  HLA-A targeting gRNA
gggaccccggcgacgctgattgg

SEQ ID NO: 7205 - DNA, 23 bp, Artificial Sequence
  HLA-A targeting gRNA
gggaccgcaggcgggggcgcagg

SEQ ID NO: 7206 - DNA, 23 bp, Artificial Sequence
  HLA-A targeting gRNA
gggaccgcaggcgggggctcagg

SEQ ID NO: 7207 - DNA, 23 bp, Artificial Sequence
  HLA-A targeting gRNA
gggaccgcggcaacgctgattgg

SEQ ID NO: 7208 - DNA, 23 bp, Artificial Sequence
  HLA-A targeting gRNA
gggaccgcggcgacgctgattgg

SEQ ID NO: 7209 - DNA, 23 bp, Artificial Sequence
  HLA-A targeting gRNA
gggacctgcgccccgggccgggg

SEQ ID NO: 7210 - DNA, 23 bp, Artificial Sequence
  HLA-A targeting gRNA
gggacgcgtcacgagtatcccgg

SEQ ID NO: 7211 - DNA, 23 bp, Artificial Sequence
  HLA-A targeting gRNA
gggacgcgtcacgagtatcctgg

SEQ ID NO: 7212 - DNA, 23 bp, Artificial Sequence
  HLA-A targeting gRNA
gggacgcgtcatgagtattcagg

SEQ ID NO: 7213 - DNA, 23 bp, Artificial Sequence
  HLA-A targeting gRNA
gggacggtggactgggaagacgg

SEQ ID NO: 7214 - DNA, 23 bp, Artificial Sequence
  HLA-A targeting gRNA
gggacggtggactgggaagatgg

SEQ ID NO: 7215 - DNA, 23 bp, Artificial Sequence
  HLA-A targeting gRNA
gggacggtggattgggaagatgg

SEQ ID NO: 7216 - DNA, 23 bp, Artificial Sequence
  HLA-A targeting gRNA
gggacgtttcgagtgtgtggtgg

SEQ ID NO: 7217 - DNA, 23 bp, Artificial Sequence
  HLA-A targeting gRNA
gggactctccgcggccgggccgg

SEQ ID NO: 7218 - DNA, 23 bp, Artificial Sequence
  HLA-A targeting gRNA
gggactgcggagacgctgattgg

SEQ ID NO: 7219 - DNA, 23 bp, Artificial Sequence
  HLA-A targeting gRNA
gggactgcgtagacgctgattgg

SEQ ID NO: 7220 - DNA, 23 bp, Artificial Sequence
  HLA-A targeting gRNA
gggactggggcggggctcggggg

SEQ ID NO: 7221 - DNA, 23 bp, Artificial Sequence
  HLA-A targeting gRNA
gggagaagaagtgaaactcaggg

SEQ ID NO: 7222 - DNA, 23 bp, Artificial Sequence
  HLA-A targeting gRNA
gggagaagaagtgaaactcgtgg

SEQ ID NO: 7223 - DNA, 23 bp, Artificial Sequence
  HLA-A targeting gRNA
gggagaagaagtgaaactcttgg

SEQ ID NO: 7224 - DNA, 23 bp, Artificial Sequence
  HLA-A targeting gRNA
gggagaatccgagtccgggtggg

SEQ ID NO: 7225 - DNA, 23 bp, Artificial Sequence
  HLA-A targeting gRNA
gggagaatctgagtccgggtggg

SEQ ID NO: 7226 - DNA, 23 bp, Artificial Sequence
  HLA-A targeting gRNA
gggagaatgtgagtccgggtggg

SEQ ID NO: 7227 - DNA, 23 bp, Artificial Sequence
  HLA-A targeting gRNA
gggagactgggggcgaggagggg

SEQ ID NO: 7228 - DNA, 23 bp, Artificial Sequence
  HLA-A targeting gRNA
gggagactgggggtgaggagggg

SEQ ID NO: 7229 - DNA, 23 bp, Artificial Sequence
  HLA-A targeting gRNA
gggagcctgggagcgaggagggg

SEQ ID NO: 7230 - DNA, 23 bp, Artificial Sequence
  HLA-A targeting gRNA
gggagcctgggggagaggagggg

SEQ ID NO: 7231 - DNA, 23 bp, Artificial Sequence
  HLA-A targeting gRNA
gggagcctgggggccaggagggg

SEQ ID NO: 7232 - DNA, 23 bp, Artificial Sequence
  HLA-A targeting gRNA
gggagcctgggggcgaggagggg

SEQ ID NO: 7233 - DNA, 23 bp, Artificial Sequence
  HLA-A targeting gRNA
gggagcctgggggtgaggagggg

SEQ ID NO: 7234 - DNA, 23 bp, Artificial Sequence
  HLA-A targeting gRNA
gggagctcaggtcctcgttcagg

SEQ ID NO: 7235 - DNA, 23 bp, Artificial Sequence
  HLA-A targeting gRNA
gggaggagagaggggaccgcagg

SEQ ID NO: 7236 - DNA, 23 bp, Artificial Sequence
  HLA-A targeting gRNA
gggaggagcaaggggaccgcagg

SEQ ID NO: 7237 - DNA, 23 bp, Artificial Sequence
  HLA-A targeting gRNA
gggaggagcgaggggaccgcagg

SEQ ID NO: 7238 - DNA, 23 bp, Artificial Sequence
  HLA-A targeting gRNA
gggaggctgggggcgaggagggg

SEQ ID NO: 7239 - DNA, 23 bp, Artificial Sequence
  HLA-A targeting gRNA
gggagggaaatggcctctgccgg

SEQ ID NO: 7240 - DNA, 23 bp, Artificial Sequence
  HLA-A targeting gRNA
gggagggaaatggcctctgtggg

SEQ ID NO: 7241 - DNA, 23 bp, Artificial Sequence
  HLA-A targeting gRNA
gggagggcctgtgcgtggagtgg

SEQ ID NO: 7242 - DNA, 23 bp, Artificial Sequence
  HLA-A targeting gRNA
gggaggggccctcccggcgaggg

SEQ ID NO: 7243 - DNA, 23 bp, Artificial Sequence
  HLA-A targeting gRNA
gggagggggcagagggggaaagg

SEQ ID NO: 7244 - DNA, 23 bp, Artificial Sequence
  HLA-A targeting gRNA
gggagtcgtgacctgcgccccgg

SEQ ID NO: 7245 - DNA, 23 bp, Artificial Sequence
  HLA-A targeting gRNA
gggatgcagcatccacacagggg

SEQ ID NO: 7246 - DNA, 23 bp, Artificial Sequence
  HLA-A targeting gRNA
gggatgcgtcacgagtatcctgg

SEQ ID NO: 7247 - DNA, 23 bp, Artificial Sequence
  HLA-A targeting gRNA
gggatggcctcccacgaggaagg

SEQ ID NO: 7248 - DNA, 23 bp, Artificial Sequence
  HLA-A targeting gRNA
gggatggcctcccacgaggaggg

SEQ ID NO: 7249 - DNA, 23 bp, Artificial Sequence
  HLA-A targeting gRNA
gggatggccttccacgaggaggg

SEQ ID NO: 7250 - DNA, 23 bp, Artificial Sequence
  HLA-A targeting gRNA
gggatggtaggctgggaagatgg

SEQ ID NO: 7251 - DNA, 23 bp, Artificial Sequence
  HLA-A targeting gRNA
gggatggtggactgggaagacgg

SEQ ID NO: 7252 - DNA, 23 bp, Artificial Sequence
  HLA-A targeting gRNA
gggatggtggactgggaagatgg

SEQ ID NO: 7253 - DNA, 23 bp, Artificial Sequence
  HLA-A targeting gRNA
gggatgttacgcgtgtgtggtgg

SEQ ID NO: 7254 - DNA, 23 bp, Artificial Sequence
  HLA-A targeting gRNA
gggatgtttcgcgtgtgtcgtgg

SEQ ID NO: 7255 - DNA, 23 bp, Artificial Sequence
  HLA-A targeting gRNA
gggatgtttcgcgtgtgtgatgg

SEQ ID NO: 7256 - DNA, 23 bp, Artificial Sequence
  HLA-A targeting gRNA
gggatgtttcgcgtgtgtggtgg

SEQ ID NO: 7257 - DNA, 23 bp, Artificial Sequence
  HLA-A targeting gRNA
gggcagagggggaaaggcctggg

SEQ ID NO: 7258 - DNA, 23 bp, Artificial Sequence
  HLA-A targeting gRNA
gggcaggatcaggaaacacaagg

SEQ ID NO: 7259 - DNA, 23 bp, Artificial Sequence
  HLA-A targeting gRNA
gggcaggatcaggaaacacaggg

SEQ ID NO: 7260 - DNA, 23 bp, Artificial Sequence
  HLA-A targeting gRNA
gggcaggatcaggaaacacgagg

SEQ ID NO: 7261 - DNA, 23 bp, Artificial Sequence
  HLA-A targeting gRNA
gggcaggatcaggaaacacgggg

SEQ ID NO: 7262 - DNA, 23 bp, Artificial Sequence
  HLA-A targeting gRNA
gggcaggatcaggaaacatgggg

SEQ ID NO: 7263 - DNA, 23 bp, Artificial Sequence
  HLA-A targeting gRNA
gggcattttcttcccacaggtgg

SEQ ID NO: 7264 - DNA, 23 bp, Artificial Sequence
  HLA-A targeting gRNA
gggccccccagagcagcaggagg

SEQ ID NO: 7265 - DNA, 23 bp, Artificial Sequence
  HLA-A targeting gRNA
gggccctgggcttctaccctggg

SEQ ID NO: 7266 - DNA, 23 bp, Artificial Sequence
  HLA-A targeting gRNA
gggccgccgagagcagcaggagg

SEQ ID NO: 7267 - DNA, 23 bp, Artificial Sequence
  HLA-A targeting gRNA
gggccgcctccaacttgcgctgg

SEQ ID NO: 7268 - DNA, 23 bp, Artificial Sequence
  HLA-A targeting gRNA
gggccgcctccaacttgggctgg

SEQ ID NO: 7269 - DNA, 23 bp, Artificial Sequence
  HLA-A targeting gRNA
gggccgcctccaacttgtgctgg

SEQ ID NO: 7270 - DNA, 23 bp, Artificial Sequence
  HLA-A targeting gRNA
gggccgcctcccacttacgctgg

SEQ ID NO: 7271 - DNA, 23 bp, Artificial Sequence
  HLA-A targeting gRNA
gggccgcctcccacttgagctgg

SEQ ID NO: 7272 - DNA, 23 bp, Artificial Sequence
  HLA-A targeting gRNA
gggccgcctcccacttgggctgg

SEQ ID NO: 7273 - DNA, 23 bp, Artificial Sequence
  HLA-A targeting gRNA
gggccgcctcccatttgcgctgg

SEQ ID NO: 7274 - DNA, 23 bp, Artificial Sequence
  HLA-A targeting gRNA
gggccgcgtctgcaatggggagg

SEQ ID NO: 7275 - DNA, 23 bp, Artificial Sequence
  HLA-A targeting gRNA
gggccgcgtctgcattggggagg

SEQ ID NO: 7276 - DNA, 23 bp, Artificial Sequence
  HLA-A targeting gRNA
gggccggtgagtgcgggatcggg

SEQ ID NO: 7277 - DNA, 23 bp, Artificial Sequence
  HLA-A targeting gRNA
gggccggtgagtgcggggtcggg

SEQ ID NO: 7278 - DNA, 23 bp, Artificial Sequence
  HLA-A targeting gRNA
gggccggtgagtgcggggttggg

SEQ ID NO: 7279 - DNA, 23 bp, Artificial Sequence
  HLA-A targeting gRNA
gggccgtgtctgcactggggagg

SEQ ID NO: 7280 - DNA, 23 bp, Artificial Sequence
  HLA-A targeting gRNA
gggccgtgtctgcattggggagg

SEQ ID NO: 7281 - DNA, 23 bp, Artificial Sequence
  HLA-A targeting gRNA
gggcctgtgagtgcgaggttggg

SEQ ID NO: 7282 - DNA, 23 bp, Artificial Sequence
  HLA-A targeting gRNA
gggcctgtgagtgcggggttagg

SEQ ID NO: 7283 - DNA, 23 bp, Artificial Sequence
  HLA-A targeting gRNA
gggcctgtgagtgcggggttggg

SEQ ID NO: 7284 - DNA, 23 bp, Artificial Sequence
  HLA-A targeting gRNA
gggcgaccccggccgtacgtggg

SEQ ID NO: 7285 - DNA, 23 bp, Artificial Sequence
  HLA-A targeting gRNA
gggcgacccgggccgtacgtggg

SEQ ID NO: 7286 - DNA, 23 bp, Artificial Sequence
  HLA-A targeting gRNA
gggcgacccgggccgtccgtggg

SEQ ID NO: 7287 - DNA, 23 bp, Artificial Sequence
  HLA-A targeting gRNA
gggcgccatcctcggactcgcgg

SEQ ID NO: 7288 - DNA, 23 bp, Artificial Sequence
  HLA-A targeting gRNA
gggcgccatcctcggactcgtgg

SEQ ID NO: 7289 - DNA, 23 bp, Artificial Sequence
  HLA-A targeting gRNA
gggcgccatgaccagcatctcgg

SEQ ID NO: 7290 - DNA, 23 bp, Artificial Sequence
  HLA-A targeting gRNA
gggcgccatgaccagcatcttgg

SEQ ID NO: 7291 - DNA, 23 bp, Artificial Sequence
  HLA-A targeting gRNA
gggcgccatgacccgcatctcgg

SEQ ID NO: 7292 - DNA, 23 bp, Artificial Sequence
  HLA-A targeting gRNA
gggcgccgtgacccgcatctcgg

SEQ ID NO: 7293 - DNA, 23 bp, Artificial Sequence
  HLA-A targeting gRNA
gggcgccgtgggtggaggagggg

SEQ ID NO: 7294 - DNA, 23 bp, Artificial Sequence
  HLA-A targeting gRNA
gggcgcctcctccgcgggtatgg

SEQ ID NO: 7295 - DNA, 23 bp, Artificial Sequence
  HLA-A targeting gRNA
gggcggattccgcagcctcgggg

SEQ ID NO: 7296 - DNA, 23 bp, Artificial Sequence
  HLA-A targeting gRNA
gggcggggcggggcggggccggg

SEQ ID NO: 7297 - DNA, 23 bp, Artificial Sequence
  HLA-A targeting gRNA
gggcggggcggggcggggctcgg

SEQ ID NO: 7298 - DNA, 23 bp, Artificial Sequence
  HLA-A targeting gRNA
gggcggggctcggggggacgggg

SEQ ID NO: 7299 - DNA, 23 bp, Artificial Sequence
  HLA-A targeting gRNA
gggcggggctcggggggactggg

SEQ ID NO: 7300 - DNA, 23 bp, Artificial Sequence
  HLA-A targeting gRNA
gggcggggggggcggggaggggg

SEQ ID NO: 7301 - DNA, 23 bp, Artificial Sequence
  HLA-A targeting gRNA
gggcggggggggggtggggtggg

SEQ ID NO: 7302 - DNA, 23 bp, Artificial Sequence
  HLA-A targeting gRNA
gggcgggggggggtggggtgggg

SEQ ID NO: 7303 - DNA, 23 bp, Artificial Sequence
  HLA-A targeting gRNA
gggcgggtcccgcggcctcaggg

SEQ ID NO: 7304 - DNA, 23 bp, Artificial Sequence
  HLA-A targeting gRNA
gggcgggtcccgcggcctcgggg

SEQ ID NO: 7305 - DNA, 23 bp, Artificial Sequence
  HLA-A targeting gRNA
gggcgggttccgcagcctcgggg

SEQ ID NO: 7306 - DNA, 23 bp, Artificial Sequence
  HLA-A targeting gRNA
gggctccatcctcggactcgcgg

SEQ ID NO: 7307 - DNA, 23 bp, Artificial Sequence
  HLA-A targeting gRNA
gggctccccacggccgggccggg

SEQ ID NO: 7308 - DNA, 23 bp, Artificial Sequence
  HLA-A targeting gRNA
gggctccccgcagccgggccggg

SEQ ID NO: 7309 - DNA, 23 bp, Artificial Sequence
  HLA-A targeting gRNA
gggctccccgcggccaggccggg

SEQ ID NO: 7310 - DNA, 23 bp, Artificial Sequence
  HLA-A targeting gRNA
gggctccccgcggccgggccagg

SEQ ID NO: 7311 - DNA, 23 bp, Artificial Sequence
  HLA-A targeting gRNA
gggctccccgctgccgggccggg

SEQ ID NO: 7312 - DNA, 23 bp, Artificial Sequence
  HLA-A targeting gRNA
gggctcccctctcggactcgcgg

SEQ ID NO: 7313 - DNA, 23 bp, Artificial Sequence
  HLA-A targeting gRNA
gggctcccctctcggacttgcgg

SEQ ID NO: 7314 - DNA, 23 bp, Artificial Sequence
  HLA-A targeting gRNA
gggctcccgagagcagcaggagg

SEQ ID NO: 7315 - DNA, 23 bp, Artificial Sequence
  HLA-A targeting gRNA
gggctccgtcctcggactcgcgg

SEQ ID NO: 7316 - DNA, 23 bp, Artificial Sequence
  HLA-A targeting gRNA
gggctctccgcggccaggccggg

SEQ ID NO: 7317 - DNA, 23 bp, Artificial Sequence
  HLA-A targeting gRNA
gggctctccgcggccgggccagg

SEQ ID NO: 7318 - DNA, 23 bp, Artificial Sequence
  HLA-A targeting gRNA
gggctctccgcggccgggcccgg

SEQ ID NO: 7319 - DNA, 23 bp, Artificial Sequence
  HLA-A targeting gRNA
gggctctccgcggccgggccggg

SEQ ID NO: 7320 - DNA, 23 bp, Artificial Sequence
  HLA-A targeting gRNA
gggctctccgcggcctggccggg

SEQ ID NO: 7321 - DNA, 23 bp, Artificial Sequence
  HLA-A targeting gRNA
gggctctccgcggctgggccggg

SEQ ID NO: 7322 - DNA, 23 bp, Artificial Sequence
  HLA-A targeting gRNA
gggctgaggcttggaggtcaggg

SEQ ID NO: 7323 - DNA, 23 bp, Artificial Sequence
  HLA-A targeting gRNA
gggctgaggcttgggggtcaggg

SEQ ID NO: 7324 - DNA, 23 bp, Artificial Sequence
  HLA-A targeting gRNA
gggctgaggcttgggtgtaaggg

SEQ ID NO: 7325 - DNA, 23 bp, Artificial Sequence
  HLA-A targeting gRNA
gggctgcctcccacttgcgctgg

SEQ ID NO: 7326 - DNA, 23 bp, Artificial Sequence
  HLA-A targeting gRNA
gggctgggtgatctgagccgcgg

SEQ ID NO: 7327 - DNA, 23 bp, Artificial Sequence
  HLA-A targeting gRNA
gggctggtgagtgcggggtcggg

SEQ ID NO: 7328 - DNA, 23 bp, Artificial Sequence
  HLA-A targeting gRNA
ggggaaaggcctgggtaatgggg

SEQ ID NO: 7329 - DNA, 23 bp, Artificial Sequence
  HLA-A targeting gRNA
ggggaccgggctgaccacggggg

SEQ ID NO: 7330 - DNA, 23 bp, Artificial Sequence
  HLA-A targeting gRNA
ggggacggggctgaccacggggg

SEQ ID NO: 7331 - DNA, 23 bp, Artificial Sequence
  HLA-A targeting gRNA
ggggacggggctgaccgcggggg

SEQ ID NO: 7332 - DNA, 23 bp, Artificial Sequence
  HLA-A targeting gRNA
ggggactgggctgaccacggggg

SEQ ID NO: 7333 - DNA, 23 bp, Artificial Sequence
  HLA-A targeting gRNA
ggggactgggctgaccgcgaggg

SEQ ID NO: 7334 - DNA, 23 bp, Artificial Sequence
  HLA-A targeting gRNA
ggggactgggctgaccgcggggg

SEQ ID NO: 7335 - DNA, 23 bp, Artificial Sequence
  HLA-A targeting gRNA
ggggagaatccgagtccgggtgg

SEQ ID NO: 7336 - DNA, 23 bp, Artificial Sequence
  HLA-A targeting gRNA
ggggagaatctgagtccgggtgg

SEQ ID NO: 7337 - DNA, 23 bp, Artificial Sequence
  HLA-A targeting gRNA
ggggagaatgtgagtccgggtgg

SEQ ID NO: 7338 - DNA, 23 bp, Artificial Sequence
  HLA-A targeting gRNA
ggggagactcggggcgacccggg

SEQ ID NO: 7339 - DNA, 23 bp, Artificial Sequence
  HLA-A targeting gRNA
ggggagactctaggcgacccggg

SEQ ID NO: 7340 - DNA, 23 bp, Artificial Sequence
  HLA-A targeting gRNA
ggggagactctgggcgacccggg

SEQ ID NO: 7341 - DNA, 23 bp, Artificial Sequence
  HLA-A targeting gRNA
ggggagccgcgcagggaggaggg

SEQ ID NO: 7342 - DNA, 23 bp, Artificial Sequence
  HLA-A targeting gRNA
ggggagccgcgcagggaggtggg

SEQ ID NO: 7343 - DNA, 23 bp, Artificial Sequence
  HLA-A targeting gRNA
ggggagccgcgccgggaggtggg

SEQ ID NO: 7344 - DNA, 23 bp, Artificial Sequence
  HLA-A targeting gRNA
ggggagccgcgccggtaggaggg

SEQ ID NO: 7345 - DNA, 23 bp, Artificial Sequence
  HLA-A targeting gRNA
ggggagcggcgcagggaggaggg

SEQ ID NO: 7346 - DNA, 23 bp, Artificial Sequence
  HLA-A targeting gRNA
ggggagcggcgcagggaggtggg

SEQ ID NO: 7347 - DNA, 23 bp, Artificial Sequence
  HLA-A targeting gRNA
ggggagggggcagaggggaaagg

SEQ ID NO: 7348 - DNA, 23 bp, Artificial Sequence
  HLA-A targeting gRNA
ggggcagagggaaaaggcctagg

SEQ ID NO: 7349 - DNA, 23 bp, Artificial Sequence
  HLA-A targeting gRNA
ggggcagagggaaaaggcctggg

SEQ ID NO: 7350 - DNA, 23 bp, Artificial Sequence
  HLA-A targeting gRNA
ggggcagaggggaaaggcctggg

SEQ ID NO: 7351 - DNA, 23 bp, Artificial Sequence
  HLA-A targeting gRNA
ggggcagagggggaaaggcctgg

SEQ ID NO: 7352 - DNA, 23 bp, Artificial Sequence
  HLA-A targeting gRNA
ggggcagtggggaaaggcctggg

SEQ ID NO: 7353 - DNA, 23 bp, Artificial Sequence
  HLA-A targeting gRNA
ggggccagagtattgggaccggg

SEQ ID NO: 7354 - DNA, 23 bp, Artificial Sequence
  HLA-A targeting gRNA
ggggccccgaccctgctgaaggg

SEQ ID NO: 7355 - DNA, 23 bp, Artificial Sequence
  HLA-A targeting gRNA
ggggccctcagaagaaactcagg

SEQ ID NO: 7356 - DNA, 23 bp, Artificial Sequence
  HLA-A targeting gRNA
ggggccctcagaggaaactcagg

SEQ ID NO: 7357 - DNA, 23 bp, Artificial Sequence
  HLA-A targeting gRNA
ggggccctcagaggaaactcggg

SEQ ID NO: 7358 - DNA, 23 bp, Artificial Sequence
  HLA-A targeting gRNA
ggggccctgaccctgctgaaggg

SEQ ID NO: 7359 - DNA, 23 bp, Artificial Sequence
  HLA-A targeting gRNA
ggggccggagtactgggaccggg

SEQ ID NO: 7360 - DNA, 23 bp, Artificial Sequence
  HLA-A targeting gRNA
ggggccggagtattaggaccggg

SEQ ID NO: 7361 - DNA, 23 bp, Artificial Sequence
  HLA-A targeting gRNA
ggggccggagtattgggaccggg

SEQ ID NO: 7362 - DNA, 23 bp, Artificial Sequence
  HLA-A targeting gRNA
ggggccggagtgttgggaccggg

SEQ ID NO: 7363 - DNA, 23 bp, Artificial Sequence
  HLA-A targeting gRNA
ggggcgaccccggccgtacgtgg

SEQ ID NO: 7364 - DNA, 23 bp, Artificial Sequence
  HLA-A targeting gRNA
ggggcgacccgggccgtacgtgg

SEQ ID NO: 7365 - DNA, 23 bp, Artificial Sequence
  HLA-A targeting gRNA
ggggcgacccgggccgtccgtgg

SEQ ID NO: 7366 - DNA, 23 bp, Artificial Sequence
  HLA-A targeting gRNA
ggggcggggagggggcagagggg

SEQ ID NO: 7367 - DNA, 23 bp, Artificial Sequence
  HLA-A targeting gRNA
ggggcggggccggggggacgggg

SEQ ID NO: 7368 - DNA, 23 bp, Artificial Sequence
  HLA-A targeting gRNA
ggggcggggcggggcggggccgg

SEQ ID NO: 7369 - DNA, 23 bp, Artificial Sequence
  HLA-A targeting gRNA
ggggcggggcggggctcgggggg

SEQ ID NO: 7370 - DNA, 23 bp, Artificial Sequence
  HLA-A targeting gRNA
ggggcggggctcgcgggacgggg

SEQ ID NO: 7371 - DNA, 23 bp, Artificial Sequence
  HLA-A targeting gRNA
ggggcggggctcgggggacgggg

SEQ ID NO: 7372 - DNA, 23 bp, Artificial Sequence
  HLA-A targeting gRNA
ggggcggggctcggggggacggg

SEQ ID NO: 7373 - DNA, 23 bp, Artificial Sequence
  HLA-A targeting gRNA
ggggcggggctcggggggactgg

SEQ ID NO: 7374 - DNA, 23 bp, Artificial Sequence
  HLA-A targeting gRNA
ggggcggggttcgggggacgggg

SEQ ID NO: 7375 - DNA, 23 bp, Artificial Sequence
  HLA-A targeting gRNA
ggggctccccacggccgggccgg

SEQ ID NO: 7376 - DNA, 23 bp, Artificial Sequence
  HLA-A targeting gRNA
ggggctccccgcagccgggccgg

SEQ ID NO: 7377 - DNA, 23 bp, Artificial Sequence
  HLA-A targeting gRNA
ggggctccccgcggccaggccgg

SEQ ID NO: 7378 - DNA, 23 bp, Artificial Sequence
  HLA-A targeting gRNA
ggggctccccgctgccgggccgg

SEQ ID NO: 7379 - DNA, 23 bp, Artificial Sequence
  HLA-A targeting gRNA
ggggctctccgcggccaggccgg

SEQ ID NO: 7380 - DNA, 23 bp, Artificial Sequence
  HLA-A targeting gRNA
ggggctctccgcggccgggccgg

SEQ ID NO: 7381 - DNA, 23 bp, Artificial Sequence
  HLA-A targeting gRNA
ggggctctccgcggcctggccgg

SEQ ID NO: 7382 - DNA, 23 bp, Artificial Sequence
  HLA-A targeting gRNA
ggggctctccgcggctgggccgg

SEQ ID NO: 7383 - DNA, 23 bp, Artificial Sequence
  HLA-A targeting gRNA
ggggctggagtattgggaccggg

SEQ ID NO: 7384 - DNA, 23 bp, Artificial Sequence
  HLA-A targeting gRNA
ggggctggggcggggctcgcggg

SEQ ID NO: 7385 - DNA, 23 bp, Artificial Sequence
  HLA-A targeting gRNA
ggggctggggcggggctcggggg

SEQ ID NO: 7386 - DNA, 23 bp, Artificial Sequence
  HLA-A targeting gRNA
ggggctggggcggggttcggggg

SEQ ID NO: 7387 - DNA, 23 bp, Artificial Sequence
  HLA-A targeting gRNA
gggggaccgggctgaccacgggg

SEQ ID NO: 7388 - DNA, 23 bp, Artificial Sequence
  HLA-A targeting gRNA
gggggacgggctgaccacggggg

SEQ ID NO: 7389 - DNA, 23 bp, Artificial Sequence
  HLA-A targeting gRNA
gggggacggggctgaccacgggg

SEQ ID NO: 7390 - DNA, 23 bp, Artificial Sequence
  HLA-A targeting gRNA
gggggacggggctgaccgcgggg

SEQ ID NO: 7391 - DNA, 23 bp, Artificial Sequence
  HLA-A targeting gRNA
gggggacggggctggccgcgggg

SEQ ID NO: 7392 - DNA, 23 bp, Artificial Sequence
  HLA-A targeting gRNA
gggggacggtgctgaccgcgggg

SEQ ID NO: 7393 - DNA, 23 bp, Artificial Sequence
  HLA-A targeting gRNA
gggggactgggctgaccacgggg

SEQ ID NO: 7394 - DNA, 23 bp, Artificial Sequence
  HLA-A targeting gRNA
gggggactgggctgaccgcgagg

SEQ ID NO: 7395 - DNA, 23 bp, Artificial Sequence
  HLA-A targeting gRNA
gggggagccgcgggcgccgtggg

SEQ ID NO: 7396 - DNA, 23 bp, Artificial Sequence
  HLA-A targeting gRNA
gggggcagaggggaaaggcctgg

SEQ ID NO: 7397 - DNA, 23 bp, Artificial Sequence
  HLA-A targeting gRNA
gggggccctcagaggaaactcgg

SEQ ID NO: 7398 - DNA, 23 bp, Artificial Sequence
  HLA-A targeting gRNA
gggggcggggagggggcagaggg

SEQ ID NO: 7399 - DNA, 23 bp, Artificial Sequence
  HLA-A targeting gRNA
ggggggacggggctgaccgcggg

SEQ ID NO: 7400 - DNA, 23 bp, Artificial Sequence
  HLA-A targeting gRNA
ggggggactgggctgaccgcggg

SEQ ID NO: 7401 - DNA, 23 bp, Artificial Sequence
  HLA-A targeting gRNA
ggggggagccgcgggcgccgtgg

SEQ ID NO: 7402 - DNA, 23 bp, Artificial Sequence
  HLA-A targeting gRNA
ggggggcggggagggggcagagg

SEQ ID NO: 7403 - DNA, 23 bp, Artificial Sequence
  HLA-A targeting gRNA
ggggggggggcagaggggaaagg

SEQ ID NO: 7404 - DNA, 23 bp, Artificial Sequence
  HLA-A targeting gRNA
ggggggggggtggggtggggagg

SEQ ID NO: 7405 - DNA, 23 bp, Artificial Sequence
  HLA-A targeting gRNA
gggggggggtggggtggggaggg

SEQ ID NO: 7406 - DNA, 23 bp, Artificial Sequence
  HLA-A targeting gRNA
ggggggggtggggtggggagggg

SEQ ID NO: 7407 - DNA, 23 bp, Artificial Sequence
  HLA-A targeting gRNA
ggggggggtggtggggcagaggg

SEQ ID NO: 7408 - DNA, 23 bp, Artificial Sequence
  HLA-A targeting gRNA
gggggggtggggtggggaggggg

SEQ ID NO: 7409 - DNA, 23 bp, Artificial Sequence
  HLA-A targeting gRNA
gggggggtggtggggcagagggg

SEQ ID NO: 7410 - DNA, 23 bp, Artificial Sequence
  HLA-A targeting gRNA
gggggtggcgggtctggggcggg

SEQ ID NO: 7411 - DNA, 23 bp, Artificial Sequence
  HLA-A targeting gRNA
gggggtggggcagagggaaaagg

SEQ ID NO: 7412 - DNA, 23 bp, Artificial Sequence
  HLA-A targeting gRNA
ggggtaaggaggggaatgggggg

SEQ ID NO: 7413 - DNA, 23 bp, Artificial Sequence
  HLA-A targeting gRNA
ggggtaaggagggggatgagggg

SEQ ID NO: 7414 - DNA, 23 bp, Artificial Sequence
  HLA-A targeting gRNA
ggggtcctgaccctgctgaaggg

SEQ ID NO: 7415 - DNA, 23 bp, Artificial Sequence
  HLA-A targeting gRNA
ggggtcgctccgcagatacctgg

SEQ ID NO: 7416 - DNA, 23 bp, Artificial Sequence
  HLA-A targeting gRNA
ggggtcgggacctgcgccccggg

SEQ ID NO: 7417 - DNA, 23 bp, Artificial Sequence
  HLA-A targeting gRNA
ggggtcgtgacctgcgccccagg

SEQ ID NO: 7418 - DNA, 23 bp, Artificial Sequence
  HLA-A targeting gRNA
ggggtctagagtgggcagggggg

SEQ ID NO: 7419 - DNA, 23 bp, Artificial Sequence
  HLA-A targeting gRNA
ggggtctagagtgggcggggggg

SEQ ID NO: 7420 - DNA, 23 bp, Artificial Sequence
  HLA-A targeting gRNA
ggggtctagagtgggtggggtgg

SEQ ID NO: 7421 - DNA, 23 bp, Artificial Sequence
  HLA-A targeting gRNA
ggggtggcaggtctgggggtggg

SEQ ID NO: 7422 - DNA, 23 bp, Artificial Sequence
  HLA-A targeting gRNA
ggggtggcgggtctggggcgggg

SEQ ID NO: 7423 - DNA, 23 bp, Artificial Sequence
  HLA-A targeting gRNA
ggggtggcgggtctggggggggg

SEQ ID NO: 7424 - DNA, 23 bp, Artificial Sequence
  HLA-A targeting gRNA
ggggtggcgggtctgggggtggg

SEQ ID NO: 7425 - DNA, 23 bp, Artificial Sequence
  HLA-A targeting gRNA
ggggtggggagggggcagagggg

SEQ ID NO: 7426 - DNA, 23 bp, Artificial Sequence
  HLA-A targeting gRNA
gggtcacatgtgtctttgggggg

SEQ ID NO: 7427 - DNA, 23 bp, Artificial Sequence
  HLA-A targeting gRNA
gggtcacgtgtgtctttgcgggg

SEQ ID NO: 7428 - DNA, 23 bp, Artificial Sequence
  HLA-A targeting gRNA
gggtcacgtgtgtctttgggggg

SEQ ID NO: 7429 - DNA, 23 bp, Artificial Sequence
  HLA-A targeting gRNA
gggtcagggctgaggcttggagg

SEQ ID NO: 7430 - DNA, 23 bp, Artificial Sequence
  HLA-A targeting gRNA
gggtcagggctgaggcttggggg

SEQ ID NO: 7431 - DNA, 23 bp, Artificial Sequence
  HLA-A targeting gRNA
gggtcccgcggcctcgggggcgg

SEQ ID NO: 7432 - DNA, 23 bp, Artificial Sequence
  HLA-A targeting gRNA
gggtccgagatccgcccccgagg

SEQ ID NO: 7433 - DNA, 23 bp, Artificial Sequence
  HLA-A targeting gRNA
gggtcctgagcccccgcctgcgg

SEQ ID NO: 7434 - DNA, 23 bp, Artificial Sequence
  HLA-A targeting gRNA
gggtcctgcgcccccgcctgcgg

SEQ ID NO: 7435 - DNA, 23 bp, Artificial Sequence
  HLA-A targeting gRNA
gggtctagagtgggcgggggggg

SEQ ID NO: 7436 - DNA, 23 bp, Artificial Sequence
  HLA-A targeting gRNA
gggtctagagtgggtgggggtgg

SEQ ID NO: 7437 - DNA, 23 bp, Artificial Sequence
  HLA-A targeting gRNA
gggtctccttcccgttctccagg

SEQ ID NO: 7438 - DNA, 23 bp, Artificial Sequence
  HLA-A targeting gRNA
gggtgccgtgacccgcatctcgg

SEQ ID NO: 7439 - DNA, 23 bp, Artificial Sequence
  HLA-A targeting gRNA
gggtggcctcatggtcagagagg

SEQ ID NO: 7440 - DNA, 23 bp, Artificial Sequence
  HLA-A targeting gRNA
gggtggcgggtctgggggggggg

SEQ ID NO: 7441 - DNA, 23 bp, Artificial Sequence
  HLA-A targeting gRNA
gggtggggagggggcagaggggg

SEQ ID NO: 7442 - DNA, 23 bp, Artificial Sequence
  HLA-A targeting gRNA
gggtgggggtggcgggtctgggg

SEQ ID NO: 7443 - DNA, 23 bp, Artificial Sequence
  HLA-A targeting gRNA
gggtggggtggcaggtctggggg

SEQ ID NO: 7444 - DNA, 23 bp, Artificial Sequence
  HLA-A targeting gRNA
gggtggggtggcgggtctggggg

SEQ ID NO: 7445 - DNA, 23 bp, Artificial Sequence
  HLA-A targeting gRNA
gggtgggtgacttcagaaccggg

SEQ ID NO: 7446 - DNA, 23 bp, Artificial Sequence
  HLA-A targeting gRNA
gggttccgcagatccaccttggg

SEQ ID NO: 7447 - DNA, 23 bp, Artificial Sequence
  HLA-A targeting gRNA
gggttgggcggggcggggcgggg

SEQ ID NO: 7448 - DNA, 23 bp, Artificial Sequence
  HLA-A targeting gRNA
gggttggtcagggcggggcgggg

SEQ ID NO: 7449 - DNA, 23 bp, Artificial Sequence
  HLA-A targeting gRNA
gggttggtcgggactggggcggg

SEQ ID NO: 7450 - DNA, 23 bp, Artificial Sequence
  HLA-A targeting gRNA
gggttggtcggggctggggcggg

SEQ ID NO: 7451 - DNA, 23 bp, Artificial Sequence
  HLA-A targeting gRNA
gggttttcttgtcccactggggg

SEQ ID NO: 7452 - DNA, 23 bp, Artificial Sequence
  HLA-A targeting gRNA
gggttttgttgtcccactggggg

SEQ ID NO: 7453 - DNA, 23 bp, Artificial Sequence
  HLA-A targeting gRNA
ggtaatggacattctttgattgg

SEQ ID NO: 7454 - DNA, 23 bp, Artificial Sequence
  HLA-A targeting gRNA
ggtaatggagattctttgattgg

SEQ ID NO: 7455 - DNA, 23 bp, Artificial Sequence
  HLA-A targeting gRNA
ggtaatggggatcctttgatagg

SEQ ID NO: 7456 - DNA, 23 bp, Artificial Sequence
  HLA-A targeting gRNA
ggtaatggggatcctttgattgg

SEQ ID NO: 7457 - DNA, 23 bp, Artificial Sequence
  HLA-A targeting gRNA
ggtaatggggattctttgattgg

SEQ ID NO: 7458 - DNA, 23 bp, Artificial Sequence
  HLA-A targeting gRNA
ggtactgcggagacgctgattgg

SEQ ID NO: 7459 - DNA, 23 bp, Artificial Sequence
  HLA-A targeting gRNA
ggtagaacaaaaaaaatacctgg

SEQ ID NO: 7460 - DNA, 23 bp, Artificial Sequence
  HLA-A targeting gRNA
ggtagggaaggggtgaagagcgg

SEQ ID NO: 7461 - DNA, 23 bp, Artificial Sequence
  HLA-A targeting gRNA
ggtagggaaggggtgaggagtgg

SEQ ID NO: 7462 - DNA, 23 bp, Artificial Sequence
  HLA-A targeting gRNA
ggtagggaaggggtgaggggtgg

SEQ ID NO: 7463 - DNA, 23 bp, Artificial Sequence
  HLA-A targeting gRNA
ggtagggaaggggtggggagtgg

SEQ ID NO: 7464 - DNA, 23 bp, Artificial Sequence
  HLA-A targeting gRNA
ggtcacagtggacacaagggtgg

SEQ ID NO: 7465 - DNA, 23 bp, Artificial Sequence
  HLA-A targeting gRNA
ggtcacagtggacacaaggttgg

SEQ ID NO: 7466 - DNA, 23 bp, Artificial Sequence
  HLA-A targeting gRNA
ggtcacagtggacacacagttgg

SEQ ID NO: 7467 - DNA, 23 bp, Artificial Sequence
  HLA-A targeting gRNA
ggtcacagtggacacgggggtgg

SEQ ID NO: 7468 - DNA, 23 bp, Artificial Sequence
  HLA-A targeting gRNA
ggtcacggtggacacgggggtgg

SEQ ID NO: 7469 - DNA, 23 bp, Artificial Sequence
  HLA-A targeting gRNA
ggtcagggcggggcggggctcgg

SEQ ID NO: 7470 - DNA, 23 bp, Artificial Sequence
  HLA-A targeting gRNA
ggtcccagccgtacatcctctgg

SEQ ID NO: 7471 - DNA, 23 bp, Artificial Sequence
  HLA-A targeting gRNA
ggtcccgcggcctcagggggcgg

SEQ ID NO: 7472 - DNA, 23 bp, Artificial Sequence
  HLA-A targeting gRNA
ggtcccggacggggctctcaggg

SEQ ID NO: 7473 - DNA, 23 bp, Artificial Sequence
  HLA-A targeting gRNA
ggtcccgggcggggctctcaggg

SEQ ID NO: 7474 - DNA, 23 bp, Artificial Sequence
  HLA-A targeting gRNA
ggtcccgggcggggctctctggg

SEQ ID NO: 7475 - DNA, 23 bp, Artificial Sequence
  HLA-A targeting gRNA
ggtcccgggcggggttctcaggg

SEQ ID NO: 7476 - DNA, 23 bp, Artificial Sequence
  HLA-A targeting gRNA
ggtccgagatccgccccctgagg

SEQ ID NO: 7477 - DNA, 23 bp, Artificial Sequence
  HLA-A targeting gRNA
ggtcctgcgccctcgccgggagg

SEQ ID NO: 7478 - DNA, 23 bp, Artificial Sequence
  HLA-A targeting gRNA
ggtcctgcgccctcgccgggcgg

SEQ ID NO: 7479 - DNA, 23 bp, Artificial Sequence
  HLA-A targeting gRNA
ggtcgcagccaaacatccactgg

SEQ ID NO: 7480 - DNA, 23 bp, Artificial Sequence
  HLA-A targeting gRNA
ggtcgcagccaaacatcctctgg

SEQ ID NO: 7481 - DNA, 23 bp, Artificial Sequence
  HLA-A targeting gRNA
ggtcgcagccacacatccactgg

SEQ ID NO: 7482 - DNA, 23 bp, Artificial Sequence
  HLA-A targeting gRNA
ggtcgcagccagacatcctctgg

SEQ ID NO: 7483 - DNA, 23 bp, Artificial Sequence
  HLA-A targeting gRNA
ggtcgcagccatacatccactgg

SEQ ID NO: 7484 - DNA, 23 bp, Artificial Sequence
  HLA-A targeting gRNA
ggtcgcagccatacatccgctgg

SEQ ID NO: 7485 - DNA, 23 bp, Artificial Sequence
  HLA-A targeting gRNA
ggtcgcagccatacatcctccgg

SEQ ID NO: 7486 - DNA, 23 bp, Artificial Sequence
  HLA-A targeting gRNA
ggtcgcagccatacatcctctgg

SEQ ID NO: 7487 - DNA, 23 bp, Artificial Sequence
  HLA-A targeting gRNA
ggtcgcagccgtacatccactgg

SEQ ID NO: 7488 - DNA, 23 bp, Artificial Sequence
  HLA-A targeting gRNA
ggtcgcagccgtacatcctctgg

SEQ ID NO: 7489 - DNA, 23 bp, Artificial Sequence
  HLA-A targeting gRNA
ggtcgcagccgtacatgctctgg

SEQ ID NO: 7490 - DNA, 23 bp, Artificial Sequence
  HLA-A targeting gRNA
ggtcggggcggggcggggcgggg

SEQ ID NO: 7491 - DNA, 23 bp, Artificial Sequence
  HLA-A targeting gRNA
ggtctagagtgggcggggggggg

SEQ ID NO: 7492 - DNA, 23 bp, Artificial Sequence
  HLA-A targeting gRNA
ggtgacctcatggtcagagatgg

SEQ ID NO: 7493 - DNA, 23 bp, Artificial Sequence
  HLA-A targeting gRNA
ggtgatgtatggctgcgacgtgg

SEQ ID NO: 7494 - DNA, 23 bp, Artificial Sequence
  HLA-A targeting gRNA
ggtgcccaaggctgctgcagggg

SEQ ID NO: 7495 - DNA, 23 bp, Artificial Sequence
  HLA-A targeting gRNA
ggtgccggaggattgggaccggg

SEQ ID NO: 7496 - DNA, 23 bp, Artificial Sequence
  HLA-A targeting gRNA
ggtgctctccgcggccaggccgg

SEQ ID NO: 7497 - DNA, 23 bp, Artificial Sequence
  HLA-A targeting gRNA
ggtgcttccagtaacaaggcggg

SEQ ID NO: 7498 - DNA, 23 bp, Artificial Sequence
  HLA-A targeting gRNA
ggtgcttccagtaacgaggtggg

SEQ ID NO: 7499 - DNA, 23 bp, Artificial Sequence
  HLA-A targeting gRNA
ggtggcctcatggtcagagacgg

SEQ ID NO: 7500 - DNA, 23 bp, Artificial Sequence
  HLA-A targeting gRNA
ggtggcctcatggtcagagaggg

SEQ ID NO: 7501 - DNA, 23 bp, Artificial Sequence
  HLA-A targeting gRNA
ggtggcgggtctggggggggggg

SEQ ID NO: 7502 - DNA, 23 bp, Artificial Sequence
  HLA-A targeting gRNA
ggtggggcacacttctacctggg

SEQ ID NO: 7503 - DNA, 23 bp, Artificial Sequence
  HLA-A targeting gRNA
ggtggggtggcgggtctgggggg

SEQ ID NO: 7504 - DNA, 23 bp, Artificial Sequence
  HLA-A targeting gRNA
ggtgggtcacatgtgtctttggg

SEQ ID NO: 7505 - DNA, 23 bp, Artificial Sequence
  HLA-A targeting gRNA
ggtgggtcacgtgtgtctttggg

SEQ ID NO: 7506 - DNA, 23 bp, Artificial Sequence
  HLA-A targeting gRNA
ggtgggtgagctcctccacacgg

SEQ ID NO: 7507 - DNA, 23 bp, Artificial Sequence
  HLA-A targeting gRNA
ggtggtggggcagaggggaaagg

SEQ ID NO: 7508 - DNA, 23 bp, Artificial Sequence
  HLA-A targeting gRNA
ggtgtagatacctcatggagtgg

SEQ ID NO: 7509 - DNA, 23 bp, Artificial Sequence
  HLA-A targeting gRNA
ggtgtcgtccacgtagcccacgg

SEQ ID NO: 7510 - DNA, 23 bp, Artificial Sequence
  HLA-A targeting gRNA
ggttccatctcctgctcgcctgg

SEQ ID NO: 7511 - DNA, 23 bp, Artificial Sequence
  HLA-A targeting gRNA
ggttccatctcctgctggcctgg

SEQ ID NO: 7512 - DNA, 23 bp, Artificial Sequence
  HLA-A targeting gRNA
ggttcccaaggctgctgcagggg

SEQ ID NO: 7513 - DNA, 23 bp, Artificial Sequence
  HLA-A targeting gRNA
ggttccgcagatccaccttgggg

SEQ ID NO: 7514 - DNA, 23 bp, Artificial Sequence
  HLA-A targeting gRNA
ggttctatctcctgcaggtctgg

SEQ ID NO: 7515 - DNA, 23 bp, Artificial Sequence
  HLA-A targeting gRNA
ggttctatctcctgccggtctgg

SEQ ID NO: 7516 - DNA, 23 bp, Artificial Sequence
  HLA-A targeting gRNA
ggttctatctcctgctggtctgg

SEQ ID NO: 7517 - DNA, 23 bp, Artificial Sequence
  HLA-A targeting gRNA
ggttctgtctcctgctggtctgg

SEQ ID NO: 7518 - DNA, 23 bp, Artificial Sequence
  HLA-A targeting gRNA
ggttgcagccacacatccactgg

SEQ ID NO: 7519 - DNA, 23 bp, Artificial Sequence
  HLA-A targeting gRNA
ggttgggagaagtgaaactcagg

SEQ ID NO: 7520 - DNA, 23 bp, Artificial Sequence
  HLA-A targeting gRNA
ggttggtcgggactggggcgggg

SEQ ID NO: 7521 - DNA, 23 bp, Artificial Sequence
  HLA-A targeting gRNA
ggttggtcggggctggggcgggg

SEQ ID NO: 7522 - DNA, 23 bp, Artificial Sequence
  HLA-A targeting gRNA
ggtttaggccaaaatccccgcgg

SEQ ID NO: 7523 - DNA, 23 bp, Artificial Sequence
  HLA-A targeting gRNA
gtaaagtgactcaaaagtgctgg

SEQ ID NO: 7524 - DNA, 23 bp, Artificial Sequence
  HLA-A targeting gRNA
gtaaagtgactcagaagtgctgg

SEQ ID NO: 7525 - DNA, 23 bp, Artificial Sequence
  HLA-A targeting gRNA
gtaacccactgagatgaagcggg

SEQ ID NO: 7526 - DNA, 23 bp, Artificial Sequence
  HLA-A targeting gRNA
gtaagccttgccgtcgtaggcgg

SEQ ID NO: 7527 - DNA, 23 bp, Artificial Sequence
  HLA-A targeting gRNA
gtaagcgatgacactctgaacgg

SEQ ID NO: 7528 - DNA, 23 bp, Artificial Sequence
  HLA-A targeting gRNA
gtaaggctgcgacgtggggccgg

SEQ ID NO: 7529 - DNA, 23 bp, Artificial Sequence
  HLA-A targeting gRNA
gtaagtctgtgtgttggtcttgg

SEQ ID NO: 7530 - DNA, 23 bp, Artificial Sequence
  HLA-A targeting gRNA
gtaagtgatgacactctgaacgg

SEQ ID NO: 7531 - DNA, 23 bp, Artificial Sequence
  HLA-A targeting gRNA
gtaagtgatgacattctgaacgg

SEQ ID NO: 7532 - DNA, 23 bp, Artificial Sequence
  HLA-A targeting gRNA
gtaatccttgccgtcctaggcgg

SEQ ID NO: 7533 - DNA, 23 bp, Artificial Sequence
  HLA-A targeting gRNA
gtaatccttgccgtcgcaggcgg

SEQ ID NO: 7534 - DNA, 23 bp, Artificial Sequence
  HLA-A targeting gRNA
gtaatccttgccgtcgtaggcgg

SEQ ID NO: 7535 - DNA, 23 bp, Artificial Sequence
  HLA-A targeting gRNA
gtaatccttgccgtcttaggcgg

SEQ ID NO: 7536 - DNA, 23 bp, Artificial Sequence
  HLA-A targeting gRNA
gtaatggacattctttgattggg

SEQ ID NO: 7537 - DNA, 23 bp, Artificial Sequence
  HLA-A targeting gRNA
gtaatggagattctttgattggg

SEQ ID NO: 7538 - DNA, 23 bp, Artificial Sequence
  HLA-A targeting gRNA
gtaatggggatcctttgataggg

SEQ ID NO: 7539 - DNA, 23 bp, Artificial Sequence
  HLA-A targeting gRNA
gtaatggggatcctttgattggg

SEQ ID NO: 7540 - DNA, 23 bp, Artificial Sequence
  HLA-A targeting gRNA
gtaatggggattctttgattggg

SEQ ID NO: 7541 - DNA, 23 bp, Artificial Sequence
  HLA-A targeting gRNA
gtacggctgcgacctggggccgg

SEQ ID NO: 7542 - DNA, 23 bp, Artificial Sequence
  HLA-A targeting gRNA
gtacggctgcgacgtggggccgg

SEQ ID NO: 7543 - DNA, 23 bp, Artificial Sequence
  HLA-A targeting gRNA
gtacgtctgtgtgttggtcttgg

SEQ ID NO: 7544 - DNA, 23 bp, Artificial Sequence
  HLA-A targeting gRNA
gtagaaatacctcaaggagtggg

SEQ ID NO: 7545 - DNA, 23 bp, Artificial Sequence
  HLA-A targeting gRNA
gtagaaatacctcatgaagtggg

SEQ ID NO: 7546 - DNA, 23 bp, Artificial Sequence
  HLA-A targeting gRNA
gtagaaatacctcatggagaggg

SEQ ID NO: 7547 - DNA, 23 bp, Artificial Sequence
  HLA-A targeting gRNA
gtagaaatacttcatggagtggg

SEQ ID NO: 7548 - DNA, 23 bp, Artificial Sequence
  HLA-A targeting gRNA
gtagaacaaaaaaaaagacctgg

SEQ ID NO: 7549 - DNA, 23 bp, Artificial Sequence
  HLA-A targeting gRNA
gtagcccacggtaatgaagcggg

SEQ ID NO: 7550 - DNA, 23 bp, Artificial Sequence
  HLA-A targeting gRNA
gtagcccacggtgatgaagcggg

SEQ ID NO: 7551 - DNA, 23 bp, Artificial Sequence
  HLA-A targeting gRNA
gtagcccactgagacgaagcggg

SEQ ID NO: 7552 - DNA, 23 bp, Artificial Sequence
  HLA-A targeting gRNA
gtagcccactgagatgaagcggg

SEQ ID NO: 7553 - DNA, 23 bp, Artificial Sequence
  HLA-A targeting gRNA
gtagcccactgcaatgaagcggg

SEQ ID NO: 7554 - DNA, 23 bp, Artificial Sequence
  HLA-A targeting gRNA
gtagcccactgcgatgaagtggg

SEQ ID NO: 7555 - DNA, 23 bp, Artificial Sequence
  HLA-A targeting gRNA
gtagcgcactgagatgaagcggg

SEQ ID NO: 7556 - DNA, 23 bp, Artificial Sequence
  HLA-A targeting gRNA
gtaggaggaagagctcaggtagg

SEQ ID NO: 7557 - DNA, 23 bp, Artificial Sequence
  HLA-A targeting gRNA
gtaggaggaagagttcaggtagg

SEQ ID NO: 7558 - DNA, 23 bp, Artificial Sequence
  HLA-A targeting gRNA
gtaggaggaagagttctggtagg

SEQ ID NO: 7559 - DNA, 23 bp, Artificial Sequence
  HLA-A targeting gRNA
gtaggctgggaagatggctctgg

SEQ ID NO: 7560 - DNA, 23 bp, Artificial Sequence
  HLA-A targeting gRNA
gtagggaaggggtgaagagcggg

SEQ ID NO: 7561 - DNA, 23 bp, Artificial Sequence
  HLA-A targeting gRNA
gtagggaaggggtgaggagtggg

SEQ ID NO: 7562 - DNA, 23 bp, Artificial Sequence
  HLA-A targeting gRNA
gtagggaaggggtgaggggtggg

SEQ ID NO: 7563 - DNA, 23 bp, Artificial Sequence
  HLA-A targeting gRNA
gtagggaaggggtggggagtggg

SEQ ID NO: 7564 - DNA, 23 bp, Artificial Sequence
  HLA-A targeting gRNA
gtagttctggaaacttctcttgg

SEQ ID NO: 7565 - DNA, 23 bp, Artificial Sequence
  HLA-A targeting gRNA
gtatctacaccgccgtgtcccgg

SEQ ID NO: 7566 - DNA, 23 bp, Artificial Sequence
  HLA-A targeting gRNA
gtatggctgcgacatggggccgg

SEQ ID NO: 7567 - DNA, 23 bp, Artificial Sequence
  HLA-A targeting gRNA
gtatggctgcgacctggggccgg

SEQ ID NO: 7568 - DNA, 23 bp, Artificial Sequence
  HLA-A targeting gRNA
gtatggctgcgacgtggagccgg

SEQ ID NO: 7569 - DNA, 23 bp, Artificial Sequence
  HLA-A targeting gRNA
gtcacagtggacacaagggtggg

SEQ ID NO: 7570 - DNA, 23 bp, Artificial Sequence
  HLA-A targeting gRNA
gtcacagtggacacaaggttggg

SEQ ID NO: 7571 - DNA, 23 bp, Artificial Sequence
  HLA-A targeting gRNA
gtcacagtggacacacagttggg

SEQ ID NO: 7572 - DNA, 23 bp, Artificial Sequence
  HLA-A targeting gRNA
gtcacagtggacacgggggtggg

SEQ ID NO: 7573 - DNA, 23 bp, Artificial Sequence
  HLA-A targeting gRNA
gtcacgagtatcccggaagaagg

SEQ ID NO: 7574 - DNA, 23 bp, Artificial Sequence
  HLA-A targeting gRNA
gtcacgagtatcctggaagaagg

SEQ ID NO: 7575 - DNA, 23 bp, Artificial Sequence
  HLA-A targeting gRNA
gtcacggtggacacgggggtggg

SEQ ID NO: 7576 - DNA, 23 bp, Artificial Sequence
  HLA-A targeting gRNA
gtcactcaccggcctcgctccgg

SEQ ID NO: 7577 - DNA, 23 bp, Artificial Sequence
  HLA-A targeting gRNA
gtcactcaccggtctcgctctgg

SEQ ID NO: 7578 - DNA, 23 bp, Artificial Sequence
  HLA-A targeting gRNA
gtcactcaccgtcctcgctccgg

SEQ ID NO: 7579 - DNA, 23 bp, Artificial Sequence
  HLA-A targeting gRNA
gtcactcacggtcctcgctctgg

SEQ ID NO: 7580 - DNA, 23 bp, Artificial Sequence
  HLA-A targeting gRNA
gtcactcactggcctcgctctgg

SEQ ID NO: 7581 - DNA, 23 bp, Artificial Sequence
  HLA-A targeting gRNA
gtcagagcccacaggagacgtgg

SEQ ID NO: 7582 - DNA, 23 bp, Artificial Sequence
  HLA-A targeting gRNA
gtcagagcccacaggagatgtgg

SEQ ID NO: 7583 - DNA, 23 bp, Artificial Sequence
  HLA-A targeting gRNA
gtcagagcccgcaggagacgtgg

SEQ ID NO: 7584 - DNA, 23 bp, Artificial Sequence
  HLA-A targeting gRNA
gtcagagcccgcaggagatgtgg

SEQ ID NO: 7585 - DNA, 23 bp, Artificial Sequence
  HLA-A targeting gRNA
gtcagagccctcaggagacgtgg

SEQ ID NO: 7586 - DNA, 23 bp, Artificial Sequence
  HLA-A targeting gRNA
gtcagggccatgcgatcttaggg

SEQ ID NO: 7587 - DNA, 23 bp, Artificial Sequence
  HLA-A targeting gRNA
gtcagggcggggcggggctcggg

SEQ ID NO: 7588 - DNA, 23 bp, Artificial Sequence
  HLA-A targeting gRNA
gtcagtctgtgtgttggtcttgg

SEQ ID NO: 7589 - DNA, 23 bp, Artificial Sequence
  HLA-A targeting gRNA
gtcatgagtattcaggaagaagg

SEQ ID NO: 7590 - DNA, 23 bp, Artificial Sequence
  HLA-A targeting gRNA
gtcccaggctgggatggcccagg

SEQ ID NO: 7591 - DNA, 23 bp, Artificial Sequence
  HLA-A targeting gRNA
gtcccgcggcctcagggaggcgg

SEQ ID NO: 7592 - DNA, 23 bp, Artificial Sequence
  HLA-A targeting gRNA
gtcccgcggcctcaggggggcgg

SEQ ID NO: 7593 - DNA, 23 bp, Artificial Sequence
  HLA-A targeting gRNA
gtcccgcggcctcaggggggtgg

SEQ ID NO: 7594 - DNA, 23 bp, Artificial Sequence
  HLA-A targeting gRNA
gtcccgcggcctcagggggtcgg

SEQ ID NO: 7595 - DNA, 23 bp, Artificial Sequence
  HLA-A targeting gRNA
gtccctagaatactgatcagggg

SEQ ID NO: 7596 - DNA, 23 bp, Artificial Sequence
  HLA-A targeting gRNA
gtccctaggatagtgatcagggg

SEQ ID NO: 7597 - DNA, 23 bp, Artificial Sequence
  HLA-A targeting gRNA
gtccctataatactgatcagggg

SEQ ID NO: 7598 - DNA, 23 bp, Artificial Sequence
  HLA-A targeting gRNA
gtccctggaatactgatcagggg

SEQ ID NO: 7599 - DNA, 23 bp, Artificial Sequence
  HLA-A targeting gRNA
gtccctgttagcataatgtgagg

SEQ ID NO: 7600 - DNA, 23 bp, Artificial Sequence
  HLA-A targeting gRNA
gtccctgttagcctaatgtgagg

SEQ ID NO: 7601 - DNA, 23 bp, Artificial Sequence
  HLA-A targeting gRNA
gtccgagatccacccccctgagg

SEQ ID NO: 7602 - DNA, 23 bp, Artificial Sequence
  HLA-A targeting gRNA
gtccgagatccgaccccctgagg

SEQ ID NO: 7603 - DNA, 23 bp, Artificial Sequence
  HLA-A targeting gRNA
gtccgagatccgcccccctgagg

SEQ ID NO: 7604 - DNA, 23 bp, Artificial Sequence
  HLA-A targeting gRNA
gtccgagatccgcctccctgagg

SEQ ID NO: 7605 - DNA, 23 bp, Artificial Sequence
  HLA-A targeting gRNA
gtcctagcagttgtggtcatcgg

SEQ ID NO: 7606 - DNA, 23 bp, Artificial Sequence
  HLA-A targeting gRNA
gtcctccccatcccactgccagg

SEQ ID NO: 7607 - DNA, 23 bp, Artificial Sequence
  HLA-A targeting gRNA
gtcctcgccatcccgctaccagg

SEQ ID NO: 7608 - DNA, 23 bp, Artificial Sequence
  HLA-A targeting gRNA
gtcctcgccatcccgctgccagg

SEQ ID NO: 7609 - DNA, 23 bp, Artificial Sequence
  HLA-A targeting gRNA
gtcctgcgccctcgccgggaggg

SEQ ID NO: 7610 - DNA, 23 bp, Artificial Sequence
  HLA-A targeting gRNA
gtcctgcgccctcgccgggcggg

SEQ ID NO: 7611 - DNA, 23 bp, Artificial Sequence
  HLA-A targeting gRNA
gtccttgccatcccgctgccagg

SEQ ID NO: 7612 - DNA, 23 bp, Artificial Sequence
  HLA-A targeting gRNA
gtcgaaatacctcatggagtggg

SEQ ID NO: 7613 - DNA, 23 bp, Artificial Sequence
  HLA-A targeting gRNA
gtcgggactggggcggggctcgg

SEQ ID NO: 7614 - DNA, 23 bp, Artificial Sequence
  HLA-A targeting gRNA
gtcggggctggggcggggctcgg

SEQ ID NO: 7615 - DNA, 23 bp, Artificial Sequence
  HLA-A targeting gRNA
gtcggggctggggcggggttcgg

SEQ ID NO: 7616 - DNA, 23 bp, Artificial Sequence
  HLA-A targeting gRNA
gtctagagtgggcaggggggtgg

SEQ ID NO: 7617 - DNA, 23 bp, Artificial Sequence
  HLA-A targeting gRNA
gtctagagtgggcgggggggcgg

SEQ ID NO: 7618 - DNA, 23 bp, Artificial Sequence
  HLA-A targeting gRNA
gtctagagtgggcgggggggggg

SEQ ID NO: 7619 - DNA, 23 bp, Artificial Sequence
  HLA-A targeting gRNA
gtctagagtgggtggggtggcgg

SEQ ID NO: 7620 - DNA, 23 bp, Artificial Sequence
  HLA-A targeting gRNA
gtctcccggtcccaacactccgg

SEQ ID NO: 7621 - DNA, 23 bp, Artificial Sequence
  HLA-A targeting gRNA
gtctcccggtcccaatactccgg

SEQ ID NO: 7622 - DNA, 23 bp, Artificial Sequence
  HLA-A targeting gRNA
gtctcccggtcccaatactctgg

SEQ ID NO: 7623 - DNA, 23 bp, Artificial Sequence
  HLA-A targeting gRNA
gtctcccggtcccaatcctccgg

SEQ ID NO: 7624 - DNA, 23 bp, Artificial Sequence
  HLA-A targeting gRNA
gtctcccggtcccagtactccgg

SEQ ID NO: 7625 - DNA, 23 bp, Artificial Sequence
  HLA-A targeting gRNA
gtctcccggtcctaatactccgg

SEQ ID NO: 7626 - DNA, 23 bp, Artificial Sequence
  HLA-A targeting gRNA
gtctcctgagggctctgaccagg

SEQ ID NO: 7627 - DNA, 23 bp, Artificial Sequence
  HLA-A targeting gRNA
gtctcctgcgggctctgaccagg

SEQ ID NO: 7628 - DNA, 23 bp, Artificial Sequence
  HLA-A targeting gRNA
gtctcctgtgggctctgaccagg

SEQ ID NO: 7629 - DNA, 23 bp, Artificial Sequence
  HLA-A targeting gRNA
gtctgagatccaccccaaggtgg

SEQ ID NO: 7630 - DNA, 23 bp, Artificial Sequence
  HLA-A targeting gRNA
gtctgaggagactctgagtccgg

SEQ ID NO: 7631 - DNA, 23 bp, Artificial Sequence
  HLA-A targeting gRNA
gtctgaggagattctgagtccgg

SEQ ID NO: 7632 - DNA, 23 bp, Artificial Sequence
  HLA-A targeting gRNA
gtctgaggagattttgagtccgg

SEQ ID NO: 7633 - DNA, 23 bp, Artificial Sequence
  HLA-A targeting gRNA
gtctgccaagtgtgagaccctgg

SEQ ID NO: 7634 - DNA, 23 bp, Artificial Sequence
  HLA-A targeting gRNA
gtctggagggtgtgagaccctgg

SEQ ID NO: 7635 - DNA, 23 bp, Artificial Sequence
  HLA-A targeting gRNA
gtctggctgcgacgtggggccgg

SEQ ID NO: 7636 - DNA, 23 bp, Artificial Sequence
  HLA-A targeting gRNA
gtctggggagaatccgagtccgg

SEQ ID NO: 7637 - DNA, 23 bp, Artificial Sequence
  HLA-A targeting gRNA
gtctggggagaatctgagtccgg

SEQ ID NO: 7638 - DNA, 23 bp, Artificial Sequence
  HLA-A targeting gRNA
gtcttccccatcccgctgccagg

SEQ ID NO: 7639 - DNA, 23 bp, Artificial Sequence
  HLA-A targeting gRNA
gtcttcccctccatttcctcagg

SEQ ID NO: 7640 - DNA, 23 bp, Artificial Sequence
  HLA-A targeting gRNA
gtcttgaagatctgtgtgttcgg

SEQ ID NO: 7641 - DNA, 23 bp, Artificial Sequence
  HLA-A targeting gRNA
gtgaacctgcggaaactgcgcgg

SEQ ID NO: 7642 - DNA, 23 bp, Artificial Sequence
  HLA-A targeting gRNA
gtgaacctgcggaacctgcgcgg

SEQ ID NO: 7643 - DNA, 23 bp, Artificial Sequence
  HLA-A targeting gRNA
gtgaacctgcggcaactgcgcgg

SEQ ID NO: 7644 - DNA, 23 bp, Artificial Sequence
  HLA-A targeting gRNA
gtgaccagcctgagaatggacgg

SEQ ID NO: 7645 - DNA, 23 bp, Artificial Sequence
  HLA-A targeting gRNA
gtgaccccggcctggggcgcagg

SEQ ID NO: 7646 - DNA, 23 bp, Artificial Sequence
  HLA-A targeting gRNA
gtgacctcatggtcagagatggg

SEQ ID NO: 7647 - DNA, 23 bp, Artificial Sequence
  HLA-A targeting gRNA
gtgacctgcgccccaggccgggg

SEQ ID NO: 7648 - DNA, 23 bp, Artificial Sequence
  HLA-A targeting gRNA
gtgactggggacttcagaaccgg

SEQ ID NO: 7649 - DNA, 23 bp, Artificial Sequence
  HLA-A targeting gRNA
gtgactggggactttagaaccgg

SEQ ID NO: 7650 - DNA, 23 bp, Artificial Sequence
  HLA-A targeting gRNA
gtgactggtgactttagaaccgg

SEQ ID NO: 7651 - DNA, 23 bp, Artificial Sequence
  HLA-A targeting gRNA
gtgagcctgcggaaactgcgcgg

SEQ ID NO: 7652 - DNA, 23 bp, Artificial Sequence
  HLA-A targeting gRNA
gtgagcctgcggaacctgcgcgg

SEQ ID NO: 7653 - DNA, 23 bp, Artificial Sequence
  HLA-A targeting gRNA
gtgagcctgcggaacctgcttgg

SEQ ID NO: 7654 - DNA, 23 bp, Artificial Sequence
  HLA-A targeting gRNA
gtgagtccgggtgggtgactggg

SEQ ID NO: 7655 - DNA, 23 bp, Artificial Sequence
  HLA-A targeting gRNA
gtgatgtatggctgcgacgtggg

SEQ ID NO: 7656 - DNA, 23 bp, Artificial Sequence
  HLA-A targeting gRNA
gtgcgaggttgggagggaaacgg

SEQ ID NO: 7657 - DNA, 23 bp, Artificial Sequence
  HLA-A targeting gRNA
gtgcgggatcgggagggaaatgg

SEQ ID NO: 7658 - DNA, 23 bp, Artificial Sequence
  HLA-A targeting gRNA
gtgcggggtcggcagggaaatgg

SEQ ID NO: 7659 - DNA, 23 bp, Artificial Sequence
  HLA-A targeting gRNA
gtgcggggtcgggagggaaatgg

SEQ ID NO: 7660 - DNA, 23 bp, Artificial Sequence
  HLA-A targeting gRNA
gtgcggggttaggagggaaacgg

SEQ ID NO: 7661 - DNA, 23 bp, Artificial Sequence
  HLA-A targeting gRNA
gtgcggggttgggagggaaacgg

SEQ ID NO: 7662 - DNA, 23 bp, Artificial Sequence
  HLA-A targeting gRNA
gtgcggggttgggagggaagcgg

SEQ ID NO: 7663 - DNA, 23 bp, Artificial Sequence
  HLA-A targeting gRNA
gtgcggggttgggagggaatcgg

SEQ ID NO: 7664 - DNA, 23 bp, Artificial Sequence
  HLA-A targeting gRNA
gtgcgtggggactttagaactgg

SEQ ID NO: 7665 - DNA, 23 bp, Artificial Sequence
  HLA-A targeting gRNA
gtgctagcacacagggtcccagg

SEQ ID NO: 7666 - DNA, 23 bp, Artificial Sequence
  HLA-A targeting gRNA
gtgctctccgcggccaggccggg

SEQ ID NO: 7667 - DNA, 23 bp, Artificial Sequence
  HLA-A targeting gRNA
gtgctggcacacagggccccagg

SEQ ID NO: 7668 - DNA, 23 bp, Artificial Sequence
  HLA-A targeting gRNA
gtgctggcacacagggtcccagg

SEQ ID NO: 7669 - DNA, 23 bp, Artificial Sequence
  HLA-A targeting gRNA
gtgctgggtgatctgagccgcgg

SEQ ID NO: 7670 - DNA, 23 bp, Artificial Sequence
  HLA-A targeting gRNA
gtgcttccagtaacaaggcgggg

SEQ ID NO: 7671 - DNA, 23 bp, Artificial Sequence
  HLA-A targeting gRNA
gtgcttccagtaacgaggtgggg

SEQ ID NO: 7672 - DNA, 23 bp, Artificial Sequence
  HLA-A targeting gRNA
gtggaaatacctcatggagtggg

SEQ ID NO: 7673 - DNA, 23 bp, Artificial Sequence
  HLA-A targeting gRNA
gtggaagcctgggggcgaggagg

SEQ ID NO: 7674 - DNA, 23 bp, Artificial Sequence
  HLA-A targeting gRNA
gtggactgggaagacggctccgg

SEQ ID NO: 7675 - DNA, 23 bp, Artificial Sequence
  HLA-A targeting gRNA
gtggactgggaagacggctctgg

SEQ ID NO: 7676 - DNA, 23 bp, Artificial Sequence
  HLA-A targeting gRNA
gtggactgggaagatggctctgg

SEQ ID NO: 7677 - DNA, 23 bp, Artificial Sequence
  HLA-A targeting gRNA
gtggagcaggaggggccggacgg

SEQ ID NO: 7678 - DNA, 23 bp, Artificial Sequence
  HLA-A targeting gRNA
gtggatagagcaagaggggccgg

SEQ ID NO: 7679 - DNA, 23 bp, Artificial Sequence
  HLA-A targeting gRNA
gtggatggagcaggaggggccgg

SEQ ID NO: 7680 - DNA, 23 bp, Artificial Sequence
  HLA-A targeting gRNA
gtggatgtacggctgcgacctgg

SEQ ID NO: 7681 - DNA, 23 bp, Artificial Sequence
  HLA-A targeting gRNA
gtggatgtatggctgcgacctgg

SEQ ID NO: 7682 - DNA, 23 bp, Artificial Sequence
  HLA-A targeting gRNA
gtggatgtatggctgcgacgtgg

SEQ ID NO: 7683 - DNA, 23 bp, Artificial Sequence
  HLA-A targeting gRNA
gtggatgtgtggctgcaacctgg

SEQ ID NO: 7684 - DNA, 23 bp, Artificial Sequence
  HLA-A targeting gRNA
gtggatgtgtggctgcgacctgg

SEQ ID NO: 7685 - DNA, 23 bp, Artificial Sequence
  HLA-A targeting gRNA
gtggatgtttggctgcgacctgg

SEQ ID NO: 7686 - DNA, 23 bp, Artificial Sequence
  HLA-A targeting gRNA
gtggattgggaagatggctctgg

SEQ ID NO: 7687 - DNA, 23 bp, Artificial Sequence
  HLA-A targeting gRNA
gtggcaggtctgggggtgggtgg

SEQ ID NO: 7688 - DNA, 23 bp, Artificial Sequence
  HLA-A targeting gRNA
gtggcctcatggtcagagacggg

SEQ ID NO: 7689 - DNA, 23 bp, Artificial Sequence
  HLA-A targeting gRNA
gtggcctcatggtcagagagggg

SEQ ID NO: 7690 - DNA, 23 bp, Artificial Sequence
  HLA-A targeting gRNA
gtggcgggtctggggcggggtgg

SEQ ID NO: 7691 - DNA, 23 bp, Artificial Sequence
  HLA-A targeting gRNA
gtggcgggtctgggggggggggg

SEQ ID NO: 7692 - DNA, 23 bp, Artificial Sequence
  HLA-A targeting gRNA
gtggcgggtctgggggtgggtgg

SEQ ID NO: 7693 - DNA, 23 bp, Artificial Sequence
  HLA-A targeting gRNA
gtgggaacctgggggcgaggagg

SEQ ID NO: 7694 - DNA, 23 bp, Artificial Sequence
  HLA-A targeting gRNA
gtgggacaagaggaattatgggg

SEQ ID NO: 7695 - DNA, 23 bp, Artificial Sequence
  HLA-A targeting gRNA
gtgggacaggaggaattaggggg

SEQ ID NO: 7696 - DNA, 23 bp, Artificial Sequence
  HLA-A targeting gRNA
gtgggacaggaggaattatgggg

SEQ ID NO: 7697 - DNA, 23 bp, Artificial Sequence
  HLA-A targeting gRNA
gtgggagactgggggcgaggagg

SEQ ID NO: 7698 - DNA, 23 bp, Artificial Sequence
  HLA-A targeting gRNA
gtgggagactgggggtgaggagg

SEQ ID NO: 7699 - DNA, 23 bp, Artificial Sequence
  HLA-A targeting gRNA
gtgggagcctgggagcgaggagg

SEQ ID NO: 7700 - DNA, 23 bp, Artificial Sequence
  HLA-A targeting gRNA
gtgggagcctggggcaaggaggg

SEQ ID NO: 7701 - DNA, 23 bp, Artificial Sequence
  HLA-A targeting gRNA
gtgggagcctgggggagaggagg

SEQ ID NO: 7702 - DNA, 23 bp, Artificial Sequence
  HLA-A targeting gRNA
gtgggagcctgggggccaggagg

SEQ ID NO: 7703 - DNA, 23 bp, Artificial Sequence
  HLA-A targeting gRNA
gtgggagcctgggggcgaggagg

SEQ ID NO: 7704 - DNA, 23 bp, Artificial Sequence
  HLA-A targeting gRNA
gtgggagcctgggggtgaggagg

SEQ ID NO: 7705 - DNA, 23 bp, Artificial Sequence
  HLA-A targeting gRNA
gtgggaggcagcccgtgaggcgg

SEQ ID NO: 7706 - DNA, 23 bp, Artificial Sequence
  HLA-A targeting gRNA
gtgggaggcggcccgggtggcgg

SEQ ID NO: 7707 - DNA, 23 bp, Artificial Sequence
  HLA-A targeting gRNA
gtgggaggcggcccgtacggcgg

SEQ ID NO: 7708 - DNA, 23 bp, Artificial Sequence
  HLA-A targeting gRNA
gtgggaggcggcccgtatggcgg

SEQ ID NO: 7709 - DNA, 23 bp, Artificial Sequence
  HLA-A targeting gRNA
gtgggaggcggcccgtgaggcgg

SEQ ID NO: 7710 - DNA, 23 bp, Artificial Sequence
  HLA-A targeting gRNA
gtgggaggcggcccgtgcggcgg

SEQ ID NO: 7711 - DNA, 23 bp, Artificial Sequence
  HLA-A targeting gRNA
gtgggaggcggccggtgaggcgg

SEQ ID NO: 7712 - DNA, 23 bp, Artificial Sequence
  HLA-A targeting gRNA
gtgggaggcggcctgtgaggcgg

SEQ ID NO: 7713 - DNA, 23 bp, Artificial Sequence
  HLA-A targeting gRNA
gtgggaggcggctcgtgaggcgg

SEQ ID NO: 7714 - DNA, 23 bp, Artificial Sequence
  HLA-A targeting gRNA
gtgggaggctgggggcgaggagg

SEQ ID NO: 7715 - DNA, 23 bp, Artificial Sequence
  HLA-A targeting gRNA
gtgggcctgcggaacctgcgcgg

SEQ ID NO: 7716 - DNA, 23 bp, Artificial Sequence
  HLA-A targeting gRNA
gtgggcgggggggcggggagggg

SEQ ID NO: 7717 - DNA, 23 bp, Artificial Sequence
  HLA-A targeting gRNA
gtgggcggggggggcggggaggg

SEQ ID NO: 7718 - DNA, 23 bp, Artificial Sequence
  HLA-A targeting gRNA
gtgggcgggggggggtggggtgg

SEQ ID NO: 7719 - DNA, 23 bp, Artificial Sequence
  HLA-A targeting gRNA
gtgggcggggggggtggggtggg

SEQ ID NO: 7720 - DNA, 23 bp, Artificial Sequence
  HLA-A targeting gRNA
gtgggctgggaagatggccctgg

SEQ ID NO: 7721 - DNA, 23 bp, Artificial Sequence
  HLA-A targeting gRNA
gtggggaaaggcctgggtaatgg

SEQ ID NO: 7722 - DNA, 23 bp, Artificial Sequence
  HLA-A targeting gRNA
gtggggcacacttctacctgggg

SEQ ID NO: 7723 - DNA, 23 bp, Artificial Sequence
  HLA-A targeting gRNA
gtgggggatggggaggggtcggg

SEQ ID NO: 7724 - DNA, 23 bp, Artificial Sequence
  HLA-A targeting gRNA
gtggggtggcgggtctggggggg

SEQ ID NO: 7725 - DNA, 23 bp, Artificial Sequence
  HLA-A targeting gRNA
gtggggtggggagggggcagagg

SEQ ID NO: 7726 - DNA, 23 bp, Artificial Sequence
  HLA-A targeting gRNA
gtgggtcacatgtgtctttgggg

SEQ ID NO: 7727 - DNA, 23 bp, Artificial Sequence
  HLA-A targeting gRNA
gtgggtcacgtgtgtctttgcgg

SEQ ID NO: 7728 - DNA, 23 bp, Artificial Sequence
  HLA-A targeting gRNA
gtgggtcacgtgtgtctttgggg

SEQ ID NO: 7729 - DNA, 23 bp, Artificial Sequence
  HLA-A targeting gRNA
gtgggtggagaaggaggggccgg

SEQ ID NO: 7730 - DNA, 23 bp, Artificial Sequence
  HLA-A targeting gRNA
gtgggtggagcaggaggggccgg

SEQ ID NO: 7731 - DNA, 23 bp, Artificial Sequence
  HLA-A targeting gRNA
gtgggtggggcagaggggaaagg

SEQ ID NO: 7732 - DNA, 23 bp, Artificial Sequence
  HLA-A targeting gRNA
gtgggtggggcagtggggaaagg

SEQ ID NO: 7733 - DNA, 23 bp, Artificial Sequence
  HLA-A targeting gRNA
gtgggtgggggtggcgggtctgg

SEQ ID NO: 7734 - DNA, 23 bp, Artificial Sequence
  HLA-A targeting gRNA
gtgggtggggtggcaggtctggg

SEQ ID NO: 7735 - DNA, 23 bp, Artificial Sequence
  HLA-A targeting gRNA
gtgggtggggtggcgggtctggg

SEQ ID NO: 7736 - DNA, 23 bp, Artificial Sequence
  HLA-A targeting gRNA
gtggtcgggggtggggcagaggg

SEQ ID NO: 7737 - DNA, 23 bp, Artificial Sequence
  HLA-A targeting gRNA
gtggtctggggtggggcagaggg

SEQ ID NO: 7738 - DNA, 23 bp, Artificial Sequence
  HLA-A targeting gRNA
gtgtagatacctcatggagtggg

SEQ ID NO: 7739 - DNA, 23 bp, Artificial Sequence
  HLA-A targeting gRNA
gtgtccgcggcggtccaggaggg

SEQ ID NO: 7740 - DNA, 23 bp, Artificial Sequence
  HLA-A targeting gRNA
gtgtctctcacagcttgaaaagg

SEQ ID NO: 7741 - DNA, 23 bp, Artificial Sequence
  HLA-A targeting gRNA
gtgtctctcatcacttgtaaagg

SEQ ID NO: 7742 - DNA, 23 bp, Artificial Sequence
  HLA-A targeting gRNA
gtgtctttgcggggtctgatggg

SEQ ID NO: 7743 - DNA, 23 bp, Artificial Sequence
  HLA-A targeting gRNA
gtgtctttgggcgttctgacggg

SEQ ID NO: 7744 - DNA, 23 bp, Artificial Sequence
  HLA-A targeting gRNA
gtgtctttggggggtctgatggg

SEQ ID NO: 7745 - DNA, 23 bp, Artificial Sequence
  HLA-A targeting gRNA
gtgtctttgggggttctgacggg

SEQ ID NO: 7746 - DNA, 23 bp, Artificial Sequence
  HLA-A targeting gRNA
gtgtctttgggtgttctgacggg

SEQ ID NO: 7747 - DNA, 23 bp, Artificial Sequence
  HLA-A targeting gRNA
gtgtctttgggtgttctgatggg

SEQ ID NO: 7748 - DNA, 23 bp, Artificial Sequence
  HLA-A targeting gRNA
gtgtgtaggaggaagagctcagg

SEQ ID NO: 7749 - DNA, 23 bp, Artificial Sequence
  HLA-A targeting gRNA
gtgttcccgtcccaatattccgg

SEQ ID NO: 7750 - DNA, 23 bp, Artificial Sequence
  HLA-A targeting gRNA
gtgttccctgcatcattactggg

SEQ ID NO: 7751 - DNA, 23 bp, Artificial Sequence
  HLA-A targeting gRNA
gtgttccctgcctcattactggg

SEQ ID NO: 7752 - DNA, 23 bp, Artificial Sequence
  HLA-A targeting gRNA
gtgttccggtcccaatattccgg

SEQ ID NO: 7753 - DNA, 23 bp, Artificial Sequence
  HLA-A targeting gRNA
gtgttccggtcccaatgctccgg

SEQ ID NO: 7754 - DNA, 23 bp, Artificial Sequence
  HLA-A targeting gRNA
gtgttcgggtcccaatactccgg

SEQ ID NO: 7755 - DNA, 23 bp, Artificial Sequence
  HLA-A targeting gRNA
gtgtttcctgatcctgccctggg

SEQ ID NO: 7756 - DNA, 23 bp, Artificial Sequence
  HLA-A targeting gRNA
gtgtttcctgatcctgccttggg

SEQ ID NO: 7757 - DNA, 23 bp, Artificial Sequence
  HLA-A targeting gRNA
gttagcataatatgaggagttgg

SEQ ID NO: 7758 - DNA, 23 bp, Artificial Sequence
  HLA-A targeting gRNA
gttagcataatgtgaggaggtgg

SEQ ID NO: 7759 - DNA, 23 bp, Artificial Sequence
  HLA-A targeting gRNA
gttagcctaatgtgaggaggtgg

SEQ ID NO: 7760 - DNA, 23 bp, Artificial Sequence
  HLA-A targeting gRNA
gttcaggtagggaaggggtgagg

SEQ ID NO: 7761 - DNA, 23 bp, Artificial Sequence
  HLA-A targeting gRNA
gttcctgttagcataatatgagg

SEQ ID NO: 7762 - DNA, 23 bp, Artificial Sequence
  HLA-A targeting gRNA
gttcctgttagcataatgtgagg

SEQ ID NO: 7763 - DNA, 23 bp, Artificial Sequence
  HLA-A targeting gRNA
gttctagaagtcccaggtcccgg

SEQ ID NO: 7764 - DNA, 23 bp, Artificial Sequence
  HLA-A targeting gRNA
gttctctcggtaagtctgcgcgg

SEQ ID NO: 7765 - DNA, 23 bp, Artificial Sequence
  HLA-A targeting gRNA
gttctggcacacagggtcccagg

SEQ ID NO: 7766 - DNA, 23 bp, Artificial Sequence
  HLA-A targeting gRNA
gttctggtagggaaggggtgagg

SEQ ID NO: 7767 - DNA, 23 bp, Artificial Sequence
  HLA-A targeting gRNA
gttgaggccaaaatccccgcggg

SEQ ID NO: 7768 - DNA, 23 bp, Artificial Sequence
  HLA-A targeting gRNA
gttgaggtcaaaatccccgcggg

SEQ ID NO: 7769 - DNA, 23 bp, Artificial Sequence
  HLA-A targeting gRNA
gttggacaggaggaattatgggg

SEQ ID NO: 7770 - DNA, 23 bp, Artificial Sequence
  HLA-A targeting gRNA
gttggaggcggcccgtgaggcgg

SEQ ID NO: 7771 - DNA, 23 bp, Artificial Sequence
  HLA-A targeting gRNA
gttggaggcggcccgtgcggcgg

SEQ ID NO: 7772 - DNA, 23 bp, Artificial Sequence
  HLA-A targeting gRNA
gttggaggcggcccgtggggcgg

SEQ ID NO: 7773 - DNA, 23 bp, Artificial Sequence
  HLA-A targeting gRNA
gttggaggcggcccgtgtggcgg

SEQ ID NO: 7774 - DNA, 23 bp, Artificial Sequence
  HLA-A targeting gRNA
gttgggagaagtgaaactcaggg

SEQ ID NO: 7775 - DNA, 23 bp, Artificial Sequence
  HLA-A targeting gRNA
gttgggagggaaacggcctctgg

SEQ ID NO: 7776 - DNA, 23 bp, Artificial Sequence
  HLA-A targeting gRNA
gttgtaatccttgccgtcgtagg

SEQ ID NO: 7777 - DNA, 23 bp, Artificial Sequence
  HLA-A targeting gRNA
gtttaggccaaaatccccgcggg

SEQ ID NO: 7778 - DNA, 23 bp, Artificial Sequence
  HLA-A targeting gRNA
gtttctccacatccgtgtcctgg

SEQ ID NO: 7779 - DNA, 23 bp, Artificial Sequence
  HLA-A targeting gRNA
gtttggctgcgacctggggccgg

SEQ ID NO: 7780 - DNA, 23 bp, Artificial Sequence
  HLA-A targeting gRNA
gtttggctgcgacgtggggccgg

SEQ ID NO: 7781 - DNA, 23 bp, Artificial Sequence
  HLA-A targeting gRNA
gttttcccgagtttcctctgagg

SEQ ID NO: 7782 - DNA, 23 bp, Artificial Sequence
  HLA-A targeting gRNA
gttttcctgagtttcctctgagg

SEQ ID NO: 7783 - DNA, 23 bp, Artificial Sequence
  HLA-A targeting gRNA
gttttcctgagtttcttctgagg

SEQ ID NO: 7784 - DNA, 23 bp, Artificial Sequence
  HLA-A targeting gRNA
taacccactgagatgaagcgggg

SEQ ID NO: 7785 - DNA, 23 bp, Artificial Sequence
  HLA-A targeting gRNA
taagtgggaggcggcccgtgagg

SEQ ID NO: 7786 - DNA, 23 bp, Artificial Sequence
  HLA-A targeting gRNA
taatgaagcggggctccccgcgg

SEQ ID NO: 7787 - DNA, 23 bp, Artificial Sequence
  HLA-A targeting gRNA
taattgtcctagacagcagaggg

SEQ ID NO: 7788 - DNA, 23 bp, Artificial Sequence
  HLA-A targeting gRNA
taattgtcctagagagaagaggg

SEQ ID NO: 7789 - DNA, 23 bp, Artificial Sequence
  HLA-A targeting gRNA
taattgtcctagagagcagacgg

SEQ ID NO: 7790 - DNA, 23 bp, Artificial Sequence
  HLA-A targeting gRNA
taattgtcctagagagcagaggg

SEQ ID NO: 7791 - DNA, 23 bp, Artificial Sequence
  HLA-A targeting gRNA
taattgtctagagagaagagggg

SEQ ID NO: 7792 - DNA, 23 bp, Artificial Sequence
  HLA-A targeting gRNA
tacaccgccatgacccggcccgg

SEQ ID NO: 7793 - DNA, 23 bp, Artificial Sequence
  HLA-A targeting gRNA
tacaccgccatgtcccggcccgg

SEQ ID NO: 7794 - DNA, 23 bp, Artificial Sequence
  HLA-A targeting gRNA
tacaccgccatgtcccggcctgg

SEQ ID NO: 7795 - DNA, 23 bp, Artificial Sequence
  HLA-A targeting gRNA
tacaccgccgtgtcccggccagg

SEQ ID NO: 7796 - DNA, 23 bp, Artificial Sequence
  HLA-A targeting gRNA
tacaccgccgtgtcccggcccgg

SEQ ID NO: 7797 - DNA, 23 bp, Artificial Sequence
  HLA-A targeting gRNA
tacaccgccgtgtcccggcctgg

SEQ ID NO: 7798 - DNA, 23 bp, Artificial Sequence
  HLA-A targeting gRNA
tacaccgccgtgtccgggcccgg

SEQ ID NO: 7799 - DNA, 23 bp, Artificial Sequence
  HLA-A targeting gRNA
tacaccgctatgtcccggcccgg

SEQ ID NO: 7800 - DNA, 23 bp, Artificial Sequence
  HLA-A targeting gRNA
tacaccgctgtgtcccggcccgg

SEQ ID NO: 7801 - DNA, 23 bp, Artificial Sequence
  HLA-A targeting gRNA
tacagacccaaggcaggatcagg

SEQ ID NO: 7802 - DNA, 23 bp, Artificial Sequence
  HLA-A targeting gRNA
tacagacccagggcaggatcagg

SEQ ID NO: 7803 - DNA, 23 bp, Artificial Sequence
  HLA-A targeting gRNA
taccaccaggacgcctacgacgg

SEQ ID NO: 7804 - DNA, 23 bp, Artificial Sequence
  HLA-A targeting gRNA
tacccaatgggagtgggaagtgg

SEQ ID NO: 7805 - DNA, 23 bp, Artificial Sequence
  HLA-A targeting gRNA
tacccagcgcaagttggaggcgg

SEQ ID NO: 7806 - DNA, 23 bp, Artificial Sequence
  HLA-A targeting gRNA
tacctcaaggagtgggagcctgg

SEQ ID NO: 7807 - DNA, 23 bp, Artificial Sequence
  HLA-A targeting gRNA
tacctcatgaagtgggagcctgg

SEQ ID NO: 7808 - DNA, 23 bp, Artificial Sequence
  HLA-A targeting gRNA
tacctcatggagagggagcctgg

SEQ ID NO: 7809 - DNA, 23 bp, Artificial Sequence
  HLA-A targeting gRNA
tacctcatggagtggaagcctgg

SEQ ID NO: 7810 - DNA, 23 bp, Artificial Sequence
  HLA-A targeting gRNA
tacctcatggagtgggaacctgg

SEQ ID NO: 7811 - DNA, 23 bp, Artificial Sequence
  HLA-A targeting gRNA
tacctcatggagtgggagactgg

SEQ ID NO: 7812 - DNA, 23 bp, Artificial Sequence
  HLA-A targeting gRNA
tacctggagggcctgtgcgtggg

SEQ ID NO: 7813 - DNA, 23 bp, Artificial Sequence
  HLA-A targeting gRNA
tacgactgcagacccagggcagg

SEQ ID NO: 7814 - DNA, 23 bp, Artificial Sequence
  HLA-A targeting gRNA
tacgtcatggagtgggagcctgg

SEQ ID NO: 7815 - DNA, 23 bp, Artificial Sequence
  HLA-A targeting gRNA
tactacaaccagagcgagaccgg

SEQ ID NO: 7816 - DNA, 23 bp, Artificial Sequence
  HLA-A targeting gRNA
tactacaaccggagcgaggacgg

SEQ ID NO: 7817 - DNA, 23 bp, Artificial Sequence
  HLA-A targeting gRNA
tactacaaccggagcgaggccgg

SEQ ID NO: 7818 - DNA, 23 bp, Artificial Sequence
  HLA-A targeting gRNA
tactataaccagagcgaggacgg

SEQ ID NO: 7819 - DNA, 23 bp, Artificial Sequence
  HLA-A targeting gRNA
tacttcatggagtgggagcctgg

SEQ ID NO: 7820 - DNA, 23 bp, Artificial Sequence
  HLA-A targeting gRNA
tacttcatggagtgggaggctgg

SEQ ID NO: 7821 - DNA, 23 bp, Artificial Sequence
  HLA-A targeting gRNA
tacttctggaaattccttttggg

SEQ ID NO: 7822 - DNA, 23 bp, Artificial Sequence
  HLA-A targeting gRNA
tacttctggaaattctttttggg

SEQ ID NO: 7823 - DNA, 23 bp, Artificial Sequence
  HLA-A targeting gRNA
tagaagtcccaggtcccgggcgg

SEQ ID NO: 7824 - DNA, 23 bp, Artificial Sequence
  HLA-A targeting gRNA
tagacgacacgcagttcgtgcgg

SEQ ID NO: 7825 - DNA, 23 bp, Artificial Sequence
  HLA-A targeting gRNA
tagagtgggcaggggggtggtgg

SEQ ID NO: 7826 - DNA, 23 bp, Artificial Sequence
  HLA-A targeting gRNA
tagagtgggcggggggggcgggg

SEQ ID NO: 7827 - DNA, 23 bp, Artificial Sequence
  HLA-A targeting gRNA
tagagtgggcggggggggggtgg

SEQ ID NO: 7828 - DNA, 23 bp, Artificial Sequence
  HLA-A targeting gRNA
tagagtgggcgggggggggtggg

SEQ ID NO: 7829 - DNA, 23 bp, Artificial Sequence
  HLA-A targeting gRNA
tagagtgggcggggggggtgggg

SEQ ID NO: 7830 - DNA, 23 bp, Artificial Sequence
  HLA-A targeting gRNA
tagcacacagggtcccaggctgg

SEQ ID NO: 7831 - DNA, 23 bp, Artificial Sequence
  HLA-A targeting gRNA
tagcccacggtaatgaagcgggg

SEQ ID NO: 7832 - DNA, 23 bp, Artificial Sequence
  HLA-A targeting gRNA
tagcccacggtgatgaagcgggg

SEQ ID NO: 7833 - DNA, 23 bp, Artificial Sequence
  HLA-A targeting gRNA
tagcccactgagacgaagcgggg

SEQ ID NO: 7834 - DNA, 23 bp, Artificial Sequence
  HLA-A targeting gRNA
tagcccactgagatgaagcgggg

SEQ ID NO: 7835 - DNA, 23 bp, Artificial Sequence
  HLA-A targeting gRNA
tagcccactgcaatgaagcgggg

SEQ ID NO: 7836 - DNA, 23 bp, Artificial Sequence
  HLA-A targeting gRNA
tagcccactgcgatgaagtgggg

SEQ ID NO: 7837 - DNA, 23 bp, Artificial Sequence
  HLA-A targeting gRNA
tagcgcactgagatgaagcgggg

SEQ ID NO: 7838 - DNA, 23 bp, Artificial Sequence
  HLA-A targeting gRNA
tagcggtgaccacagctccaagg

SEQ ID NO: 7839 - DNA, 23 bp, Artificial Sequence
  HLA-A targeting gRNA
taggaggaagagctcaggtaggg

SEQ ID NO: 7840 - DNA, 23 bp, Artificial Sequence
  HLA-A targeting gRNA
taggaggaagagttcaggtaggg

SEQ ID NO: 7841 - DNA, 23 bp, Artificial Sequence
  HLA-A targeting gRNA
taggaggaagagttctggtaggg

SEQ ID NO: 7842 - DNA, 23 bp, Artificial Sequence
  HLA-A targeting gRNA
taggagggaaacggcctctgcgg

SEQ ID NO: 7843 - DNA, 23 bp, Artificial Sequence
  HLA-A targeting gRNA
taggcgacccgggccgtccgtgg

SEQ ID NO: 7844 - DNA, 23 bp, Artificial Sequence
  HLA-A targeting gRNA
taggctgggaagatggctctggg

SEQ ID NO: 7845 - DNA, 23 bp, Artificial Sequence
  HLA-A targeting gRNA
tagggaaggggtgaagagcgggg

SEQ ID NO: 7846 - DNA, 23 bp, Artificial Sequence
  HLA-A targeting gRNA
tagggaaggggtgaggagtgggg

SEQ ID NO: 7847 - DNA, 23 bp, Artificial Sequence
  HLA-A targeting gRNA
tagggaaggggtgaggggtgggg

SEQ ID NO: 7848 - DNA, 23 bp, Artificial Sequence
  HLA-A targeting gRNA
tagggaaggggtggggagtgggg

SEQ ID NO: 7849 - DNA, 23 bp, Artificial Sequence
  HLA-A targeting gRNA
taggtccgagatccgccccgagg

SEQ ID NO: 7850 - DNA, 23 bp, Artificial Sequence
  HLA-A targeting gRNA
tagttctggaaacttctcttggg

SEQ ID NO: 7851 - DNA, 23 bp, Artificial Sequence
  HLA-A targeting gRNA
tataaccagtacgcctacgacgg

SEQ ID NO: 7852 - DNA, 23 bp, Artificial Sequence
  HLA-A targeting gRNA
tataaccagttagcctacgacgg

SEQ ID NO: 7853 - DNA, 23 bp, Artificial Sequence
  HLA-A targeting gRNA
tataaccagttcgcctacgacgg

SEQ ID NO: 7854 - DNA, 23 bp, Artificial Sequence
  HLA-A targeting gRNA
tataaccagttcgcctacgatgg

SEQ ID NO: 7855 - DNA, 23 bp, Artificial Sequence
  HLA-A targeting gRNA
tatccaatacccaatgggagtgg

SEQ ID NO: 7856 - DNA, 23 bp, Artificial Sequence
  HLA-A targeting gRNA
tatcccaggtccctgtgtccagg

SEQ ID NO: 7857 - DNA, 23 bp, Artificial Sequence
  HLA-A targeting gRNA
tatcccaggtgcctgcgtccagg

SEQ ID NO: 7858 - DNA, 23 bp, Artificial Sequence
  HLA-A targeting gRNA
tatcccaggtgcctgcgtccggg

SEQ ID NO: 7859 - DNA, 23 bp, Artificial Sequence
  HLA-A targeting gRNA
tatccgacacccaatgggagtgg

SEQ ID NO: 7860 - DNA, 23 bp, Artificial Sequence
  HLA-A targeting gRNA
tatctctgctcttctccagaagg

SEQ ID NO: 7861 - DNA, 23 bp, Artificial Sequence
  HLA-A targeting gRNA
tatctctgctcttgtccagaagg

SEQ ID NO: 7862 - DNA, 23 bp, Artificial Sequence
  HLA-A targeting gRNA
tatctctgctgttctccagaagg

SEQ ID NO: 7863 - DNA, 23 bp, Artificial Sequence
  HLA-A targeting gRNA
tatctctgttcttgtccagaagg

SEQ ID NO: 7864 - DNA, 23 bp, Artificial Sequence
  HLA-A targeting gRNA
tatctcttctcagggaaagcagg

SEQ ID NO: 7865 - DNA, 23 bp, Artificial Sequence
  HLA-A targeting gRNA
tatctgcggagccactccacagg

SEQ ID NO: 7866 - DNA, 23 bp, Artificial Sequence
  HLA-A targeting gRNA
tatctgttctcagggaaagcagg

SEQ ID NO: 7867 - DNA, 23 bp, Artificial Sequence
  HLA-A targeting gRNA
tatgaccaggacgcctacgacgg

SEQ ID NO: 7868 - DNA, 23 bp, Artificial Sequence
  HLA-A targeting gRNA
tatgaccagtacgcctacgacgg

SEQ ID NO: 7869 - DNA, 23 bp, Artificial Sequence
  HLA-A targeting gRNA
tatgaccagtccgcctaagacgg

SEQ ID NO: 7870 - DNA, 23 bp, Artificial Sequence
  HLA-A targeting gRNA
tatgaccagtccgcctacgacgg

SEQ ID NO: 7871 - DNA, 23 bp, Artificial Sequence
  HLA-A targeting gRNA
tatgaccagttcgcctacgacgg

SEQ ID NO: 7872 - DNA, 23 bp, Artificial Sequence
  HLA-A targeting gRNA
tatgaccggtccgcctacgacgg

SEQ ID NO: 7873 - DNA, 23 bp, Artificial Sequence
  HLA-A targeting gRNA
tatgactacagacccaaggcagg

SEQ ID NO: 7874 - DNA, 23 bp, Artificial Sequence
  HLA-A targeting gRNA
tatgactacagacccagggcagg

SEQ ID NO: 7875 - DNA, 23 bp, Artificial Sequence
  HLA-A targeting gRNA
tatgactgcagacccagggcagg

SEQ ID NO: 7876 - DNA, 23 bp, Artificial Sequence
  HLA-A targeting gRNA
tatgagcagtatgcctacgacgg

SEQ ID NO: 7877 - DNA, 23 bp, Artificial Sequence
  HLA-A targeting gRNA
tatgatcagtccgcctacgacgg

SEQ ID NO: 7878 - DNA, 23 bp, Artificial Sequence
  HLA-A targeting gRNA
tatggccagtccgcctacgacgg

SEQ ID NO: 7879 - DNA, 23 bp, Artificial Sequence
  HLA-A targeting gRNA
tatggctgcgacgtggggcccgg

SEQ ID NO: 7880 - DNA, 23 bp, Artificial Sequence
  HLA-A targeting gRNA
tatgtaatccttgccgtcgtagg

SEQ ID NO: 7881 - DNA, 23 bp, Artificial Sequence
  HLA-A targeting gRNA
tatgtccagtacgcctacgacgg

SEQ ID NO: 7882 - DNA, 23 bp, Artificial Sequence
  HLA-A targeting gRNA
tatgtcccggcccggccgcgggg

SEQ ID NO: 7883 - DNA, 23 bp, Artificial Sequence
  HLA-A targeting gRNA
tatttctacaccgccgtgtccgg

SEQ ID NO: 7884 - DNA, 23 bp, Artificial Sequence
  HLA-A targeting gRNA
tcaaagaatccccattacccagg

SEQ ID NO: 7885 - DNA, 23 bp, Artificial Sequence
  HLA-A targeting gRNA
tcaaagaatctccattacccagg

SEQ ID NO: 7886 - DNA, 23 bp, Artificial Sequence
  HLA-A targeting gRNA
tcaaagaatgtccattacccagg

SEQ ID NO: 7887 - DNA, 23 bp, Artificial Sequence
  HLA-A targeting gRNA
tcaaaggatccccattacccagg

SEQ ID NO: 7888 - DNA, 23 bp, Artificial Sequence
  HLA-A targeting gRNA
tcaaaggatccccattacctagg

SEQ ID NO: 7889 - DNA, 23 bp, Artificial Sequence
  HLA-A targeting gRNA
tcaagagcccgcaggagacgtgg

SEQ ID NO: 7890 - DNA, 23 bp, Artificial Sequence
  HLA-A targeting gRNA
tcacagctcctaggacagctagg

SEQ ID NO: 7891 - DNA, 23 bp, Artificial Sequence
  HLA-A targeting gRNA
tcacaggggctaacgcagcctgg

SEQ ID NO: 7892 - DNA, 23 bp, Artificial Sequence
  HLA-A targeting gRNA
tcaccgctaagatgtgtaggagg

SEQ ID NO: 7893 - DNA, 23 bp, Artificial Sequence
  HLA-A targeting gRNA
tcaccgctatgatgtgtaggagg

SEQ ID NO: 7894 - DNA, 23 bp, Artificial Sequence
  HLA-A targeting gRNA
tcaccttcccctcctttcccagg

SEQ ID NO: 7895 - DNA, 23 bp, Artificial Sequence
  HLA-A targeting gRNA
tcaccttgatattatggtgttgg

SEQ ID NO: 7896 - DNA, 23 bp, Artificial Sequence
  HLA-A targeting gRNA
tcacgactccccatcccccacgg

SEQ ID NO: 7897 - DNA, 23 bp, Artificial Sequence
  HLA-A targeting gRNA
tcactcggtcagcctgtgcctgg

SEQ ID NO: 7898 - DNA, 23 bp, Artificial Sequence
  HLA-A targeting gRNA
tcactcggtcagtctgtgcctgg

SEQ ID NO: 7899 - DNA, 23 bp, Artificial Sequence
  HLA-A targeting gRNA
tcacttctcccaacctgcgtcgg

SEQ ID NO: 7900 - DNA, 23 bp, Artificial Sequence
  HLA-A targeting gRNA
tcacttcttctcccaacttgtgg

SEQ ID NO: 7901 - DNA, 23 bp, Artificial Sequence
  HLA-A targeting gRNA
tcagagcccacaggagacgtggg

SEQ ID NO: 7902 - DNA, 23 bp, Artificial Sequence
  HLA-A targeting gRNA
tcagagcccacaggagatgtggg

SEQ ID NO: 7903 - DNA, 23 bp, Artificial Sequence
  HLA-A targeting gRNA
tcagagcccgcaggagacgtggg

SEQ ID NO: 7904 - DNA, 23 bp, Artificial Sequence
  HLA-A targeting gRNA
tcagagcccgcaggagacgttgg

SEQ ID NO: 7905 - DNA, 23 bp, Artificial Sequence
  HLA-A targeting gRNA
tcagagcccgcaggagatgtggg

SEQ ID NO: 7906 - DNA, 23 bp, Artificial Sequence
  HLA-A targeting gRNA
tcagagccctcaggagacgtggg

SEQ ID NO: 7907 - DNA, 23 bp, Artificial Sequence
  HLA-A targeting gRNA
tcagatcacccagcacaagttgg

SEQ ID NO: 7908 - DNA, 23 bp, Artificial Sequence
  HLA-A targeting gRNA
tcagatcacccagcccaagtggg

SEQ ID NO: 7909 - DNA, 23 bp, Artificial Sequence
  HLA-A targeting gRNA
tcagatcacccagcccaagttgg

SEQ ID NO: 7910 - DNA, 23 bp, Artificial Sequence
  HLA-A targeting gRNA
tcagatcacccagcgcaaatggg

SEQ ID NO: 7911 - DNA, 23 bp, Artificial Sequence
  HLA-A targeting gRNA
tcagatcacccagcgcaagttgg

SEQ ID NO: 7912 - DNA, 23 bp, Artificial Sequence
  HLA-A targeting gRNA
tcagatcacccagcgtaagtggg

SEQ ID NO: 7913 - DNA, 23 bp, Artificial Sequence
  HLA-A targeting gRNA
tcagatcacccagctcaagtggg

SEQ ID NO: 7914 - DNA, 23 bp, Artificial Sequence
  HLA-A targeting gRNA
tcagatcactcagcgcaagttgg

SEQ ID NO: 7915 - DNA, 23 bp, Artificial Sequence
  HLA-A targeting gRNA
tcagatcatccagcgcaagtggg

SEQ ID NO: 7916 - DNA, 23 bp, Artificial Sequence
  HLA-A targeting gRNA
tcagatctcccagcgcaagtggg

SEQ ID NO: 7917 - DNA, 23 bp, Artificial Sequence
  HLA-A targeting gRNA
tcagatctcccagcgcaagttgg

SEQ ID NO: 7918 - DNA, 23 bp, Artificial Sequence
  HLA-A targeting gRNA
tcagattacccagcgcaagttgg

SEQ ID NO: 7919 - DNA, 23 bp, Artificial Sequence
  HLA-A targeting gRNA
tcagccctgacccagctgaaggg

SEQ ID NO: 7920 - DNA, 23 bp, Artificial Sequence
  HLA-A targeting gRNA
tcagccctgacccggctgaaggg

SEQ ID NO: 7921 - DNA, 23 bp, Artificial Sequence
  HLA-A targeting gRNA
tcagccctgacctggctgaaggg

SEQ ID NO: 7922 - DNA, 23 bp, Artificial Sequence
  HLA-A targeting gRNA
tcaggctgcgtgtaagtgatggg

SEQ ID NO: 7923 - DNA, 23 bp, Artificial Sequence
  HLA-A targeting gRNA
tcaggctgcgtgtaagtggtggg

SEQ ID NO: 7924 - DNA, 23 bp, Artificial Sequence
  HLA-A targeting gRNA
tcagggccatgcgatcttagggg

SEQ ID NO: 7925 - DNA, 23 bp, Artificial Sequence
  HLA-A targeting gRNA
tcagggcggggcggggctcgggg

SEQ ID NO: 7926 - DNA, 23 bp, Artificial Sequence
  HLA-A targeting gRNA
tcaggggaaggtccctgctaagg

SEQ ID NO: 7927 - DNA, 23 bp, Artificial Sequence
  HLA-A targeting gRNA
tcaggtagggaaggggtgagggg

SEQ ID NO: 7928 - DNA, 23 bp, Artificial Sequence
  HLA-A targeting gRNA
tcagtccgcctacgacggcaagg

SEQ ID NO: 7929 - DNA, 23 bp, Artificial Sequence
  HLA-A targeting gRNA
tcatcccattctccattcaaggg

SEQ ID NO: 7930 - DNA, 23 bp, Artificial Sequence
  HLA-A targeting gRNA
tcatcccattttccattcaaggg

SEQ ID NO: 7931 - DNA, 23 bp, Artificial Sequence
  HLA-A targeting gRNA
tcatcccccacggacggcccggg

SEQ ID NO: 7932 - DNA, 23 bp, Artificial Sequence
  HLA-A targeting gRNA
tcatgactattgtgttctgtagg

SEQ ID NO: 7933 - DNA, 23 bp, Artificial Sequence
  HLA-A targeting gRNA
tcatgccattctccattcaacgg

SEQ ID NO: 7934 - DNA, 23 bp, Artificial Sequence
  HLA-A targeting gRNA
tcatgccattctccattcaaggg

SEQ ID NO: 7935 - DNA, 23 bp, Artificial Sequence
  HLA-A targeting gRNA
tcattcggtcagtctgtgcctgg

SEQ ID NO: 7936 - DNA, 23 bp, Artificial Sequence
  HLA-A targeting gRNA
tcattttcctcccctcctcgtgg

SEQ ID NO: 7937 - DNA, 23 bp, Artificial Sequence
  HLA-A targeting gRNA
tccaacttttctgagtccttcgg

SEQ ID NO: 7938 - DNA, 23 bp, Artificial Sequence
  HLA-A targeting gRNA
tccaagcctcagccctgacccgg

SEQ ID NO: 7939 - DNA, 23 bp, Artificial Sequence
  HLA-A targeting gRNA
tccaagggccgtgtctgcactgg

SEQ ID NO: 7940 - DNA, 23 bp, Artificial Sequence
  HLA-A targeting gRNA
tccaagggccgtgtctgcattgg

SEQ ID NO: 7941 - DNA, 23 bp, Artificial Sequence
  HLA-A targeting gRNA
tccaatgaatagattatcccagg

SEQ ID NO: 7942 - DNA, 23 bp, Artificial Sequence
  HLA-A targeting gRNA
tccacatccgtgtcctggcccgg

SEQ ID NO: 7943 - DNA, 23 bp, Artificial Sequence
  HLA-A targeting gRNA
tccaccccaaggtggatctgcgg

SEQ ID NO: 7944 - DNA, 23 bp, Artificial Sequence
  HLA-A targeting gRNA
tccagccagcgacagtgcccagg

SEQ ID NO: 7945 - DNA, 23 bp, Artificial Sequence
  HLA-A targeting gRNA
tccagcttttctgagtccttcgg

SEQ ID NO: 7946 - DNA, 23 bp, Artificial Sequence
  HLA-A targeting gRNA
tccaggcagcgacagtgcccagg

SEQ ID NO: 7947 - DNA, 23 bp, Artificial Sequence
  HLA-A targeting gRNA
tccaggtctcgatcagggccagg

SEQ ID NO: 7948 - DNA, 23 bp, Artificial Sequence
  HLA-A targeting gRNA
tcccactcccattgggtgtcggg

SEQ ID NO: 7949 - DNA, 23 bp, Artificial Sequence
  HLA-A targeting gRNA
tcccaggctcccactccatgagg

SEQ ID NO: 7950 - DNA, 23 bp, Artificial Sequence
  HLA-A targeting gRNA
tcccagggccgtgtctgcattgg

SEQ ID NO: 7951 - DNA, 23 bp, Artificial Sequence
  HLA-A targeting gRNA
tcccaggtgcctgcatccgctgg

SEQ ID NO: 7952 - DNA, 23 bp, Artificial Sequence
  HLA-A targeting gRNA
tcccaggtgcctgcgtccgctgg

SEQ ID NO: 7953 - DNA, 23 bp, Artificial Sequence
  HLA-A targeting gRNA
tcccattctccaggtatctgcgg

SEQ ID NO: 7954 - DNA, 23 bp, Artificial Sequence
  HLA-A targeting gRNA
tcccattctccattcaagggagg

SEQ ID NO: 7955 - DNA, 23 bp, Artificial Sequence
  HLA-A targeting gRNA
tcccattcttcaggtatctgcgg

SEQ ID NO: 7956 - DNA, 23 bp, Artificial Sequence
  HLA-A targeting gRNA
tcccattcttcaggtgtctgcgg

SEQ ID NO: 7957 - DNA, 23 bp, Artificial Sequence
  HLA-A targeting gRNA
tcccattttccattcaagggagg

SEQ ID NO: 7958 - DNA, 23 bp, Artificial Sequence
  HLA-A targeting gRNA
tccccaattcccactcccattgg

SEQ ID NO: 7959 - DNA, 23 bp, Artificial Sequence
  HLA-A targeting gRNA
tccccacttcccactcccattgg

SEQ ID NO: 7960 - DNA, 23 bp, Artificial Sequence
  HLA-A targeting gRNA
tccccatttcccactcccattgg

SEQ ID NO: 7961 - DNA, 23 bp, Artificial Sequence
  HLA-A targeting gRNA
tccccgcgggttgggcggggcgg

SEQ ID NO: 7962 - DNA, 23 bp, Artificial Sequence
  HLA-A targeting gRNA
tccccgcgggttggtcagggcgg

SEQ ID NO: 7963 - DNA, 23 bp, Artificial Sequence
  HLA-A targeting gRNA
tccccgcgggttggtcggggcgg

SEQ ID NO: 7964 - DNA, 23 bp, Artificial Sequence
  HLA-A targeting gRNA
tcccctccttaccccagctcagg

SEQ ID NO: 7965 - DNA, 23 bp, Artificial Sequence
  HLA-A targeting gRNA
tcccgagagcagcaggaggacgg

SEQ ID NO: 7966 - DNA, 23 bp, Artificial Sequence
  HLA-A targeting gRNA
tcccgagagcagcaggaggaggg

SEQ ID NO: 7967 - DNA, 23 bp, Artificial Sequence
  HLA-A targeting gRNA
tcccgagagcagcaggatgaggg

SEQ ID NO: 7968 - DNA, 23 bp, Artificial Sequence
  HLA-A targeting gRNA
tcccggcatggcctcccacgagg

SEQ ID NO: 7969 - DNA, 23 bp, Artificial Sequence
  HLA-A targeting gRNA
tcccgggatggcctcccacgagg

SEQ ID NO: 7970 - DNA, 23 bp, Artificial Sequence
  HLA-A targeting gRNA
tcccgggatggccttccacgagg

SEQ ID NO: 7971 - DNA, 23 bp, Artificial Sequence
  HLA-A targeting gRNA
tcccgttccccaggtatctgcgg

SEQ ID NO: 7972 - DNA, 23 bp, Artificial Sequence
  HLA-A targeting gRNA
tcccgttctccagatatctgcgg

SEQ ID NO: 7973 - DNA, 23 bp, Artificial Sequence
  HLA-A targeting gRNA
tcccgttctccaggtatccgcgg

SEQ ID NO: 7974 - DNA, 23 bp, Artificial Sequence
  HLA-A targeting gRNA
tccctttctccaggtatctgcgg

SEQ ID NO: 7975 - DNA, 23 bp, Artificial Sequence
  HLA-A targeting gRNA
tccctttcttcaggtatctgcgg

SEQ ID NO: 7976 - DNA, 23 bp, Artificial Sequence
  HLA-A targeting gRNA
tccgagagccttgtctgcattgg

SEQ ID NO: 7977 - DNA, 23 bp, Artificial Sequence
  HLA-A targeting gRNA
tccgagggccgcgtctgcaatgg

SEQ ID NO: 7978 - DNA, 23 bp, Artificial Sequence
  HLA-A targeting gRNA
tccgagggccgcgtctgcattgg

SEQ ID NO: 7979 - DNA, 23 bp, Artificial Sequence
  HLA-A targeting gRNA
tccgagtccgggtgggtgactgg

SEQ ID NO: 7980 - DNA, 23 bp, Artificial Sequence
  HLA-A targeting gRNA
tccgcagacacctgaagaatggg

SEQ ID NO: 7981 - DNA, 23 bp, Artificial Sequence
  HLA-A targeting gRNA
tccgcagacacctggagaacagg

SEQ ID NO: 7982 - DNA, 23 bp, Artificial Sequence
  HLA-A targeting gRNA
tccgcagatacctgaagaaaggg

SEQ ID NO: 7983 - DNA, 23 bp, Artificial Sequence
  HLA-A targeting gRNA
tccgcagatacctgaagaatggg

SEQ ID NO: 7984 - DNA, 23 bp, Artificial Sequence
  HLA-A targeting gRNA
tccgcagatacctggagaaaggg

SEQ ID NO: 7985 - DNA, 23 bp, Artificial Sequence
  HLA-A targeting gRNA
tccgcagatacctggagaacagg

SEQ ID NO: 7986 - DNA, 23 bp, Artificial Sequence
  HLA-A targeting gRNA
tccgcagatacctggagaaccgg

SEQ ID NO: 7987 - DNA, 23 bp, Artificial Sequence
  HLA-A targeting gRNA
tccgcagatacctggagaatggg

SEQ ID NO: 7988 - DNA, 23 bp, Artificial Sequence
  HLA-A targeting gRNA
tccgcagatacctggggaacggg

SEQ ID NO: 7989 - DNA, 23 bp, Artificial Sequence
  HLA-A targeting gRNA
tccgcagatatctggagaacggg

SEQ ID NO: 7990 - DNA, 23 bp, Artificial Sequence
  HLA-A targeting gRNA
tccgcagatccaccttggggtgg

SEQ ID NO: 7991 - DNA, 23 bp, Artificial Sequence
  HLA-A targeting gRNA
tccgccgcgtccaggagcgcagg

SEQ ID NO: 7992 - DNA, 23 bp, Artificial Sequence
  HLA-A targeting gRNA
tccgcggatacctggagaacggg

SEQ ID NO: 7993 - DNA, 23 bp, Artificial Sequence
  HLA-A targeting gRNA
tccgcggccaggccgggacacgg

SEQ ID NO: 7994 - DNA, 23 bp, Artificial Sequence
  HLA-A targeting gRNA
tccgcggccgggccaggacacgg

SEQ ID NO: 7995 - DNA, 23 bp, Artificial Sequence
  HLA-A targeting gRNA
tccgcggccgggcccggacacgg

SEQ ID NO: 7996 - DNA, 23 bp, Artificial Sequence
  HLA-A targeting gRNA
tccgcggccgggccgggacacgg

SEQ ID NO: 7997 - DNA, 23 bp, Artificial Sequence
  HLA-A targeting gRNA
tccgcggcctggccgggacacgg

SEQ ID NO: 7998 - DNA, 23 bp, Artificial Sequence
  HLA-A targeting gRNA
tccggcccctcctccacccacgg

SEQ ID NO: 7999 - DNA, 23 bp, Artificial Sequence
  HLA-A targeting gRNA
tccggttctccaggtatctgcgg

SEQ ID NO: 8000 - DNA, 23 bp, Artificial Sequence
  HLA-A targeting gRNA
tccggttgtagtagccgcgcagg

SEQ ID NO: 8001 - DNA, 23 bp, Artificial Sequence
  HLA-A targeting gRNA
tccgtgtcccggcccggcagcgg

SEQ ID NO: 8002 - DNA, 23 bp, Artificial Sequence
  HLA-A targeting gRNA
tccgtgtcccggcctggccgcgg

SEQ ID NO: 8003 - DNA, 23 bp, Artificial Sequence
  HLA-A targeting gRNA
tccgtgtcctggcccggccgcgg

SEQ ID NO: 8004 - DNA, 23 bp, Artificial Sequence
  HLA-A targeting gRNA
tcctaaggtctgtccttagcagg

SEQ ID NO: 8005 - DNA, 23 bp, Artificial Sequence
  HLA-A targeting gRNA
tcctaccggcgcggctccccggg

SEQ ID NO: 8006 - DNA, 23 bp, Artificial Sequence
  HLA-A targeting gRNA
tcctccacccacggcgcccgcgg

SEQ ID NO: 8007 - DNA, 23 bp, Artificial Sequence
  HLA-A targeting gRNA
tcctcccctttgtgacttcaagg

SEQ ID NO: 8008 - DNA, 23 bp, Artificial Sequence
  HLA-A targeting gRNA
tcctcccggcgcggctccccggg

SEQ ID NO: 8009 - DNA, 23 bp, Artificial Sequence
  HLA-A targeting gRNA
tcctcccggcgcggctcctcagg

SEQ ID NO: 8010 - DNA, 23 bp, Artificial Sequence
  HLA-A targeting gRNA
tcctccctgcgccgctccccggg

SEQ ID NO: 8011 - DNA, 23 bp, Artificial Sequence
  HLA-A targeting gRNA
tcctccctgcgcggctccccggg

SEQ ID NO: 8012 - DNA, 23 bp, Artificial Sequence
  HLA-A targeting gRNA
tcctccctgcgcggcttcccggg

SEQ ID NO: 8013 - DNA, 23 bp, Artificial Sequence
  HLA-A targeting gRNA
tcctcgtggaaggccatcccggg

SEQ ID NO: 8014 - DNA, 23 bp, Artificial Sequence
  HLA-A targeting gRNA
tcctcgtgggaggccatcccggg

SEQ ID NO: 8015 - DNA, 23 bp, Artificial Sequence
  HLA-A targeting gRNA
tcctcgtgggaggccatgccggg

SEQ ID NO: 8016 - DNA, 23 bp, Artificial Sequence
  HLA-A targeting gRNA
tcctgaagatctgtgtgttccgg

SEQ ID NO: 8017 - DNA, 23 bp, Artificial Sequence
  HLA-A targeting gRNA
tcctggccctgaccgagacctgg

SEQ ID NO: 8018 - DNA, 23 bp, Artificial Sequence
  HLA-A targeting gRNA
tcctgtccaacgtctcctgcggg

SEQ ID NO: 8019 - DNA, 23 bp, Artificial Sequence
  HLA-A targeting gRNA
tcctgtcccacgtctcctgaggg

SEQ ID NO: 8020 - DNA, 23 bp, Artificial Sequence
  HLA-A targeting gRNA
tcctgtcccacgtctcctgcggg

SEQ ID NO: 8021 - DNA, 23 bp, Artificial Sequence
  HLA-A targeting gRNA
tcctgtcccacgtctcctgtggg

SEQ ID NO: 8022 - DNA, 23 bp, Artificial Sequence
  HLA-A targeting gRNA
tcctgttctccaggtatctgcgg

SEQ ID NO: 8023 - DNA, 23 bp, Artificial Sequence
  HLA-A targeting gRNA
tcctgttctccaggtgtctgcgg

SEQ ID NO: 8024 - DNA, 23 bp, Artificial Sequence
  HLA-A targeting gRNA
tcctgttttggttctactccagg

SEQ ID NO: 8025 - DNA, 23 bp, Artificial Sequence
  HLA-A targeting gRNA
tcctgtttttgttctactccagg

SEQ ID NO: 8026 - DNA, 23 bp, Artificial Sequence
  HLA-A targeting gRNA
tccttctggagcccttcagccgg

SEQ ID NO: 8027 - DNA, 23 bp, Artificial Sequence
  HLA-A targeting gRNA
tcgacgggcgcctcctccgcggg

SEQ ID NO: 8028 - DNA, 23 bp, Artificial Sequence
  HLA-A targeting gRNA
tcgccggtcgagggtctgggcgg

SEQ ID NO: 8029 - DNA, 23 bp, Artificial Sequence
  HLA-A targeting gRNA
tcgccggtcgagggtttgggcgg

SEQ ID NO: 8030 - DNA, 23 bp, Artificial Sequence
  HLA-A targeting gRNA
tcgcctggtctccacaagctcgg

SEQ ID NO: 8031 - DNA, 23 bp, Artificial Sequence
  HLA-A targeting gRNA
tcgcgggacggggctgaccacgg

SEQ ID NO: 8032 - DNA, 23 bp, Artificial Sequence
  HLA-A targeting gRNA
tcgctactgtgatgtgtaggagg

SEQ ID NO: 8033 - DNA, 23 bp, Artificial Sequence
  HLA-A targeting gRNA
tcgctgctgtgatacataggagg

SEQ ID NO: 8034 - DNA, 23 bp, Artificial Sequence
  HLA-A targeting gRNA
tcgctgctgtgatgtgtaggagg

SEQ ID NO: 8035 - DNA, 23 bp, Artificial Sequence
  HLA-A targeting gRNA
tcgctgctgtggtgtgtaggagg

SEQ ID NO: 8036 - DNA, 23 bp, Artificial Sequence
  HLA-A targeting gRNA
tcgcttgtaaggtgagattctgg

SEQ ID NO: 8037 - DNA, 23 bp, Artificial Sequence
  HLA-A targeting gRNA
tcggacgggcgcctcctccgcgg

SEQ ID NO: 8038 - DNA, 23 bp, Artificial Sequence
  HLA-A targeting gRNA
tcgggacctgcgccccgggccgg

SEQ ID NO: 8039 - DNA, 23 bp, Artificial Sequence
  HLA-A targeting gRNA
tcgggactggggcggggctcggg

SEQ ID NO: 8040 - DNA, 23 bp, Artificial Sequence
  HLA-A targeting gRNA
tcgggcccctcctcgcccccagg

SEQ ID NO: 8041 - DNA, 23 bp, Artificial Sequence
  HLA-A targeting gRNA
tcggggctggggcggggctcggg

SEQ ID NO: 8042 - DNA, 23 bp, Artificial Sequence
  HLA-A targeting gRNA
tcggggctggggcggggttcggg

SEQ ID NO: 8043 - DNA, 23 bp, Artificial Sequence
  HLA-A targeting gRNA
tcgggggaaggtccctgctaagg

SEQ ID NO: 8044 - DNA, 23 bp, Artificial Sequence
  HLA-A targeting gRNA
tcgggggaccgggctgaccacgg

SEQ ID NO: 8045 - DNA, 23 bp, Artificial Sequence
  HLA-A targeting gRNA
tcgggggacgggctgaccacggg

SEQ ID NO: 8046 - DNA, 23 bp, Artificial Sequence
  HLA-A targeting gRNA
tcgggggacggggctgaccacgg

SEQ ID NO: 8047 - DNA, 23 bp, Artificial Sequence
  HLA-A targeting gRNA
tcgggggacggggctgaccgcgg

SEQ ID NO: 8048 - DNA, 23 bp, Artificial Sequence
  HLA-A targeting gRNA
tcgggggacggggctggccgcgg

SEQ ID NO: 8049 - DNA, 23 bp, Artificial Sequence
  HLA-A targeting gRNA
tcgggggacggtgctgaccgcgg

SEQ ID NO: 8050 - DNA, 23 bp, Artificial Sequence
  HLA-A targeting gRNA
tcgggggactgggctgaccacgg

SEQ ID NO: 8051 - DNA, 23 bp, Artificial Sequence
  HLA-A targeting gRNA
tcgggggcggatctcggacccgg

SEQ ID NO: 8052 - DNA, 23 bp, Artificial Sequence
  HLA-A targeting gRNA
tcggtaaggagggggatgagggg

SEQ ID NO: 8053 - DNA, 23 bp, Artificial Sequence
  HLA-A targeting gRNA
tcgtgacctgcgccccaggccgg

SEQ ID NO: 8054 - DNA, 23 bp, Artificial Sequence
  HLA-A targeting gRNA
tctagaacccgacacccaatggg

SEQ ID NO: 8055 - DNA, 23 bp, Artificial Sequence
  HLA-A targeting gRNA
tctagaatccgacacccaatggg

SEQ ID NO: 8056 - DNA, 23 bp, Artificial Sequence
  HLA-A targeting gRNA
tctagacacccgacacccaatgg

SEQ ID NO: 8057 - DNA, 23 bp, Artificial Sequence
  HLA-A targeting gRNA
tctagagtgggcgggggggcggg

SEQ ID NO: 8058 - DNA, 23 bp, Artificial Sequence
  HLA-A targeting gRNA
tctagagtgggcggggggggcgg

SEQ ID NO: 8059 - DNA, 23 bp, Artificial Sequence
  HLA-A targeting gRNA
tctagagtgggcggggggggtgg

SEQ ID NO: 8060 - DNA, 23 bp, Artificial Sequence
  HLA-A targeting gRNA
tctagagtgggtgggggtggcgg

SEQ ID NO: 8061 - DNA, 23 bp, Artificial Sequence
  HLA-A targeting gRNA
tctagagtgggtggggtggcagg

SEQ ID NO: 8062 - DNA, 23 bp, Artificial Sequence
  HLA-A targeting gRNA
tctagagtgggtggggtggcggg

SEQ ID NO: 8063 - DNA, 23 bp, Artificial Sequence
  HLA-A targeting gRNA
tctagatatccaatacccaatgg

SEQ ID NO: 8064 - DNA, 23 bp, Artificial Sequence
  HLA-A targeting gRNA
tctagatatccgacacccaatgg

SEQ ID NO: 8065 - DNA, 23 bp, Artificial Sequence
  HLA-A targeting gRNA
tctcaactgctccgcctcacggg

SEQ ID NO: 8066 - DNA, 23 bp, Artificial Sequence
  HLA-A targeting gRNA
tctcacatccagaggatgtacgg

SEQ ID NO: 8067 - DNA, 23 bp, Artificial Sequence
  HLA-A targeting gRNA
tctcagcccctccttgccccagg

SEQ ID NO: 8068 - DNA, 23 bp, Artificial Sequence
  HLA-A targeting gRNA
tctcagctgctccgccacacggg

SEQ ID NO: 8069 - DNA, 23 bp, Artificial Sequence
  HLA-A targeting gRNA
tctcagctgctccgccacccggg

SEQ ID NO: 8070 - DNA, 23 bp, Artificial Sequence
  HLA-A targeting gRNA
tctcagctgctccgccccacggg

SEQ ID NO: 8071 - DNA, 23 bp, Artificial Sequence
  HLA-A targeting gRNA
tctcagctgctccgccgcacggg

SEQ ID NO: 8072 - DNA, 23 bp, Artificial Sequence
  HLA-A targeting gRNA
tctcagctgctccgccgtacggg

SEQ ID NO: 8073 - DNA, 23 bp, Artificial Sequence
  HLA-A targeting gRNA
tctcagctgctccgcctcacggg

SEQ ID NO: 8074 - DNA, 23 bp, Artificial Sequence
  HLA-A targeting gRNA
tctcagctgctcggccgcacggg

SEQ ID NO: 8075 - DNA, 23 bp, Artificial Sequence
  HLA-A targeting gRNA
tctcaggctggtcacatgggtgg

SEQ ID NO: 8076 - DNA, 23 bp, Artificial Sequence
  HLA-A targeting gRNA
tctcagggtctcaggctccaagg

SEQ ID NO: 8077 - DNA, 23 bp, Artificial Sequence
  HLA-A targeting gRNA
tctcagggtctcaggctccgagg

SEQ ID NO: 8078 - DNA, 23 bp, Artificial Sequence
  HLA-A targeting gRNA
tctccacaagctcggtgtcctgg

SEQ ID NO: 8079 - DNA, 23 bp, Artificial Sequence
  HLA-A targeting gRNA
tctccacagggtagaaacccagg

SEQ ID NO: 8080 - DNA, 23 bp, Artificial Sequence
  HLA-A targeting gRNA
tctccacagggtagaagcccagg

SEQ ID NO: 8081 - DNA, 23 bp, Artificial Sequence
  HLA-A targeting gRNA
tctccactgctccgccgcacggg

SEQ ID NO: 8082 - DNA, 23 bp, Artificial Sequence
  HLA-A targeting gRNA
tctccactgctccgcctcacggg

SEQ ID NO: 8083 - DNA, 23 bp, Artificial Sequence
  HLA-A targeting gRNA
tctccccagacgccgagatgcgg

SEQ ID NO: 8084 - DNA, 23 bp, Artificial Sequence
  HLA-A targeting gRNA
tctccccagaggccgagatgcgg

SEQ ID NO: 8085 - DNA, 23 bp, Artificial Sequence
  HLA-A targeting gRNA
tctccccagggtagaagcccagg

SEQ ID NO: 8086 - DNA, 23 bp, Artificial Sequence
  HLA-A targeting gRNA
tctccgcagggtagaaacccagg

SEQ ID NO: 8087 - DNA, 23 bp, Artificial Sequence
  HLA-A targeting gRNA
tctccgcagggtagaagcacagg

SEQ ID NO: 8088 - DNA, 23 bp, Artificial Sequence
  HLA-A targeting gRNA
tctccgctgctccgccacacggg

SEQ ID NO: 8089 - DNA, 23 bp, Artificial Sequence
  HLA-A targeting gRNA
tctccgctgctccgcctcacagg

SEQ ID NO: 8090 - DNA, 23 bp, Artificial Sequence
  HLA-A targeting gRNA
tctccgctgctccgcctcaccgg

SEQ ID NO: 8091 - DNA, 23 bp, Artificial Sequence
  HLA-A targeting gRNA
tctccgctgctccgcctcacggg

SEQ ID NO: 8092 - DNA, 23 bp, Artificial Sequence
  HLA-A targeting gRNA
tctccggccgagggtctgggcgg

SEQ ID NO: 8093 - DNA, 23 bp, Artificial Sequence
  HLA-A targeting gRNA
tctccggtcgagggtctgggcgg

SEQ ID NO: 8094 - DNA, 23 bp, Artificial Sequence
  HLA-A targeting gRNA
tctccgtagggtagaagcccagg

SEQ ID NO: 8095 - DNA, 23 bp, Artificial Sequence
  HLA-A targeting gRNA
tctccgttgctccgcctcacggg

SEQ ID NO: 8096 - DNA, 23 bp, Artificial Sequence
  HLA-A targeting gRNA
tctcctcagacaccgagatgcgg

SEQ ID NO: 8097 - DNA, 23 bp, Artificial Sequence
  HLA-A targeting gRNA
tctcctcagacgccgagatgcgg

SEQ ID NO: 8098 - DNA, 23 bp, Artificial Sequence
  HLA-A targeting gRNA
tctcctgcgggctcttgaccagg

SEQ ID NO: 8099 - DNA, 23 bp, Artificial Sequence
  HLA-A targeting gRNA
tctctaggacaattaagggatgg

SEQ ID NO: 8100 - DNA, 23 bp, Artificial Sequence
  HLA-A targeting gRNA
tctctccacctcctcacattagg

SEQ ID NO: 8101 - DNA, 23 bp, Artificial Sequence
  HLA-A targeting gRNA
tctctccgtcagtctgtgcctgg

SEQ ID NO: 8102 - DNA, 23 bp, Artificial Sequence
  HLA-A targeting gRNA
tctctcggtcagtctgtgcctgg

SEQ ID NO: 8103 - DNA, 23 bp, Artificial Sequence
  HLA-A targeting gRNA
tctctgctgctccgccgcacggg

SEQ ID NO: 8104 - DNA, 23 bp, Artificial Sequence
  HLA-A targeting gRNA
tctctgggtctcaagctcccagg

SEQ ID NO: 8105 - DNA, 23 bp, Artificial Sequence
  HLA-A targeting gRNA
tctgagccgccgtgtccgccagg

SEQ ID NO: 8106 - DNA, 23 bp, Artificial Sequence
  HLA-A targeting gRNA
tctgaggagactctgagtccggg

SEQ ID NO: 8107 - DNA, 23 bp, Artificial Sequence
  HLA-A targeting gRNA
tctgaggagattctgagtccggg

SEQ ID NO: 8108 - DNA, 23 bp, Artificial Sequence
  HLA-A targeting gRNA
tctgaggagattttgagtccggg

SEQ ID NO: 8109 - DNA, 23 bp, Artificial Sequence
  HLA-A targeting gRNA
tctgagtccgggtgggtgactgg

SEQ ID NO: 8110 - DNA, 23 bp, Artificial Sequence
  HLA-A targeting gRNA
tctgagtccgggtgggtgcgtgg

SEQ ID NO: 8111 - DNA, 23 bp, Artificial Sequence
  HLA-A targeting gRNA
tctgagttttcttgtcccactgg

SEQ ID NO: 8112 - DNA, 23 bp, Artificial Sequence
  HLA-A targeting gRNA
tctgcactgctccgcctcacggg

SEQ ID NO: 8113 - DNA, 23 bp, Artificial Sequence
  HLA-A targeting gRNA
tctgccccacactcagtgtttgg

SEQ ID NO: 8114 - DNA, 23 bp, Artificial Sequence
  HLA-A targeting gRNA
tctgccgccttccccaccccagg

SEQ ID NO: 8115 - DNA, 23 bp, Artificial Sequence
  HLA-A targeting gRNA
tctgcgctcctggaccgccgcgg

SEQ ID NO: 8116 - DNA, 23 bp, Artificial Sequence
  HLA-A targeting gRNA
tctgcggtcgaggttctgggcgg

SEQ ID NO: 8117 - DNA, 23 bp, Artificial Sequence
  HLA-A targeting gRNA
tctgcgttcctggaccgccgcgg

SEQ ID NO: 8118 - DNA, 23 bp, Artificial Sequence
  HLA-A targeting gRNA
tctgctcccgatctgagtggagg

SEQ ID NO: 8119 - DNA, 23 bp, Artificial Sequence
  HLA-A targeting gRNA
tctgctcctgatctaagtggagg

SEQ ID NO: 8120 - DNA, 23 bp, Artificial Sequence
  HLA-A targeting gRNA
tctgctcctgatctgagtagagg

SEQ ID NO: 8121 - DNA, 23 bp, Artificial Sequence
  HLA-A targeting gRNA
tctgctcctgatctgagtggagg

SEQ ID NO: 8122 - DNA, 23 bp, Artificial Sequence
  HLA-A targeting gRNA
tctgctctctaggacaattaagg

SEQ ID NO: 8123 - DNA, 23 bp, Artificial Sequence
  HLA-A targeting gRNA
tctgctgtctaggacaattaagg

SEQ ID NO: 8124 - DNA, 23 bp, Artificial Sequence
  HLA-A targeting gRNA
tctggcatctctttctacaaagg

SEQ ID NO: 8125 - DNA, 23 bp, Artificial Sequence
  HLA-A targeting gRNA
tctggcatctctttctgcaaagg

SEQ ID NO: 8126 - DNA, 23 bp, Artificial Sequence
  HLA-A targeting gRNA
tctgggagctgaagtggtcgggg

SEQ ID NO: 8127 - DNA, 23 bp, Artificial Sequence
  HLA-A targeting gRNA
tctggggagaatccgagtccggg

SEQ ID NO: 8128 - DNA, 23 bp, Artificial Sequence
  HLA-A targeting gRNA
tctggggagaatctgagtccggg

SEQ ID NO: 8129 - DNA, 23 bp, Artificial Sequence
  HLA-A targeting gRNA
tctggggagaatgtgagtccggg

SEQ ID NO: 8130 - DNA, 23 bp, Artificial Sequence
  HLA-A targeting gRNA
tctggggagctgaagtggtcggg

SEQ ID NO: 8131 - DNA, 23 bp, Artificial Sequence
  HLA-A targeting gRNA
tctggggagctgaagtggtctgg

SEQ ID NO: 8132 - DNA, 23 bp, Artificial Sequence
  HLA-A targeting gRNA
tctggggcggggtggggcagagg

SEQ ID NO: 8133 - DNA, 23 bp, Artificial Sequence
  HLA-A targeting gRNA
tctggggggggggggggcagagg

SEQ ID NO: 8134 - DNA, 23 bp, Artificial Sequence
  HLA-A targeting gRNA
tctgggggtgggtggggcagagg

SEQ ID NO: 8135 - DNA, 23 bp, Artificial Sequence
  HLA-A targeting gRNA
tctgggggtgggtggggcagtgg

SEQ ID NO: 8136 - DNA, 23 bp, Artificial Sequence
  HLA-A targeting gRNA
tctgggttttcttgtcccactgg

SEQ ID NO: 8137 - DNA, 23 bp, Artificial Sequence
  HLA-A targeting gRNA
tctgggttttcttgttccactgg

SEQ ID NO: 8138 - DNA, 23 bp, Artificial Sequence
  HLA-A targeting gRNA
tctgggttttgttgtcccactgg

SEQ ID NO: 8139 - DNA, 23 bp, Artificial Sequence
  HLA-A targeting gRNA
tctggtagggaaggggtgagggg

SEQ ID NO: 8140 - DNA, 23 bp, Artificial Sequence
  HLA-A targeting gRNA
tctggttatagtagccgcgcagg

SEQ ID NO: 8141 - DNA, 23 bp, Artificial Sequence
  HLA-A targeting gRNA
tctggttgtagtagccaagcagg

SEQ ID NO: 8142 - DNA, 23 bp, Artificial Sequence
  HLA-A targeting gRNA
tctggttgtagtagcggagcagg

SEQ ID NO: 8143 - DNA, 23 bp, Artificial Sequence
  HLA-A targeting gRNA
tctggttgtagtagctgcgcagg

SEQ ID NO: 8144 - DNA, 23 bp, Artificial Sequence
  HLA-A targeting gRNA
tctggttgtagtggccgcgcagg

SEQ ID NO: 8145 - DNA, 23 bp, Artificial Sequence
  HLA-A targeting gRNA
tctgtcctgctccgccacacggg

SEQ ID NO: 8146 - DNA, 23 bp, Artificial Sequence
  HLA-A targeting gRNA
tctgtcctgctccgccatacggg

SEQ ID NO: 8147 - DNA, 23 bp, Artificial Sequence
  HLA-A targeting gRNA
tctgtcctgctccgccgcacggg

SEQ ID NO: 8148 - DNA, 23 bp, Artificial Sequence
  HLA-A targeting gRNA
tctgttcctgatctgagtggagg

SEQ ID NO: 8149 - DNA, 23 bp, Artificial Sequence
  HLA-A targeting gRNA
tcttagctgctccgccacacggg

SEQ ID NO: 8150 - DNA, 23 bp, Artificial Sequence
  HLA-A targeting gRNA
tcttcccctccatttcctcaagg

SEQ ID NO: 8151 - DNA, 23 bp, Artificial Sequence
  HLA-A targeting gRNA
tcttcccctccatttcctcaggg

SEQ ID NO: 8152 - DNA, 23 bp, Artificial Sequence
  HLA-A targeting gRNA
tcttctctctagacaattaaggg

SEQ ID NO: 8153 - DNA, 23 bp, Artificial Sequence
  HLA-A targeting gRNA
tcttctctctaggacaattaagg

SEQ ID NO: 8154 - DNA, 23 bp, Artificial Sequence
  HLA-A targeting gRNA
tcttgaagatctgtgtctcccgg

SEQ ID NO: 8155 - DNA, 23 bp, Artificial Sequence
  HLA-A targeting gRNA
tcttgaagatctgtgtgttccgg

SEQ ID NO: 8156 - DNA, 23 bp, Artificial Sequence
  HLA-A targeting gRNA
tcttgaagatctgtgtgttcggg

SEQ ID NO: 8157 - DNA, 23 bp, Artificial Sequence
  HLA-A targeting gRNA
tcttgcagatctgtgtctcccgg

SEQ ID NO: 8158 - DNA, 23 bp, Artificial Sequence
  HLA-A targeting gRNA
tcttgcagatctgtgtgttccgg

SEQ ID NO: 8159 - DNA, 23 bp, Artificial Sequence
  HLA-A targeting gRNA
tcttggagatctctgtctcccgg

SEQ ID NO: 8160 - DNA, 23 bp, Artificial Sequence
  HLA-A targeting gRNA
tcttggagatctgtgtctcccgg

SEQ ID NO: 8161 - DNA, 23 bp, Artificial Sequence
  HLA-A targeting gRNA
tcttggagatctgtgtgttccgg

SEQ ID NO: 8162 - DNA, 23 bp, Artificial Sequence
  HLA-A targeting gRNA
tcttggggtctagagtgggcagg

SEQ ID NO: 8163 - DNA, 23 bp, Artificial Sequence
  HLA-A targeting gRNA
tcttggggtctagagtgggcggg

SEQ ID NO: 8164 - DNA, 23 bp, Artificial Sequence
  HLA-A targeting gRNA
tcttggggtctagagtgggtggg

SEQ ID NO: 8165 - DNA, 23 bp, Artificial Sequence
  HLA-A targeting gRNA
tcttgtagatctgtgtgttccgg

SEQ ID NO: 8166 - DNA, 23 bp, Artificial Sequence
  HLA-A targeting gRNA
tcttgtcccacatctcctgcggg

SEQ ID NO: 8167 - DNA, 23 bp, Artificial Sequence
  HLA-A targeting gRNA
tcttgtcccacatctcctgtggg

SEQ ID NO: 8168 - DNA, 23 bp, Artificial Sequence
  HLA-A targeting gRNA
tgaaaccgggtaaacgcgcctgg

SEQ ID NO: 8169 - DNA, 23 bp, Artificial Sequence
  HLA-A targeting gRNA
tgaaaccgggtaaaggcgactgg

SEQ ID NO: 8170 - DNA, 23 bp, Artificial Sequence
  HLA-A targeting gRNA
tgaaaccgggtaaaggtgactgg

SEQ ID NO: 8171 - DNA, 23 bp, Artificial Sequence
  HLA-A targeting gRNA
tgaaaccgggtaaagtcgcctgg

SEQ ID NO: 8172 - DNA, 23 bp, Artificial Sequence
  HLA-A targeting gRNA
tgaacgaggacctaagctcctgg

SEQ ID NO: 8173 - DNA, 23 bp, Artificial Sequence
  HLA-A targeting gRNA
tgaacgaggacctgagctcccgg

SEQ ID NO: 8174 - DNA, 23 bp, Artificial Sequence
  HLA-A targeting gRNA
tgaacgaggacctgagctcctgg

SEQ ID NO: 8175 - DNA, 23 bp, Artificial Sequence
  HLA-A targeting gRNA
tgaacgaggacctgccctcctgg

SEQ ID NO: 8176 - DNA, 23 bp, Artificial Sequence
  HLA-A targeting gRNA
tgaacgaggatctgcgctcctgg

SEQ ID NO: 8177 - DNA, 23 bp, Artificial Sequence
  HLA-A targeting gRNA
tgaacgaggatctgcgttcctgg

SEQ ID NO: 8178 - DNA, 23 bp, Artificial Sequence
  HLA-A targeting gRNA
tgaagaaatacttcatggagtgg

SEQ ID NO: 8179 - DNA, 23 bp, Artificial Sequence
  HLA-A targeting gRNA
tgaagcacatgtgacaatgaagg

SEQ ID NO: 8180 - DNA, 23 bp, Artificial Sequence
  HLA-A targeting gRNA
tgaagtccctgaggaaatggagg

SEQ ID NO: 8181 - DNA, 23 bp, Artificial Sequence
  HLA-A targeting gRNA
tgaagtccttgaggaaatggagg

SEQ ID NO: 8182 - DNA, 23 bp, Artificial Sequence
  HLA-A targeting gRNA
tgaagtctctgaggaaatggagg

SEQ ID NO: 8183 - DNA, 23 bp, Artificial Sequence
  HLA-A targeting gRNA
tgaatgaggacctgcgctcctgg

SEQ ID NO: 8184 - DNA, 23 bp, Artificial Sequence
  HLA-A targeting gRNA
tgacatctctgaggaaatggagg

SEQ ID NO: 8185 - DNA, 23 bp, Artificial Sequence
  HLA-A targeting gRNA
tgaccaacccgcggggattttgg

SEQ ID NO: 8186 - DNA, 23 bp, Artificial Sequence
  HLA-A targeting gRNA
tgaccacgggggcggggccaggg

SEQ ID NO: 8187 - DNA, 23 bp, Artificial Sequence
  HLA-A targeting gRNA
tgaccagcctgagaatggacagg

SEQ ID NO: 8188 - DNA, 23 bp, Artificial Sequence
  HLA-A targeting gRNA
tgaccagcctgagaatggacggg

SEQ ID NO: 8189 - DNA, 23 bp, Artificial Sequence
  HLA-A targeting gRNA
tgaccagcctgagaatgggcagg

SEQ ID NO: 8190 - DNA, 23 bp, Artificial Sequence
  HLA-A targeting gRNA
tgaccatcctgagaacggacagg

SEQ ID NO: 8191 - DNA, 23 bp, Artificial Sequence
  HLA-A targeting gRNA
tgaccatcctgagaatggacagg

SEQ ID NO: 8192 - DNA, 23 bp, Artificial Sequence
  HLA-A targeting gRNA
tgacccagctgaagggctccagg

SEQ ID NO: 8193 - DNA, 23 bp, Artificial Sequence
  HLA-A targeting gRNA
tgacccgcatctcggcctctggg

SEQ ID NO: 8194 - DNA, 23 bp, Artificial Sequence
  HLA-A targeting gRNA
tgacccgcatctcggcgtctggg

SEQ ID NO: 8195 - DNA, 23 bp, Artificial Sequence
  HLA-A targeting gRNA
tgacccggctgaagggctccagg

SEQ ID NO: 8196 - DNA, 23 bp, Artificial Sequence
  HLA-A targeting gRNA
tgaccgcgagggctgggccaggg

SEQ ID NO: 8197 - DNA, 23 bp, Artificial Sequence
  HLA-A targeting gRNA
tgaccgcggggccggggccaggg

SEQ ID NO: 8198 - DNA, 23 bp, Artificial Sequence
  HLA-A targeting gRNA
tgaccgcggggcctaggccaggg

SEQ ID NO: 8199 - DNA, 23 bp, Artificial Sequence
  HLA-A targeting gRNA
tgaccgcggggcctgggccaggg

SEQ ID NO: 8200 - DNA, 23 bp, Artificial Sequence
  HLA-A targeting gRNA
tgaccgcgggggcggggccaggg

SEQ ID NO: 8201 - DNA, 23 bp, Artificial Sequence
  HLA-A targeting gRNA
tgacctcatggtcagagatgggg

SEQ ID NO: 8202 - DNA, 23 bp, Artificial Sequence
  HLA-A targeting gRNA
tgacctggctgaagggctccagg

SEQ ID NO: 8203 - DNA, 23 bp, Artificial Sequence
  HLA-A targeting gRNA
tgacgtctctgaggaaatggagg

SEQ ID NO: 8204 - DNA, 23 bp, Artificial Sequence
  HLA-A targeting gRNA
tgacgtctctgaggaaatgtagg

SEQ ID NO: 8205 - DNA, 23 bp, Artificial Sequence
  HLA-A targeting gRNA
tgactatcctgagaatggacagg

SEQ ID NO: 8206 - DNA, 23 bp, Artificial Sequence
  HLA-A targeting gRNA
tgactcatgatgctggaatcagg

SEQ ID NO: 8207 - DNA, 23 bp, Artificial Sequence
  HLA-A targeting gRNA
tgactggggacttcagaaccggg

SEQ ID NO: 8208 - DNA, 23 bp, Artificial Sequence
  HLA-A targeting gRNA
tgactggggactttagaaccggg

SEQ ID NO: 8209 - DNA, 23 bp, Artificial Sequence
  HLA-A targeting gRNA
tgactggggactttagaacctgg

SEQ ID NO: 8210 - DNA, 23 bp, Artificial Sequence
  HLA-A targeting gRNA
tgactggtgactttagaaccggg

SEQ ID NO: 8211 - DNA, 23 bp, Artificial Sequence
  HLA-A targeting gRNA
tgactttagaaccgggactgcgg

SEQ ID NO: 8212 - DNA, 23 bp, Artificial Sequence
  HLA-A targeting gRNA
tgagaaccccgcccgggacctgg

SEQ ID NO: 8213 - DNA, 23 bp, Artificial Sequence
  HLA-A targeting gRNA
tgagaacggacaggacacctggg

SEQ ID NO: 8214 - DNA, 23 bp, Artificial Sequence
  HLA-A targeting gRNA
tgagaatggacgggacacctggg

SEQ ID NO: 8215 - DNA, 23 bp, Artificial Sequence
  HLA-A targeting gRNA
tgagaatgggcaggacacctggg

SEQ ID NO: 8216 - DNA, 23 bp, Artificial Sequence
  HLA-A targeting gRNA
tgagagactcatcagagccctgg

SEQ ID NO: 8217 - DNA, 23 bp, Artificial Sequence
  HLA-A targeting gRNA
tgagagccccgcccgggacctgg

SEQ ID NO: 8218 - DNA, 23 bp, Artificial Sequence
  HLA-A targeting gRNA
tgagagccccgcccggggcctgg

SEQ ID NO: 8219 - DNA, 23 bp, Artificial Sequence
  HLA-A targeting gRNA
tgagagccccgtccgggacatgg

SEQ ID NO: 8220 - DNA, 23 bp, Artificial Sequence
  HLA-A targeting gRNA
tgagagccccgtccgggacctgg

SEQ ID NO: 8221 - DNA, 23 bp, Artificial Sequence
  HLA-A targeting gRNA
tgagatccaccccgaggctgcgg

SEQ ID NO: 8222 - DNA, 23 bp, Artificial Sequence
  HLA-A targeting gRNA
tgagatcctccccgaggctgcgg

SEQ ID NO: 8223 - DNA, 23 bp, Artificial Sequence
  HLA-A targeting gRNA
tgagattctgggagctgaagtgg

SEQ ID NO: 8224 - DNA, 23 bp, Artificial Sequence
  HLA-A targeting gRNA
tgagcatgaggcagagaacaagg

SEQ ID NO: 8225 - DNA, 23 bp, Artificial Sequence
  HLA-A targeting gRNA
tgagcgtcaggcagagaacaagg

SEQ ID NO: 8226 - DNA, 23 bp, Artificial Sequence
  HLA-A targeting gRNA
tgagcgtgaggcagagaacaagg

SEQ ID NO: 8227 - DNA, 23 bp, Artificial Sequence
  HLA-A targeting gRNA
tgagctcctggcggacacggcgg

SEQ ID NO: 8228 - DNA, 23 bp, Artificial Sequence
  HLA-A targeting gRNA
tgagcttgtggagaccagaccgg

SEQ ID NO: 8229 - DNA, 23 bp, Artificial Sequence
  HLA-A targeting gRNA
tgaggagccgcgccgggaggagg

SEQ ID NO: 8230 - DNA, 23 bp, Artificial Sequence
  HLA-A targeting gRNA
tgagggcactgggaggaagcagg

SEQ ID NO: 8231 - DNA, 23 bp, Artificial Sequence
  HLA-A targeting gRNA
tgaggggacagggaggaggcagg

SEQ ID NO: 8232 - DNA, 23 bp, Artificial Sequence
  HLA-A targeting gRNA
tgaggggacagggaggagtcagg

SEQ ID NO: 8233 - DNA, 23 bp, Artificial Sequence
  HLA-A targeting gRNA
tgaggggactgggaggaagcagg

SEQ ID NO: 8234 - DNA, 23 bp, Artificial Sequence
  HLA-A targeting gRNA
tgaggggactgggaggaggcagg

SEQ ID NO: 8235 - DNA, 23 bp, Artificial Sequence
  HLA-A targeting gRNA
tgaggggcttcggtaaggagggg

SEQ ID NO: 8236 - DNA, 23 bp, Artificial Sequence
  HLA-A targeting gRNA
tgaggtcaccctgaggtgctggg

SEQ ID NO: 8237 - DNA, 23 bp, Artificial Sequence
  HLA-A targeting gRNA
tgagtatgaggcagagaacaagg

SEQ ID NO: 8238 - DNA, 23 bp, Artificial Sequence
  HLA-A targeting gRNA
tgagtccgggtgggtgactgggg

SEQ ID NO: 8239 - DNA, 23 bp, Artificial Sequence
  HLA-A targeting gRNA
tgagtccgggtgggtgcgtgggg

SEQ ID NO: 8240 - DNA, 23 bp, Artificial Sequence
  HLA-A targeting gRNA
tgagtctctcatcgcttgtaagg

SEQ ID NO: 8241 - DNA, 23 bp, Artificial Sequence
  HLA-A targeting gRNA
tgagtgtgaggcagagaacaagg

SEQ ID NO: 8242 - DNA, 23 bp, Artificial Sequence
  HLA-A targeting gRNA
tgagtgtggggcagagaacaagg

SEQ ID NO: 8243 - DNA, 23 bp, Artificial Sequence
  HLA-A targeting gRNA
tgagttttcttgtcccactgggg

SEQ ID NO: 8244 - DNA, 23 bp, Artificial Sequence
  HLA-A targeting gRNA
tgatgaagcggggctccccgcgg

SEQ ID NO: 8245 - DNA, 23 bp, Artificial Sequence
  HLA-A targeting gRNA
tgatgccggtgggcgtgtggagg

SEQ ID NO: 8246 - DNA, 23 bp, Artificial Sequence
  HLA-A targeting gRNA
tgatggcagtgggcgtgtggagg

SEQ ID NO: 8247 - DNA, 23 bp, Artificial Sequence
  HLA-A targeting gRNA
tgatggcggcaggcgtgtggagg

SEQ ID NO: 8248 - DNA, 23 bp, Artificial Sequence
  HLA-A targeting gRNA
tgatggcggcgggcgtgtggagg

SEQ ID NO: 8249 - DNA, 23 bp, Artificial Sequence
  HLA-A targeting gRNA
tgatggcggtggccgtgtggagg

SEQ ID NO: 8250 - DNA, 23 bp, Artificial Sequence
  HLA-A targeting gRNA
tgatggcggtgggcgtgtggagg

SEQ ID NO: 8251 - DNA, 23 bp, Artificial Sequence
  HLA-A targeting gRNA
tgatggctgttgtgatgtgtagg

SEQ ID NO: 8252 - DNA, 23 bp, Artificial Sequence
  HLA-A targeting gRNA
tgatgggggcgggagtgtgaagg

SEQ ID NO: 8253 - DNA, 23 bp, Artificial Sequence
  HLA-A targeting gRNA
tgatgggggcgggagtgtggagg

SEQ ID NO: 8254 - DNA, 23 bp, Artificial Sequence
  HLA-A targeting gRNA
tgatgggggtgggagtgtgaagg

SEQ ID NO: 8255 - DNA, 23 bp, Artificial Sequence
  HLA-A targeting gRNA
tgatgggggtgggagtgtggagg

SEQ ID NO: 8256 - DNA, 23 bp, Artificial Sequence
  HLA-A targeting gRNA
tgattccagcatcatgagtcagg

SEQ ID NO: 8257 - DNA, 23 bp, Artificial Sequence
  HLA-A targeting gRNA
tgattccagcattcatgagtcgg

SEQ ID NO: 8258 - DNA, 23 bp, Artificial Sequence
  HLA-A targeting gRNA
tgcagcacatgtgacaatgaagg

SEQ ID NO: 8259 - DNA, 23 bp, Artificial Sequence
  HLA-A targeting gRNA
tgcagccacacatccactggagg

SEQ ID NO: 8260 - DNA, 23 bp, Artificial Sequence
  HLA-A targeting gRNA
tgcagggaacacttctacctggg

SEQ ID NO: 8261 - DNA, 23 bp, Artificial Sequence
  HLA-A targeting gRNA
tgcatcccagtaatgaggcaggg

SEQ ID NO: 8262 - DNA, 23 bp, Artificial Sequence
  HLA-A targeting gRNA
tgcatgtaagtgatggcggtggg

SEQ ID NO: 8263 - DNA, 23 bp, Artificial Sequence
  HLA-A targeting gRNA
tgccattctccattcaacggagg

SEQ ID NO: 8264 - DNA, 23 bp, Artificial Sequence
  HLA-A targeting gRNA
tgccattctccattcaagggagg

SEQ ID NO: 8265 - DNA, 23 bp, Artificial Sequence
  HLA-A targeting gRNA
tgccccacactcagtgtttgggg

SEQ ID NO: 8266 - DNA, 23 bp, Artificial Sequence
  HLA-A targeting gRNA
tgcccgcccggcgagggcgcagg

SEQ ID NO: 8267 - DNA, 23 bp, Artificial Sequence
  HLA-A targeting gRNA
tgccctatgaggggactgggagg

SEQ ID NO: 8268 - DNA, 23 bp, Artificial Sequence
  HLA-A targeting gRNA
tgccctgtgaggggacagggagg

SEQ ID NO: 8269 - DNA, 23 bp, Artificial Sequence
  HLA-A targeting gRNA
tgccctgtgaggggactgggagg

SEQ ID NO: 8270 - DNA, 23 bp, Artificial Sequence
  HLA-A targeting gRNA
tgccgtcgtaggcgtcctggtgg

SEQ ID NO: 8271 - DNA, 23 bp, Artificial Sequence
  HLA-A targeting gRNA
tgcctcacactcagtgtgtttgg

SEQ ID NO: 8272 - DNA, 23 bp, Artificial Sequence
  HLA-A targeting gRNA
tgcctgcatccgctggtgtctgg

SEQ ID NO: 8273 - DNA, 23 bp, Artificial Sequence
  HLA-A targeting gRNA
tgcctgcgtccgctggtgtctgg

SEQ ID NO: 8274 - DNA, 23 bp, Artificial Sequence
  HLA-A targeting gRNA
tgcggagccactccacacacagg

SEQ ID NO: 8275 - DNA, 23 bp, Artificial Sequence
  HLA-A targeting gRNA
tgcggagccactcctcgcacagg

SEQ ID NO: 8276 - DNA, 23 bp, Artificial Sequence
  HLA-A targeting gRNA
tgcggagcgaccccacgcacagg

SEQ ID NO: 8277 - DNA, 23 bp, Artificial Sequence
  HLA-A targeting gRNA
tgcggagcgactccacgcacagg

SEQ ID NO: 8278 - DNA, 23 bp, Artificial Sequence
  HLA-A targeting gRNA
tgcggtcccctcgctcctcccgg

SEQ ID NO: 8279 - DNA, 23 bp, Artificial Sequence
  HLA-A targeting gRNA
tgcgtccagcgacagtgcccagg

SEQ ID NO: 8280 - DNA, 23 bp, Artificial Sequence
  HLA-A targeting gRNA
tgcgtggggactttagaactggg

SEQ ID NO: 8281 - DNA, 23 bp, Artificial Sequence
  HLA-A targeting gRNA
tgcgtgtaaatgatggcggcggg

SEQ ID NO: 8282 - DNA, 23 bp, Artificial Sequence
  HLA-A targeting gRNA
tgcgtgtaagtgatgccggtggg

SEQ ID NO: 8283 - DNA, 23 bp, Artificial Sequence
  HLA-A targeting gRNA
tgcgtgtaagtgatggcagtggg

SEQ ID NO: 8284 - DNA, 23 bp, Artificial Sequence
  HLA-A targeting gRNA
tgcgtgtaagtgatggcggcagg

SEQ ID NO: 8285 - DNA, 23 bp, Artificial Sequence
  HLA-A targeting gRNA
tgcgtgtaagtgatggcggcggg

SEQ ID NO: 8286 - DNA, 23 bp, Artificial Sequence
  HLA-A targeting gRNA
tgcgtgtaagtgatggcggtggg

SEQ ID NO: 8287 - DNA, 23 bp, Artificial Sequence
  HLA-A targeting gRNA
tgcgtgtaagtgatgggggcggg

SEQ ID NO: 8288 - DNA, 23 bp, Artificial Sequence
  HLA-A targeting gRNA
tgcgtgtaagtgatgggggtggg

SEQ ID NO: 8289 - DNA, 23 bp, Artificial Sequence
  HLA-A targeting gRNA
tgcgtgtaagtggtgggggtggg

SEQ ID NO: 8290 - DNA, 23 bp, Artificial Sequence
  HLA-A targeting gRNA
tgctaaggacagaccttaggagg

SEQ ID NO: 8291 - DNA, 23 bp, Artificial Sequence
  HLA-A targeting gRNA
tgctccacccacggcgcccgcgg

SEQ ID NO: 8292 - DNA, 23 bp, Artificial Sequence
  HLA-A targeting gRNA
tgctccacccacggcgcccgggg

SEQ ID NO: 8293 - DNA, 23 bp, Artificial Sequence
  HLA-A targeting gRNA
tgctccacccacggcgcctgcgg

SEQ ID NO: 8294 - DNA, 23 bp, Artificial Sequence
  HLA-A targeting gRNA
tgctccacccacggctcccgcgg

SEQ ID NO: 8295 - DNA, 23 bp, Artificial Sequence
  HLA-A targeting gRNA
tgctccatccacggctcccgcgg

SEQ ID NO: 8296 - DNA, 23 bp, Artificial Sequence
  HLA-A targeting gRNA
tgctctatccaccgcgcccgcgg

SEQ ID NO: 8297 - DNA, 23 bp, Artificial Sequence
  HLA-A targeting gRNA
tgctctatccacggcgcccgggg

SEQ ID NO: 8298 - DNA, 23 bp, Artificial Sequence
  HLA-A targeting gRNA
tgctctatccagggcgcccgcgg

SEQ ID NO: 8299 - DNA, 23 bp, Artificial Sequence
  HLA-A targeting gRNA
tgctctatccatggcgcccaggg

SEQ ID NO: 8300 - DNA, 23 bp, Artificial Sequence
  HLA-A targeting gRNA
tgctctatccatggcgcccgcgg

SEQ ID NO: 8301 - DNA, 23 bp, Artificial Sequence
  HLA-A targeting gRNA
tgctctatccatggcgcccgggg

SEQ ID NO: 8302 - DNA, 23 bp, Artificial Sequence
  HLA-A targeting gRNA
tgctctatccatggctcccgggg

SEQ ID NO: 8303 - DNA, 23 bp, Artificial Sequence
  HLA-A targeting gRNA
tgctggcctggctgtccttgtgg

SEQ ID NO: 8304 - DNA, 23 bp, Artificial Sequence
  HLA-A targeting gRNA
tgcttcccagtaatgaggcaggg

SEQ ID NO: 8305 - DNA, 23 bp, Artificial Sequence
  HLA-A targeting gRNA
tgcttcccagtaatgatgcaggg

SEQ ID NO: 8306 - DNA, 23 bp, Artificial Sequence
  HLA-A targeting gRNA
tggaaagttctagtctctgaggg

SEQ ID NO: 8307 - DNA, 23 bp, Artificial Sequence
  HLA-A targeting gRNA
tggaagaagaagtgaaactcagg

SEQ ID NO: 8308 - DNA, 23 bp, Artificial Sequence
  HLA-A targeting gRNA
tggaagcaccatccacacatggg

SEQ ID NO: 8309 - DNA, 23 bp, Artificial Sequence
  HLA-A targeting gRNA
tggaagcaccatccacacctggg

SEQ ID NO: 8310 - DNA, 23 bp, Artificial Sequence
  HLA-A targeting gRNA
tggaagcaccatccacacgtggg

SEQ ID NO: 8311 - DNA, 23 bp, Artificial Sequence
  HLA-A targeting gRNA
tggaagcctgggggcgaggaggg

SEQ ID NO: 8312 - DNA, 23 bp, Artificial Sequence
  HLA-A targeting gRNA
tggaaggttccatctcctgctgg

SEQ ID NO: 8313 - DNA, 23 bp, Artificial Sequence
  HLA-A targeting gRNA
tggaaggttctatctcctgcagg

SEQ ID NO: 8314 - DNA, 23 bp, Artificial Sequence
  HLA-A targeting gRNA
tggaaggttctatctcctgccgg

SEQ ID NO: 8315 - DNA, 23 bp, Artificial Sequence
  HLA-A targeting gRNA
tggaaggttctatctcctgctgg

SEQ ID NO: 8316 - DNA, 23 bp, Artificial Sequence
  HLA-A targeting gRNA
tggaaggttctgtctcctgctgg

SEQ ID NO: 8317 - DNA, 23 bp, Artificial Sequence
  HLA-A targeting gRNA
tggacaggacacctggggtaggg

SEQ ID NO: 8318 - DNA, 23 bp, Artificial Sequence
  HLA-A targeting gRNA
tggacaggacacctggggtgggg

SEQ ID NO: 8319 - DNA, 23 bp, Artificial Sequence
  HLA-A targeting gRNA
tggacaggacacctggtgtgggg

SEQ ID NO: 8320 - DNA, 23 bp, Artificial Sequence
  HLA-A targeting gRNA
tggaccggtgagtgcggggttgg

SEQ ID NO: 8321 - DNA, 23 bp, Artificial Sequence
  HLA-A targeting gRNA
tggacgacaagcagttcgtgagg

SEQ ID NO: 8322 - DNA, 23 bp, Artificial Sequence
  HLA-A targeting gRNA
tggacgacacccagttcgtgagg

SEQ ID NO: 8323 - DNA, 23 bp, Artificial Sequence
  HLA-A targeting gRNA
tggacgacacgcacttcgtgcgg

SEQ ID NO: 8324 - DNA, 23 bp, Artificial Sequence
  HLA-A targeting gRNA
tggacgacacgcagttcatgagg

SEQ ID NO: 8325 - DNA, 23 bp, Artificial Sequence
  HLA-A targeting gRNA
tggacgacacgcagttcgcgcgg

SEQ ID NO: 8326 - DNA, 23 bp, Artificial Sequence
  HLA-A targeting gRNA
tggacgacacgcagttcgtgagg

SEQ ID NO: 8327 - DNA, 23 bp, Artificial Sequence
  HLA-A targeting gRNA
tggacgacacgcagtttgtgcgg

SEQ ID NO: 8328 - DNA, 23 bp, Artificial Sequence
  HLA-A targeting gRNA
tggacgacacgctgttcatgagg

SEQ ID NO: 8329 - DNA, 23 bp, Artificial Sequence
  HLA-A targeting gRNA
tggacgacacgctgttcgtgagg

SEQ ID NO: 8330 - DNA, 23 bp, Artificial Sequence
  HLA-A targeting gRNA
tggacgacacgctgttggtgagg

SEQ ID NO: 8331 - DNA, 23 bp, Artificial Sequence
  HLA-A targeting gRNA
tggacgaggacctgcgctcctgg

SEQ ID NO: 8332 - DNA, 23 bp, Artificial Sequence
  HLA-A targeting gRNA
tggacgatacgcagttcgtgcgg

SEQ ID NO: 8333 - DNA, 23 bp, Artificial Sequence
  HLA-A targeting gRNA
tggacggcacccagttcgtgagg

SEQ ID NO: 8334 - DNA, 23 bp, Artificial Sequence
  HLA-A targeting gRNA
tggacgggacacctggggtgggg

SEQ ID NO: 8335 - DNA, 23 bp, Artificial Sequence
  HLA-A targeting gRNA
tggactacacgcagttcgtgcgg

SEQ ID NO: 8336 - DNA, 23 bp, Artificial Sequence
  HLA-A targeting gRNA
tggactgcggagacgctgattgg

SEQ ID NO: 8337 - DNA, 23 bp, Artificial Sequence
  HLA-A targeting gRNA
tggactgggaagacggctccggg

SEQ ID NO: 8338 - DNA, 23 bp, Artificial Sequence
  HLA-A targeting gRNA
tggactgggaagacggctctggg

SEQ ID NO: 8339 - DNA, 23 bp, Artificial Sequence
  HLA-A targeting gRNA
tggactgggaagatggctctggg

SEQ ID NO: 8340 - DNA, 23 bp, Artificial Sequence
  HLA-A targeting gRNA
tggagaaacacctcatggagtgg

SEQ ID NO: 8341 - DNA, 23 bp, Artificial Sequence
  HLA-A targeting gRNA
tggagaaatacgtcatggagtgg

SEQ ID NO: 8342 - DNA, 23 bp, Artificial Sequence
  HLA-A targeting gRNA
tggagcccctcaccctgagatgg

SEQ ID NO: 8343 - DNA, 23 bp, Artificial Sequence
  HLA-A targeting gRNA
tggagcccttcagcagggtcagg

SEQ ID NO: 8344 - DNA, 23 bp, Artificial Sequence
  HLA-A targeting gRNA
tggagcccttcagcagggtcggg

SEQ ID NO: 8345 - DNA, 23 bp, Artificial Sequence
  HLA-A targeting gRNA
tggagcccttcagccaggtcagg

SEQ ID NO: 8346 - DNA, 23 bp, Artificial Sequence
  HLA-A targeting gRNA
tggagcccttcagccgggtcagg

SEQ ID NO: 8347 - DNA, 23 bp, Artificial Sequence
  HLA-A targeting gRNA
tggagcccttcagctgggtcagg

SEQ ID NO: 8348 - DNA, 23 bp, Artificial Sequence
  HLA-A targeting gRNA
tggaggacacgtgcgtggagtgg

SEQ ID NO: 8349 - DNA, 23 bp, Artificial Sequence
  HLA-A targeting gRNA
tggaggaggggccggagtattgg

SEQ ID NO: 8350 - DNA, 23 bp, Artificial Sequence
  HLA-A targeting gRNA
tggagggaacgtgcgtggagtgg

SEQ ID NO: 8351 - DNA, 23 bp, Artificial Sequence
  HLA-A targeting gRNA
tggagggcaagtgcgtggagtgg

SEQ ID NO: 8352 - DNA, 23 bp, Artificial Sequence
  HLA-A targeting gRNA
tggagggcacgcgcgtggagtgg

SEQ ID NO: 8353 - DNA, 23 bp, Artificial Sequence
  HLA-A targeting gRNA
tggagggcacgtacgtggagtgg

SEQ ID NO: 8354 - DNA, 23 bp, Artificial Sequence
  HLA-A targeting gRNA
tggagggcacgtgagtggagtgg

SEQ ID NO: 8355 - DNA, 23 bp, Artificial Sequence
  HLA-A targeting gRNA
tggagggcacgtgcatggagtgg

SEQ ID NO: 8356 - DNA, 23 bp, Artificial Sequence
  HLA-A targeting gRNA
tggagggcacgtgtgtggagtgg

SEQ ID NO: 8357 - DNA, 23 bp, Artificial Sequence
  HLA-A targeting gRNA
tggagggcacgttcgtggagtgg

SEQ ID NO: 8358 - DNA, 23 bp, Artificial Sequence
  HLA-A targeting gRNA
tggagggcctgtgcgaggagtgg

SEQ ID NO: 8359 - DNA, 23 bp, Artificial Sequence
  HLA-A targeting gRNA
tggagggcctgtgtgtggagtgg

SEQ ID NO: 8360 - DNA, 23 bp, Artificial Sequence
  HLA-A targeting gRNA
tggagggcgagtgcgtggagtgg

SEQ ID NO: 8361 - DNA, 23 bp, Artificial Sequence
  HLA-A targeting gRNA
tggaggggaagacagtccctagg

SEQ ID NO: 8362 - DNA, 23 bp, Artificial Sequence
  HLA-A targeting gRNA
tggagtaaggagggggatgaggg

SEQ ID NO: 8363 - DNA, 23 bp, Artificial Sequence
  HLA-A targeting gRNA
tggagtgggagcctggggcaagg

SEQ ID NO: 8364 - DNA, 23 bp, Artificial Sequence
  HLA-A targeting gRNA
tggatgtacggctgcgacctggg

SEQ ID NO: 8365 - DNA, 23 bp, Artificial Sequence
  HLA-A targeting gRNA
tggatgtatggctgcgacctggg

SEQ ID NO: 8366 - DNA, 23 bp, Artificial Sequence
  HLA-A targeting gRNA
tggatgtatggctgcgacgtggg

SEQ ID NO: 8367 - DNA, 23 bp, Artificial Sequence
  HLA-A targeting gRNA
tggatgtgagaccctggccccgg

SEQ ID NO: 8368 - DNA, 23 bp, Artificial Sequence
  HLA-A targeting gRNA
tggatgtgtggctgcaacctggg

SEQ ID NO: 8369 - DNA, 23 bp, Artificial Sequence
  HLA-A targeting gRNA
tggatgtgtggctgcgacctggg

SEQ ID NO: 8370 - DNA, 23 bp, Artificial Sequence
  HLA-A targeting gRNA
tggatgtttggctgcgacctggg

SEQ ID NO: 8371 - DNA, 23 bp, Artificial Sequence
  HLA-A targeting gRNA
tggatgtttggctgcgaccttgg

SEQ ID NO: 8372 - DNA, 23 bp, Artificial Sequence
  HLA-A targeting gRNA
tggattgggaagatggctctggg

SEQ ID NO: 8373 - DNA, 23 bp, Artificial Sequence
  HLA-A targeting gRNA
tggcacacagggtcccaggctgg

SEQ ID NO: 8374 - DNA, 23 bp, Artificial Sequence
  HLA-A targeting gRNA
tggcaggtctgggggtgggtggg

SEQ ID NO: 8375 - DNA, 23 bp, Artificial Sequence
  HLA-A targeting gRNA
tggccgcggggccggggccaggg

SEQ ID NO: 8376 - DNA, 23 bp, Artificial Sequence
  HLA-A targeting gRNA
tggcctcatggtcagagacgggg

SEQ ID NO: 8377 - DNA, 23 bp, Artificial Sequence
  HLA-A targeting gRNA
tggcctcatggtcagagaggggg

SEQ ID NO: 8378 - DNA, 23 bp, Artificial Sequence
  HLA-A targeting gRNA
tggcctccaacgagaagaagagg

SEQ ID NO: 8379 - DNA, 23 bp, Artificial Sequence
  HLA-A targeting gRNA
tggcctcccacgagaagaagagg

SEQ ID NO: 8380 - DNA, 23 bp, Artificial Sequence
  HLA-A targeting gRNA
tggcctcccacgagaagaggagg

SEQ ID NO: 8381 - DNA, 23 bp, Artificial Sequence
  HLA-A targeting gRNA
tggcctcccacgaggaagggagg

SEQ ID NO: 8382 - DNA, 23 bp, Artificial Sequence
  HLA-A targeting gRNA
tggcctcccacgaggaggggagg

SEQ ID NO: 8383 - DNA, 23 bp, Artificial Sequence
  HLA-A targeting gRNA
tggcctggtctccacaagctcgg

SEQ ID NO: 8384 - DNA, 23 bp, Artificial Sequence
  HLA-A targeting gRNA
tggcctggtctccacaagctggg

SEQ ID NO: 8385 - DNA, 23 bp, Artificial Sequence
  HLA-A targeting gRNA
tggccttccacgaggaggggagg

SEQ ID NO: 8386 - DNA, 23 bp, Artificial Sequence
  HLA-A targeting gRNA
tggcgggtctcagcccctcctgg

SEQ ID NO: 8387 - DNA, 23 bp, Artificial Sequence
  HLA-A targeting gRNA
tggcgggtctggggcggggtggg

SEQ ID NO: 8388 - DNA, 23 bp, Artificial Sequence
  HLA-A targeting gRNA
tggcgggtctggggggggggggg

SEQ ID NO: 8389 - DNA, 23 bp, Artificial Sequence
  HLA-A targeting gRNA
tggcgggtctgggggtgggtggg

SEQ ID NO: 8390 - DNA, 23 bp, Artificial Sequence
  HLA-A targeting gRNA
tggcgtctctgaggaaatggagg

SEQ ID NO: 8391 - DNA, 23 bp, Artificial Sequence
  HLA-A targeting gRNA
tggctactacaaccagagcgagg

SEQ ID NO: 8392 - DNA, 23 bp, Artificial Sequence
  HLA-A targeting gRNA
tggctcccatctcagggtgaggg

SEQ ID NO: 8393 - DNA, 23 bp, Artificial Sequence
  HLA-A targeting gRNA
tggctgttgtgatgtgtaggagg

SEQ ID NO: 8394 - DNA, 23 bp, Artificial Sequence
  HLA-A targeting gRNA
tggctgttgttatgtgtaggagg

SEQ ID NO: 8395 - DNA, 23 bp, Artificial Sequence
  HLA-A targeting gRNA
tgggaaaagaggagaaggtgagg

SEQ ID NO: 8396 - DNA, 23 bp, Artificial Sequence
  HLA-A targeting gRNA
tgggaaaggaagggaagatgagg

SEQ ID NO: 8397 - DNA, 23 bp, Artificial Sequence
  HLA-A targeting gRNA
tgggaaaggaggagaaggtgagg

SEQ ID NO: 8398 - DNA, 23 bp, Artificial Sequence
  HLA-A targeting gRNA
tgggaaaggaggggaagacgagg

SEQ ID NO: 8399 - DNA, 23 bp, Artificial Sequence
  HLA-A targeting gRNA
tgggaaaggaggggaagatgagg

SEQ ID NO: 8400 - DNA, 23 bp, Artificial Sequence
  HLA-A targeting gRNA
tgggaaaggaggggaaggtgagg

SEQ ID NO: 8401 - DNA, 23 bp, Artificial Sequence
  HLA-A targeting gRNA
tgggaacctgggggcgaggaggg

SEQ ID NO: 8402 - DNA, 23 bp, Artificial Sequence
  HLA-A targeting gRNA
tgggaagaaaatgccctatgagg

SEQ ID NO: 8403 - DNA, 23 bp, Artificial Sequence
  HLA-A targeting gRNA
tgggaagaaaatgccctgtgagg

SEQ ID NO: 8404 - DNA, 23 bp, Artificial Sequence
  HLA-A targeting gRNA
tgggaagaaaatgtcctgtgagg

SEQ ID NO: 8405 - DNA, 23 bp, Artificial Sequence
  HLA-A targeting gRNA
tgggaagacggctccgggaaagg

SEQ ID NO: 8406 - DNA, 23 bp, Artificial Sequence
  HLA-A targeting gRNA
tgggaagacggctctgggaaagg

SEQ ID NO: 8407 - DNA, 23 bp, Artificial Sequence
  HLA-A targeting gRNA
tgggaagagtcagaaaattcagg

SEQ ID NO: 8408 - DNA, 23 bp, Artificial Sequence
  HLA-A targeting gRNA
tgggaagatggccctgggaaagg

SEQ ID NO: 8409 - DNA, 23 bp, Artificial Sequence
  HLA-A targeting gRNA
tgggaagatggctctgggaaagg

SEQ ID NO: 8410 - DNA, 23 bp, Artificial Sequence
  HLA-A targeting gRNA
tgggaagcaaatgtcctgtgagg

SEQ ID NO: 8411 - DNA, 23 bp, Artificial Sequence
  HLA-A targeting gRNA
tgggaagcagcatccacacaggg

SEQ ID NO: 8412 - DNA, 23 bp, Artificial Sequence
  HLA-A targeting gRNA
tgggaagcagcatcctcacaggg

SEQ ID NO: 8413 - DNA, 23 bp, Artificial Sequence
  HLA-A targeting gRNA
tgggaagcagcatgcacacaggg

SEQ ID NO: 8414 - DNA, 23 bp, Artificial Sequence
  HLA-A targeting gRNA
tgggagaagaagtgaaactcagg

SEQ ID NO: 8415 - DNA, 23 bp, Artificial Sequence
  HLA-A targeting gRNA
tgggagactgggggcgaggaggg

SEQ ID NO: 8416 - DNA, 23 bp, Artificial Sequence
  HLA-A targeting gRNA
tgggagactgggggtgaggaggg

SEQ ID NO: 8417 - DNA, 23 bp, Artificial Sequence
  HLA-A targeting gRNA
tgggagcctgggagcgaggaggg

SEQ ID NO: 8418 - DNA, 23 bp, Artificial Sequence
  HLA-A targeting gRNA
tgggagcctggggcaaggagggg

SEQ ID NO: 8419 - DNA, 23 bp, Artificial Sequence
  HLA-A targeting gRNA
tgggagcctgggggagaggaggg

SEQ ID NO: 8420 - DNA, 23 bp, Artificial Sequence
  HLA-A targeting gRNA
tgggagcctgggggccaggaggg

SEQ ID NO: 8421 - DNA, 23 bp, Artificial Sequence
  HLA-A targeting gRNA
tgggagcctgggggcgaggaggg

SEQ ID NO: 8422 - DNA, 23 bp, Artificial Sequence
  HLA-A targeting gRNA
tgggagcctgggggtgaggaggg

SEQ ID NO: 8423 - DNA, 23 bp, Artificial Sequence
  HLA-A targeting gRNA
tgggaggctgggggcgaggaggg

SEQ ID NO: 8424 - DNA, 23 bp, Artificial Sequence
  HLA-A targeting gRNA
tgggagggaaacggcctctgcgg

SEQ ID NO: 8425 - DNA, 23 bp, Artificial Sequence
  HLA-A targeting gRNA
tgggagggaaacggcctctgggg

SEQ ID NO: 8426 - DNA, 23 bp, Artificial Sequence
  HLA-A targeting gRNA
tgggagggaagcggcctctatgg

SEQ ID NO: 8427 - DNA, 23 bp, Artificial Sequence
  HLA-A targeting gRNA
tgggagggaagcggcctctgcgg

SEQ ID NO: 8428 - DNA, 23 bp, Artificial Sequence
  HLA-A targeting gRNA
tgggagggaatcggcctctgcgg

SEQ ID NO: 8429 - DNA, 23 bp, Artificial Sequence
  HLA-A targeting gRNA
tgggataatctcctattcattgg

SEQ ID NO: 8430 - DNA, 23 bp, Artificial Sequence
  HLA-A targeting gRNA
tgggataatctcctattctttgg

SEQ ID NO: 8431 - DNA, 23 bp, Artificial Sequence
  HLA-A targeting gRNA
tgggatgcagcatccacacaggg

SEQ ID NO: 8432 - DNA, 23 bp, Artificial Sequence
  HLA-A targeting gRNA
tgggatggcccacgtgtggatgg

SEQ ID NO: 8433 - DNA, 23 bp, Artificial Sequence
  HLA-A targeting gRNA
tgggatggcccaggtgtggatgg

SEQ ID NO: 8434 - DNA, 23 bp, Artificial Sequence
  HLA-A targeting gRNA
tgggatggcccatgtgtggatgg

SEQ ID NO: 8435 - DNA, 23 bp, Artificial Sequence
  HLA-A targeting gRNA
tgggcaggacacctggggtgggg

SEQ ID NO: 8436 - DNA, 23 bp, Artificial Sequence
  HLA-A targeting gRNA
tgggccctgggcttctaccctgg

SEQ ID NO: 8437 - DNA, 23 bp, Artificial Sequence
  HLA-A targeting gRNA
tgggccggtgagtgcgggatcgg

SEQ ID NO: 8438 - DNA, 23 bp, Artificial Sequence
  HLA-A targeting gRNA
tgggccggtgagtgcggggtcgg

SEQ ID NO: 8439 - DNA, 23 bp, Artificial Sequence
  HLA-A targeting gRNA
tgggccggtgagtgcggggttgg

SEQ ID NO: 8440 - DNA, 23 bp, Artificial Sequence
  HLA-A targeting gRNA
tgggccggtgagtgcgggtcggg

SEQ ID NO: 8441 - DNA, 23 bp, Artificial Sequence
  HLA-A targeting gRNA
tgggcctgtgagtgcgaggttgg

SEQ ID NO: 8442 - DNA, 23 bp, Artificial Sequence
  HLA-A targeting gRNA
tgggcctgtgagtgcggggttgg

SEQ ID NO: 8443 - DNA, 23 bp, Artificial Sequence
  HLA-A targeting gRNA
tgggcgacccgggccgtccgtgg

SEQ ID NO: 8444 - DNA, 23 bp, Artificial Sequence
  HLA-A targeting gRNA
tgggcggattccgcagcctcggg

SEQ ID NO: 8445 - DNA, 23 bp, Artificial Sequence
  HLA-A targeting gRNA
tgggcgggggggcggggaggggg

SEQ ID NO: 8446 - DNA, 23 bp, Artificial Sequence
  HLA-A targeting gRNA
tgggcggggggggcggggagggg

SEQ ID NO: 8447 - DNA, 23 bp, Artificial Sequence
  HLA-A targeting gRNA
tgggcggggggggggtggggtgg

SEQ ID NO: 8448 - DNA, 23 bp, Artificial Sequence
  HLA-A targeting gRNA
tgggcgggggggggtggggtggg

SEQ ID NO: 8449 - DNA, 23 bp, Artificial Sequence
  HLA-A targeting gRNA
tgggcggggggggtggggtgggg

SEQ ID NO: 8450 - DNA, 23 bp, Artificial Sequence
  HLA-A targeting gRNA
tgggcgggtcccgcggcctcagg

SEQ ID NO: 8451 - DNA, 23 bp, Artificial Sequence
  HLA-A targeting gRNA
tgggcgggtcccgcggcctcggg

SEQ ID NO: 8452 - DNA, 23 bp, Artificial Sequence
  HLA-A targeting gRNA
tgggcgggttccgcagcctcggg

SEQ ID NO: 8453 - DNA, 23 bp, Artificial Sequence
  HLA-A targeting gRNA
tgggctgggaagatggccctggg

SEQ ID NO: 8454 - DNA, 23 bp, Artificial Sequence
  HLA-A targeting gRNA
tgggctggtgagtgcggggtcgg

SEQ ID NO: 8455 - DNA, 23 bp, Artificial Sequence
  HLA-A targeting gRNA
tggggagctgaagtggtcggggg

SEQ ID NO: 8456 - DNA, 23 bp, Artificial Sequence
  HLA-A targeting gRNA
tggggagctgaagtggtctgggg

SEQ ID NO: 8457 - DNA, 23 bp, Artificial Sequence
  HLA-A targeting gRNA
tggggcagagggaaaaggcctgg

SEQ ID NO: 8458 - DNA, 23 bp, Artificial Sequence
  HLA-A targeting gRNA
tggggcagaggggaaaggcctgg

SEQ ID NO: 8459 - DNA, 23 bp, Artificial Sequence
  HLA-A targeting gRNA
tggggcagtggggaaaggcctgg

SEQ ID NO: 8460 - DNA, 23 bp, Artificial Sequence
  HLA-A targeting gRNA
tggggcggggctcgcgggacggg

SEQ ID NO: 8461 - DNA, 23 bp, Artificial Sequence
  HLA-A targeting gRNA
tggggcggggctcgggggaccgg

SEQ ID NO: 8462 - DNA, 23 bp, Artificial Sequence
  HLA-A targeting gRNA
tggggcggggctcgggggacggg

SEQ ID NO: 8463 - DNA, 23 bp, Artificial Sequence
  HLA-A targeting gRNA
tggggcggggtggggcagagggg

SEQ ID NO: 8464 - DNA, 23 bp, Artificial Sequence
  HLA-A targeting gRNA
tggggcggggttcgggggacggg

SEQ ID NO: 8465 - DNA, 23 bp, Artificial Sequence
  HLA-A targeting gRNA
tggggcttgaaacccccagtggg

SEQ ID NO: 8466 - DNA, 23 bp, Artificial Sequence
  HLA-A targeting gRNA
tggggcttgaaactcccagtggg

SEQ ID NO: 8467 - DNA, 23 bp, Artificial Sequence
  HLA-A targeting gRNA
tggggggggggggggcagagggg

SEQ ID NO: 8468 - DNA, 23 bp, Artificial Sequence
  HLA-A targeting gRNA
tgggggtggcgggtctggggcgg

SEQ ID NO: 8469 - DNA, 23 bp, Artificial Sequence
  HLA-A targeting gRNA
tgggggtgggtggggcagagggg

SEQ ID NO: 8470 - DNA, 23 bp, Artificial Sequence
  HLA-A targeting gRNA
tgggggtgggtggggcagtgggg

SEQ ID NO: 8471 - DNA, 23 bp, Artificial Sequence
  HLA-A targeting gRNA
tggggtaaggaggggaatggggg

SEQ ID NO: 8472 - DNA, 23 bp, Artificial Sequence
  HLA-A targeting gRNA
tggggtaaggagggggatgaggg

SEQ ID NO: 8473 - DNA, 23 bp, Artificial Sequence
  HLA-A targeting gRNA
tggggtctagagtgggcaggggg

SEQ ID NO: 8474 - DNA, 23 bp, Artificial Sequence
  HLA-A targeting gRNA
tggggtctagagtgggcgggggg

SEQ ID NO: 8475 - DNA, 23 bp, Artificial Sequence
  HLA-A targeting gRNA
tggggtggcaggtctgggggtgg

SEQ ID NO: 8476 - DNA, 23 bp, Artificial Sequence
  HLA-A targeting gRNA
tggggtggcgggtctgggggggg

SEQ ID NO: 8477 - DNA, 23 bp, Artificial Sequence
  HLA-A targeting gRNA
tggggtggcgggtctgggggtgg

SEQ ID NO: 8478 - DNA, 23 bp, Artificial Sequence
  HLA-A targeting gRNA
tggggtggggagggggcagaggg

SEQ ID NO: 8479 - DNA, 23 bp, Artificial Sequence
  HLA-A targeting gRNA
tggggtggggcagagggaaaagg

SEQ ID NO: 8480 - DNA, 23 bp, Artificial Sequence
  HLA-A targeting gRNA
tgggtcacatgtgtctttggggg

SEQ ID NO: 8481 - DNA, 23 bp, Artificial Sequence
  HLA-A targeting gRNA
tgggtcacgtgtgtctttgcggg

SEQ ID NO: 8482 - DNA, 23 bp, Artificial Sequence
  HLA-A targeting gRNA
tgggtcacgtgtgtctttggggg

SEQ ID NO: 8483 - DNA, 23 bp, Artificial Sequence
  HLA-A targeting gRNA
tgggtcagggctgaggcttgggg

SEQ ID NO: 8484 - DNA, 23 bp, Artificial Sequence
  HLA-A targeting gRNA
tgggtctgcagtcatagttctgg

SEQ ID NO: 8485 - DNA, 23 bp, Artificial Sequence
  HLA-A targeting gRNA
tgggtctgcagtcgtagttctgg

SEQ ID NO: 8486 - DNA, 23 bp, Artificial Sequence
  HLA-A targeting gRNA
tgggtctgtagtcatacttctgg

SEQ ID NO: 8487 - DNA, 23 bp, Artificial Sequence
  HLA-A targeting gRNA
tgggtgggggtggcgggtctggg

SEQ ID NO: 8488 - DNA, 23 bp, Artificial Sequence
  HLA-A targeting gRNA
tgggtggggtggcaggtctgggg

SEQ ID NO: 8489 - DNA, 23 bp, Artificial Sequence
  HLA-A targeting gRNA
tgggtggggtggcgggtctgggg

SEQ ID NO: 8490 - DNA, 23 bp, Artificial Sequence
  HLA-A targeting gRNA
tgggttttcttgtcccactgggg

SEQ ID NO: 8491 - DNA, 23 bp, Artificial Sequence
  HLA-A targeting gRNA
tgggttttgttgtcccactgggg

SEQ ID NO: 8492 - DNA, 23 bp, Artificial Sequence
  HLA-A targeting gRNA
tggtcacatgggtggtcctaggg

SEQ ID NO: 8493 - DNA, 23 bp, Artificial Sequence
  HLA-A targeting gRNA
tggtcaccgctaagatgtgtagg

SEQ ID NO: 8494 - DNA, 23 bp, Artificial Sequence
  HLA-A targeting gRNA
tggtcaccgctatgatgtgtagg

SEQ ID NO: 8495 - DNA, 23 bp, Artificial Sequence
  HLA-A targeting gRNA
tggtcatacccgcggaggagggg

SEQ ID NO: 8496 - DNA, 23 bp, Artificial Sequence
  HLA-A targeting gRNA
tggtcgctactgtgatgtgtagg

SEQ ID NO: 8497 - DNA, 23 bp, Artificial Sequence
  HLA-A targeting gRNA
tggtcgctgctgtgatacatagg

SEQ ID NO: 8498 - DNA, 23 bp, Artificial Sequence
  HLA-A targeting gRNA
tggtcgctgctgtgatgtgtagg

SEQ ID NO: 8499 - DNA, 23 bp, Artificial Sequence
  HLA-A targeting gRNA
tggtcgctgctgtggtgtgtagg

SEQ ID NO: 8500 - DNA, 23 bp, Artificial Sequence
  HLA-A targeting gRNA
tggtcggggcggggcggggcggg

SEQ ID NO: 8501 - DNA, 23 bp, Artificial Sequence
  HLA-A targeting gRNA
tggtctggtctccacaagctcgg

SEQ ID NO: 8502 - DNA, 23 bp, Artificial Sequence
  HLA-A targeting gRNA
tggtgagtgcggggtcggcaggg

SEQ ID NO: 8503 - DNA, 23 bp, Artificial Sequence
  HLA-A targeting gRNA
tggtgagtgcggggtcgggaggg

SEQ ID NO: 8504 - DNA, 23 bp, Artificial Sequence
  HLA-A targeting gRNA
tggtgcttccagtaacaaggcgg

SEQ ID NO: 8505 - DNA, 23 bp, Artificial Sequence
  HLA-A targeting gRNA
tggtgcttccagtaacgaggtgg

SEQ ID NO: 8506 - DNA, 23 bp, Artificial Sequence
  HLA-A targeting gRNA
tggtggctgttgtgatgtgtagg

SEQ ID NO: 8507 - DNA, 23 bp, Artificial Sequence
  HLA-A targeting gRNA
tggtggctgttgttatgtgtagg

SEQ ID NO: 8508 - DNA, 23 bp, Artificial Sequence
  HLA-A targeting gRNA
tggtgggcacgtgcgtggagtgg

SEQ ID NO: 8509 - DNA, 23 bp, Artificial Sequence
  HLA-A targeting gRNA
tggtgggggtgggagtgtgaagg

SEQ ID NO: 8510 - DNA, 23 bp, Artificial Sequence
  HLA-A targeting gRNA
tggtgggggtgggagtgtggagg

SEQ ID NO: 8511 - DNA, 23 bp, Artificial Sequence
  HLA-A targeting gRNA
tggtgggtcacatgtgtctttgg

SEQ ID NO: 8512 - DNA, 23 bp, Artificial Sequence
  HLA-A targeting gRNA
tggtgggtcacgtgtgtctttgg

SEQ ID NO: 8513 - DNA, 23 bp, Artificial Sequence
  HLA-A targeting gRNA
tggttcccaaggctgctgcaggg

SEQ ID NO: 8514 - DNA, 23 bp, Artificial Sequence
  HLA-A targeting gRNA
tggttgctactgtgatgtgtagg

SEQ ID NO: 8515 - DNA, 23 bp, Artificial Sequence
  HLA-A targeting gRNA
tgtagaaatacctcaaggagtgg

SEQ ID NO: 8516 - DNA, 23 bp, Artificial Sequence
  HLA-A targeting gRNA
tgtagaaatacctcatgaagtgg

SEQ ID NO: 8517 - DNA, 23 bp, Artificial Sequence
  HLA-A targeting gRNA
tgtagaaatacctcatggagagg

SEQ ID NO: 8518 - DNA, 23 bp, Artificial Sequence
  HLA-A targeting gRNA
tgtagaaatacttcatggagtgg

SEQ ID NO: 8519 - DNA, 23 bp, Artificial Sequence
  HLA-A targeting gRNA
tgtagccgcgcaggttccgcagg

SEQ ID NO: 8520 - DNA, 23 bp, Artificial Sequence
  HLA-A targeting gRNA
tgtaggacagctgcctgtgtggg

SEQ ID NO: 8521 - DNA, 23 bp, Artificial Sequence
  HLA-A targeting gRNA
tgtaggaggaagagctcaggtgg

SEQ ID NO: 8522 - DNA, 23 bp, Artificial Sequence
  HLA-A targeting gRNA
tgtcacaaaagagtaagtgctgg

SEQ ID NO: 8523 - DNA, 23 bp, Artificial Sequence
  HLA-A targeting gRNA
tgtcccggacggggctctcaggg

SEQ ID NO: 8524 - DNA, 23 bp, Artificial Sequence
  HLA-A targeting gRNA
tgtcccgtccattctcaggctgg

SEQ ID NO: 8525 - DNA, 23 bp, Artificial Sequence
  HLA-A targeting gRNA
tgtcctgcccattctcaggctgg

SEQ ID NO: 8526 - DNA, 23 bp, Artificial Sequence
  HLA-A targeting gRNA
tgtcctgtccattctcaggatgg

SEQ ID NO: 8527 - DNA, 23 bp, Artificial Sequence
  HLA-A targeting gRNA
tgtcctgtccattctcaggctgg

SEQ ID NO: 8528 - DNA, 23 bp, Artificial Sequence
  HLA-A targeting gRNA
tgtcctgtccgttctcaggatgg

SEQ ID NO: 8529 - DNA, 23 bp, Artificial Sequence
  HLA-A targeting gRNA
tgtcctgtgagggcactgggagg

SEQ ID NO: 8530 - DNA, 23 bp, Artificial Sequence
  HLA-A targeting gRNA
tgtcctgtgaggggactgggagg

SEQ ID NO: 8531 - DNA, 23 bp, Artificial Sequence
  HLA-A targeting gRNA
tgtcgaaatacctcatggagtgg

SEQ ID NO: 8532 - DNA, 23 bp, Artificial Sequence
  HLA-A targeting gRNA
tgtgaagcacatgacaacgaagg

SEQ ID NO: 8533 - DNA, 23 bp, Artificial Sequence
  HLA-A targeting gRNA
tgtgaagcacatgacaatgaagg

SEQ ID NO: 8534 - DNA, 23 bp, Artificial Sequence
  HLA-A targeting gRNA
tgtgacacatgtgacaatgaagg

SEQ ID NO: 8535 - DNA, 23 bp, Artificial Sequence
  HLA-A targeting gRNA
tgtgagacccggcctcgctctgg

SEQ ID NO: 8536 - DNA, 23 bp, Artificial Sequence
  HLA-A targeting gRNA
tgtgagtccgggtgggtgactgg

SEQ ID NO: 8537 - DNA, 23 bp, Artificial Sequence
  HLA-A targeting gRNA
tgtgcagcacgaggggctgcagg

SEQ ID NO: 8538 - DNA, 23 bp, Artificial Sequence
  HLA-A targeting gRNA
tgtgcagcacgaggggctgccgg

SEQ ID NO: 8539 - DNA, 23 bp, Artificial Sequence
  HLA-A targeting gRNA
tgtgcagcacgaggggctgctgg

SEQ ID NO: 8540 - DNA, 23 bp, Artificial Sequence
  HLA-A targeting gRNA
tgtgcagcacgaggggctgtcgg

SEQ ID NO: 8541 - DNA, 23 bp, Artificial Sequence
  HLA-A targeting gRNA
tgtgcccccttccccaccccagg

SEQ ID NO: 8542 - DNA, 23 bp, Artificial Sequence
  HLA-A targeting gRNA
tgtgcccccttccctaccccagg

SEQ ID NO: 8543 - DNA, 23 bp, Artificial Sequence
  HLA-A targeting gRNA
tgtgccgccttccccaccccagg

SEQ ID NO: 8544 - DNA, 23 bp, Artificial Sequence
  HLA-A targeting gRNA
tgtggaaatacctcatggagtgg

SEQ ID NO: 8545 - DNA, 23 bp, Artificial Sequence
  HLA-A targeting gRNA
tgtgggacaagaggaattatggg

SEQ ID NO: 8546 - DNA, 23 bp, Artificial Sequence
  HLA-A targeting gRNA
tgtgtcccggcccggccgcgggg

SEQ ID NO: 8547 - DNA, 23 bp, Artificial Sequence
  HLA-A targeting gRNA
tgtgtctttgcggggtctgatgg

SEQ ID NO: 8548 - DNA, 23 bp, Artificial Sequence
  HLA-A targeting gRNA
tgtgtctttgggcgttctgacgg

SEQ ID NO: 8549 - DNA, 23 bp, Artificial Sequence
  HLA-A targeting gRNA
tgtgtctttggggggtctgatgg

SEQ ID NO: 8550 - DNA, 23 bp, Artificial Sequence
  HLA-A targeting gRNA
tgtgtctttgggggttctgacgg

SEQ ID NO: 8551 - DNA, 23 bp, Artificial Sequence
  HLA-A targeting gRNA
tgtgtctttgggtgttctgacgg

SEQ ID NO: 8552 - DNA, 23 bp, Artificial Sequence
  HLA-A targeting gRNA
tgtgtctttgggtgttctgatgg

SEQ ID NO: 8553 - DNA, 23 bp, Artificial Sequence
  HLA-A targeting gRNA
tgtgtttcctgatcctgccctgg

SEQ ID NO: 8554 - DNA, 23 bp, Artificial Sequence
  HLA-A targeting gRNA
tgttcagcacgaggggctgccgg

SEQ ID NO: 8555 - DNA, 23 bp, Artificial Sequence
  HLA-A targeting gRNA
ttaagtctgtgtgttggtcttgg

SEQ ID NO: 8556 - DNA, 23 bp, Artificial Sequence
  HLA-A targeting gRNA
ttaattgtcctagacagcagagg

SEQ ID NO: 8557 - DNA, 23 bp, Artificial Sequence
  HLA-A targeting gRNA
ttaattgtcctagagagaagagg

SEQ ID NO: 8558 - DNA, 23 bp, Artificial Sequence
  HLA-A targeting gRNA
ttaattgtcctagagagcagagg

SEQ ID NO: 8559 - DNA, 23 bp, Artificial Sequence
  HLA-A targeting gRNA
ttaattgtctagagagaagaggg

SEQ ID NO: 8560 - DNA, 23 bp, Artificial Sequence
  HLA-A targeting gRNA
ttaccccagctcagggtgagggg

SEQ ID NO: 8561 - DNA, 23 bp, Artificial Sequence
  HLA-A targeting gRNA
ttactccatctcagggtgagggg

SEQ ID NO: 8562 - DNA, 23 bp, Artificial Sequence
  HLA-A targeting gRNA
ttactccatctcagggtgcaggg

SEQ ID NO: 8563 - DNA, 23 bp, Artificial Sequence
  HLA-A targeting gRNA
ttagaggaacctcctagtcttgg

SEQ ID NO: 8564 - DNA, 23 bp, Artificial Sequence
  HLA-A targeting gRNA
ttagaggaacctcctcgtcttgg

SEQ ID NO: 8565 - DNA, 23 bp, Artificial Sequence
  HLA-A targeting gRNA
ttagatcacccagcgcaagtggg

SEQ ID NO: 8566 - DNA, 23 bp, Artificial Sequence
  HLA-A targeting gRNA
ttaggggaacctcctagtcttgg

SEQ ID NO: 8567 - DNA, 23 bp, Artificial Sequence
  HLA-A targeting gRNA
ttatcccaggtgcctgcgtccgg

SEQ ID NO: 8568 - DNA, 23 bp, Artificial Sequence
  HLA-A targeting gRNA
ttcacatccgtgtcccggcctgg

SEQ ID NO: 8569 - DNA, 23 bp, Artificial Sequence
  HLA-A targeting gRNA
ttcacatccgtgtcctggcccgg

SEQ ID NO: 8570 - DNA, 23 bp, Artificial Sequence
  HLA-A targeting gRNA
ttcagcccctcctcgcccccagg

SEQ ID NO: 8571 - DNA, 23 bp, Artificial Sequence
  HLA-A targeting gRNA
ttcaggtagggaaggggtgaggg

SEQ ID NO: 8572 - DNA, 23 bp, Artificial Sequence
  HLA-A targeting gRNA
ttcatggagtgggagcctggggg

SEQ ID NO: 8573 - DNA, 23 bp, Artificial Sequence
  HLA-A targeting gRNA
ttcatggagtgggaggctggggg

SEQ ID NO: 8574 - DNA, 23 bp, Artificial Sequence
  HLA-A targeting gRNA
ttccagcattcatgagtcagggg

SEQ ID NO: 8575 - DNA, 23 bp, Artificial Sequence
  HLA-A targeting gRNA
ttccagcattcatgagtcggggg

SEQ ID NO: 8576 - DNA, 23 bp, Artificial Sequence
  HLA-A targeting gRNA
ttccagcattcgtgagtcagggg

SEQ ID NO: 8577 - DNA, 23 bp, Artificial Sequence
  HLA-A targeting gRNA
ttcccacaggtggaaaaggaggg

SEQ ID NO: 8578 - DNA, 23 bp, Artificial Sequence
  HLA-A targeting gRNA
ttcccactcccattgggtattgg

SEQ ID NO: 8579 - DNA, 23 bp, Artificial Sequence
  HLA-A targeting gRNA
ttcccactcccattgggtgtcgg

SEQ ID NO: 8580 - DNA, 23 bp, Artificial Sequence
  HLA-A targeting gRNA
ttcccccgactcatgaatgctgg

SEQ ID NO: 8581 - DNA, 23 bp, Artificial Sequence
  HLA-A targeting gRNA
ttcccctgactcacgaatgctgg

SEQ ID NO: 8582 - DNA, 23 bp, Artificial Sequence
  HLA-A targeting gRNA
ttcccctgactcatgaatgctgg

SEQ ID NO: 8583 - DNA, 23 bp, Artificial Sequence
  HLA-A targeting gRNA
ttcctcccagtcccctcacaggg

SEQ ID NO: 8584 - DNA, 23 bp, Artificial Sequence
  HLA-A targeting gRNA
ttcctcgtgggaggccatcccgg

SEQ ID NO: 8585 - DNA, 23 bp, Artificial Sequence
  HLA-A targeting gRNA
ttcctggaccgccgcggacacgg

SEQ ID NO: 8586 - DNA, 23 bp, Artificial Sequence
  HLA-A targeting gRNA
ttccttttgggtccaagacgagg

SEQ ID NO: 8587 - DNA, 23 bp, Artificial Sequence
  HLA-A targeting gRNA
ttccttttgggtccaagactagg

SEQ ID NO: 8588 - DNA, 23 bp, Artificial Sequence
  HLA-A targeting gRNA
ttccttttggttccaagacgagg

SEQ ID NO: 8589 - DNA, 23 bp, Artificial Sequence
  HLA-A targeting gRNA
ttcgaccactgcggcagctgtgg

SEQ ID NO: 8590 - DNA, 23 bp, Artificial Sequence
  HLA-A targeting gRNA
ttcggtaaggagggggatgaggg

SEQ ID NO: 8591 - DNA, 23 bp, Artificial Sequence
  HLA-A targeting gRNA
ttctagaagtcccaggtcccggg

SEQ ID NO: 8592 - DNA, 23 bp, Artificial Sequence
  HLA-A targeting gRNA
ttctcagctgctccgccacacgg

SEQ ID NO: 8593 - DNA, 23 bp, Artificial Sequence
  HLA-A targeting gRNA
ttctcagctgctccgcctcacgg

SEQ ID NO: 8594 - DNA, 23 bp, Artificial Sequence
  HLA-A targeting gRNA
ttctccacccacggcgcccgcgg

SEQ ID NO: 8595 - DNA, 23 bp, Artificial Sequence
  HLA-A targeting gRNA
ttctccgctgctccgcctcacgg

SEQ ID NO: 8596 - DNA, 23 bp, Artificial Sequence
  HLA-A targeting gRNA
ttctcgtgggaggccatccccgg

SEQ ID NO: 8597 - DNA, 23 bp, Artificial Sequence
  HLA-A targeting gRNA
ttctcgttggaggccatccccgg

SEQ ID NO: 8598 - DNA, 23 bp, Artificial Sequence
  HLA-A targeting gRNA
ttctggagggtgtgagaccctgg

SEQ ID NO: 8599 - DNA, 23 bp, Artificial Sequence
  HLA-A targeting gRNA
ttctgggagctgaagtggtcggg

SEQ ID NO: 8600 - DNA, 23 bp, Artificial Sequence
  HLA-A targeting gRNA
ttctggggagctgaagtggtcgg

SEQ ID NO: 8601 - DNA, 23 bp, Artificial Sequence
  HLA-A targeting gRNA
ttctggtagggaaggggtgaggg

SEQ ID NO: 8602 - DNA, 23 bp, Artificial Sequence
  HLA-A targeting gRNA
ttcttctcccaacctatgtcggg

SEQ ID NO: 8603 - DNA, 23 bp, Artificial Sequence
  HLA-A targeting gRNA
ttcttctcccaacctgcgacggg

SEQ ID NO: 8604 - DNA, 23 bp, Artificial Sequence
  HLA-A targeting gRNA
ttcttctcccaacctgcgtcggg

SEQ ID NO: 8605 - DNA, 23 bp, Artificial Sequence
  HLA-A targeting gRNA
ttcttctcccaacctgtgtcggg

SEQ ID NO: 8606 - DNA, 23 bp, Artificial Sequence
  HLA-A targeting gRNA
ttcttctcccaacttgtgtcggg

SEQ ID NO: 8607 - DNA, 23 bp, Artificial Sequence
  HLA-A targeting gRNA
ttcttcttccaacctgcgtcggg

SEQ ID NO: 8608 - DNA, 23 bp, Artificial Sequence
  HLA-A targeting gRNA
ttcttggggtctagagtgggcgg

SEQ ID NO: 8609 - DNA, 23 bp, Artificial Sequence
  HLA-A targeting gRNA
ttcttggggtctagagtgggtgg

SEQ ID NO: 8610 - DNA, 23 bp, Artificial Sequence
  HLA-A targeting gRNA
ttctttttgggtccaagactagg

SEQ ID NO: 8611 - DNA, 23 bp, Artificial Sequence
  HLA-A targeting gRNA
ttgaaaaggtgagattcttgggg

SEQ ID NO: 8612 - DNA, 23 bp, Artificial Sequence
  HLA-A targeting gRNA
ttgacccctgcagcagccttggg

SEQ ID NO: 8613 - DNA, 23 bp, Artificial Sequence
  HLA-A targeting gRNA
ttgagtccgggtgggtgcgtggg

SEQ ID NO: 8614 - DNA, 23 bp, Artificial Sequence
  HLA-A targeting gRNA
ttgcgtgtaagtgatggcggcgg

SEQ ID NO: 8615 - DNA, 23 bp, Artificial Sequence
  HLA-A targeting gRNA
ttgctactgtgatgtgtaggagg

SEQ ID NO: 8616 - DNA, 23 bp, Artificial Sequence
  HLA-A targeting gRNA
ttgctctatccacggcgcccggg

SEQ ID NO: 8617 - DNA, 23 bp, Artificial Sequence
  HLA-A targeting gRNA
ttgctctatccatggcgcccggg

SEQ ID NO: 8618 - DNA, 23 bp, Artificial Sequence
  HLA-A targeting gRNA
ttgcttcccacaggtggaaaagg

SEQ ID NO: 8619 - DNA, 23 bp, Artificial Sequence
  HLA-A targeting gRNA
ttggaaagttctagtctctgagg

SEQ ID NO: 8620 - DNA, 23 bp, Artificial Sequence
  HLA-A targeting gRNA
ttgggagaagtgaaactcagggg

SEQ ID NO: 8621 - DNA, 23 bp, Artificial Sequence
  HLA-A targeting gRNA
ttgggagggaaacggcctctggg

SEQ ID NO: 8622 - DNA, 23 bp, Artificial Sequence
  HLA-A targeting gRNA
ttggggtctagagtgggcagggg

SEQ ID NO: 8623 - DNA, 23 bp, Artificial Sequence
  HLA-A targeting gRNA
ttggggtctagagtgggcggggg

SEQ ID NO: 8624 - DNA, 23 bp, Artificial Sequence
  HLA-A targeting gRNA
ttggggtctagagtgggtggggg

SEQ ID NO: 8625 - DNA, 23 bp, Artificial Sequence
  HLA-A targeting gRNA
ttggtcggggcggggcggggcgg

SEQ ID NO: 8626 - DNA, 23 bp, Artificial Sequence
  HLA-A targeting gRNA
ttggtcttgaagatctgttccgg

SEQ ID NO: 8627 - DNA, 23 bp, Artificial Sequence
  HLA-A targeting gRNA
ttgtgtcgggtccttcttccagg

SEQ ID NO: 8628 - DNA, 23 bp, Artificial Sequence
  HLA-A targeting gRNA
ttgtgtcgggtccttcttccggg

SEQ ID NO: 8629 - DNA, 23 bp, Artificial Sequence
  HLA-A targeting gRNA
tttcagcattcatgagtcagggg

SEQ ID NO: 8630 - DNA, 23 bp, Artificial Sequence
  HLA-A targeting gRNA
tttcctcccctcctcgtggaagg

SEQ ID NO: 8631 - DNA, 23 bp, Artificial Sequence
  HLA-A targeting gRNA
tttcctcccctcctcgtgggagg

SEQ ID NO: 8632 - DNA, 23 bp, Artificial Sequence
  HLA-A targeting gRNA
tttcctcccttcctcgtgggagg

SEQ ID NO: 8633 - DNA, 23 bp, Artificial Sequence
  HLA-A targeting gRNA
tttcctcctcttctcgtgggagg

SEQ ID NO: 8634 - DNA, 23 bp, Artificial Sequence
  HLA-A targeting gRNA
tttcctcttcttctcgtgggagg

SEQ ID NO: 8635 - DNA, 23 bp, Artificial Sequence
  HLA-A targeting gRNA
tttcctcttcttctcgttggagg

SEQ ID NO: 8636 - DNA, 23 bp, Artificial Sequence
  HLA-A targeting gRNA
tttcttcccacaggtggaaaagg

SEQ ID NO: 8637 - DNA, 23 bp, Artificial Sequence
  HLA-A targeting gRNA
tttgaccactgcagcagctgtgg

SEQ ID NO: 8638 - DNA, 23 bp, Artificial Sequence
  HLA-A targeting gRNA
tttgaccactgcggcagctgtgg

SEQ ID NO: 8639 - DNA, 23 bp, Artificial Sequence
  HLA-A targeting gRNA
tttgaccacttcgaccactgcgg

SEQ ID NO: 8640 - DNA, 23 bp, Artificial Sequence
  HLA-A targeting gRNA
tttgaccactttgaccactgcgg

SEQ ID NO: 8641 - DNA, 23 bp, Artificial Sequence
  HLA-A targeting gRNA
tttgacccctgcagcagccttgg

SEQ ID NO: 8642 - DNA, 23 bp, Artificial Sequence
  HLA-A targeting gRNA
tttgagtccgggtgggtgcgtgg

SEQ ID NO: 8643 - DNA, 23 bp, Artificial Sequence
  HLA-A targeting gRNA
tttgcagaaagagatgccagagg

SEQ ID NO: 8644 - DNA, 23 bp, Artificial Sequence
  HLA-A targeting gRNA
tttgtagaaagagatgccagagg

SEQ ID NO: 8645 - DNA, 23 bp, Artificial Sequence
  HLA-A targeting gRNA
tttgtgacttcaagagcctctgg

SEQ ID NO: 8646 - DNA, 23 bp, Artificial Sequence
  HLA-A targeting gRNA
tttgtgacttcaagggcctctgg

SEQ ID NO: 8647 - DNA, 23 bp, Artificial Sequence
  HLA-A targeting gRNA
ttttcccgagtttcctctgaggg

SEQ ID NO: 8648 - DNA, 23 bp, Artificial Sequence
  HLA-A targeting gRNA
ttttcctgagtttcctctgaggg

SEQ ID NO: 8649 - DNA, 23 bp, Artificial Sequence
  HLA-A targeting gRNA
ttttcctgagtttcttctgaggg

SEQ ID NO: 8650 - DNA, 23 bp, Artificial Sequence
  HLA-A targeting gRNA
tttttgggtccaagactaggagg

SEQ ID NO: 8651 - DNA, 20 bp, Artificial Sequence
  HLA-A targeting gRNA
tggacgacacgcagttcgtg

SEQ ID NO: 8652 - DNA, 20 bp, Artificial Sequence
  HLA-A targeting gRNA
cagatacctggagaacggga

SEQ ID NO: 8653 - DNA, 20 bp, Artificial Sequence
  HLA-A targeting gRNA
tcccgttctccaggtatctg

SEQ ID NO: 8654 - DNA, 20 bp, Artificial Sequence
  HLA-A targeting gRNA
ccgccgcggtccaagagcgc

SEQ ID NO: 8655 - DNA, 20 bp, Artificial Sequence
  HLA-A targeting gRNA
cctgcgctcttggaccgcgg

SEQ ID NO: 8656 - DNA, 21 bp, Artificial Sequence
  HLA-A targeting gRNA
ggacctgcgctcttggaccgc

SEQ ID NO: 8657 - DNA, 20 bp, Artificial Sequence
  B2M CDS targeting gRNA
cgcgagcacagctaaggcca

SEQ ID NO: 8658 - DNA, 20 bp, Artificial Sequence
  B2M CDS targeting gRNA
gagtagcgcgagcacagcta

SEQ ID NO: 8659 - DNA, 20 bp, Artificial Sequence
  B2M CDS targeting gRNA
agggtaggagagactcacgc

SEQ ID NO: 8660 - DNA, 20 bp, Artificial Sequence
  B2M CDS targeting gRNA
ctgaatctttggagtacctg

SEQ ID NO: 8661 - DNA, 20 bp, Artificial Sequence
  B2M CDS targeting gRNA
tcacgtcatccagcagagaa

SEQ ID NO: 8662 - DNA, 20 bp, Artificial Sequence
  B2M CDS targeting gRNA
tcctgaattgctatgtgtct

SEQ ID NO: 8663 - DNA, 20 bp, Artificial Sequence
  B2M CDS targeting gRNA
aagtcaacttcaatgtcgga

SEQ ID NO: 8664 - DNA, 20 bp, Artificial Sequence
  B2M CDS targeting gRNA
gtcttttcccgatattcctc

SEQ ID NO: 8665 - DNA, 20 bp, Artificial Sequence
  B2M CDS targeting gRNA
tggagtacctgaggaatatc

SEQ ID NO: 8666 - DNA, 20 bp, Artificial Sequence
  B2M CDS targeting gRNA
cagcccaagatagttaagtg

SEQ ID NO: 8667 - DNA, 20 bp, Artificial Sequence
  B2M CDS targeting gRNA
acaaagtcacatggttcaca

SEQ ID NO: 8668 - DNA, 20 bp, Artificial Sequence
  B2M CDS targeting gRNA
actctctctttctggcctgg

SEQ ID NO: 8669 - DNA, 20 bp, Artificial Sequence
  B2M CDS targeting gRNA
tgggctgtgacaaagtcaca

SEQ ID NO: 8670 - DNA, 20 bp, Artificial Sequence
  B2M CDS targeting gRNA
ggccgagatgtctcgctccg

SEQ ID NO: 8671 - DNA, 20 bp, Artificial Sequence
  B2M CDS targeting gRNA
cagtaagtcaacttcaatgt

SEQ ID NO: 8672 - DNA, 20 bp, Artificial Sequence
  B2M CDS targeting gRNA
actcacgctggatagcctcc

SEQ ID NO: 8673 - DNA, 20 bp, Artificial Sequence
  B2M CDS targeting gRNA
catactcatctttttcagtg

SEQ ID NO: 8674 - DNA, 20 bp, Artificial Sequence
  B2M CDS targeting gRNA
cacagcccaagatagttaag

SEQ ID NO: 8675 - DNA, 20 bp, Artificial Sequence
  B2M CDS targeting gRNA
ttcagacttgtctttcagca

SEQ ID NO: 8676 - DNA, 20 bp, Artificial Sequence
  B2M CDS targeting gRNA
agtcacatggttcacacggc

SEQ ID NO: 8677 - DNA, 20 bp, Artificial Sequence
  B2M CDS targeting gRNA
atactcatctttttcagtgg

SEQ ID NO: 8678 - DNA, 20 bp, Artificial Sequence
  B2M CDS targeting gRNA
ggcatactcatctttttcag

SEQ ID NO: 8679 - DNA, 20 bp, Artificial Sequence
  B2M CDS targeting gRNA
acagcccaagatagttaagt

SEQ ID NO: 8680 - DNA, 20 bp, Artificial Sequence
  B2M CDS targeting gRNA
gctactctctctttctggcc

SEQ ID NO: 8681 - DNA, 20 bp, Artificial Sequence
  B2M CDS targeting gRNA
tggagagagaattgaaaaag

SEQ ID NO: 8682 - DNA, 20 bp, Artificial Sequence
  B2M CDS targeting gRNA
acttgtctttcagcaaggac

SEQ ID NO: 8683 - DNA, 20 bp, Artificial Sequence
  B2M CDS targeting gRNA
gaagttgacttactgaagaa

SEQ ID NO: 8684 - DNA, 20 bp, Artificial Sequence
  B2M CDS targeting gRNA
ggccacggagcgagacatct

SEQ ID NO: 8685 - DNA, 20 bp, Artificial Sequence
  B2M CDS targeting gRNA
gcatactcatctttttcagt

SEQ ID NO: 8686 - DNA, 20 bp, Artificial Sequence
  B2M CDS targeting gRNA
cgtgagtaaacctgaatctt

SEQ ID NO: 8687 - DNA, 20 bp, Artificial Sequence
  B2M CDS targeting gRNA
ttaccccacttaactatctt

SEQ ID NO: 8688 - DNA, 20 bp, Artificial Sequence
  B2M CDS targeting gRNA
ttggagtacctgaggaatat

SEQ ID NO: 8689 - DNA, 20 bp, Artificial Sequence
  B2M CDS targeting gRNA
acccagacacatagcaattc

SEQ ID NO: 8690 - DNA, 20 bp, Artificial Sequence
  B2M CDS targeting gRNA
tttgactttccattctctgc

SEQ ID NO: 8691 - DNA, 20 bp, Artificial Sequence
  B2M CDS targeting gRNA
ttcctgaattgctatgtgtc

SEQ ID NO: 8692 - DNA, 20 bp, Artificial Sequence
  B2M CDS targeting gRNA
ctcaggtactccaaagattc

SEQ ID NO: 8693 - DNA, 20 bp, Artificial Sequence
  B2M CDS targeting gRNA
cttaccccacttaactatct

SEQ ID NO: 8694 - DNA, 20 bp, Artificial Sequence
  B2M CDS targeting gRNA
ctcgcgctactctctctttc

SEQ ID NO: 8695 - DNA, 20 bp, Artificial Sequence
  B2M CDS targeting gRNA
tcgatctatgaaaaagacag

SEQ ID NO: 8696 - DNA, 20 bp, Artificial Sequence
  B2M CDS targeting gRNA
gagacatgtaagcagcatca

SEQ ID NO: 8697 - DNA, 20 bp, Artificial Sequence
  B2M CDS targeting gRNA
acatgtaagcagcatcatgg

SEQ ID NO: 8698 - DNA, 20 bp, Artificial Sequence
  B2M promoter targeting gRNA
gaagtcctagaatgagcgcc

SEQ ID NO: 8699 - DNA, 20 bp, Artificial Sequence
  B2M promoter targeting gRNA
gagcgcccggtgtcccaagc

SEQ ID NO: 8700 - DNA, 20 bp, Artificial Sequence
  B2M promoter targeting gRNA
agcgcccggtgtcccaagct

SEQ ID NO: 8701 - DNA, 20 bp, Artificial Sequence
  B2M promoter targeting gRNA
gcgcccggtgtcccaagctg

SEQ ID NO: 8702 - DNA, 20 bp, Artificial Sequence
  B2M promoter targeting gRNA
ctggggcgcgcaccccagat

SEQ ID NO: 8703 - DNA, 20 bp, Artificial Sequence
  B2M promoter targeting gRNA
gggcgcgcaccccagatcgg

SEQ ID NO: 8704 - DNA, 20 bp, Artificial Sequence
  B2M promoter targeting gRNA
ggcgcgcaccccagatcgga

SEQ ID NO: 8705 - DNA, 20 bp, Artificial Sequence
  B2M promoter targeting gRNA
catcacgagactctaagaaa

SEQ ID NO: 8706 - DNA, 20 bp, Artificial Sequence
  B2M promoter targeting gRNA
taagaaaaggaaactgaaaa

SEQ ID NO: 8707 - DNA, 20 bp, Artificial Sequence
  B2M promoter targeting gRNA
aagaaaaggaaactgaaaac

SEQ ID NO: 8708 - DNA, 20 bp, Artificial Sequence
  B2M promoter targeting gRNA
gaaagtccctctctctaacc

SEQ ID NO: 8709 - DNA, 20 bp, Artificial Sequence
  B2M promoter targeting gRNA
ctaacctggcactgcgtcgc

SEQ ID NO: 8710 - DNA, 20 bp, Artificial Sequence
  B2M promoter targeting gRNA
ctggcactgcgtcgctggct

SEQ ID NO: 8711 - DNA, 20 bp, Artificial Sequence
  B2M promoter targeting gRNA
tgcgtcgctggcttggagac

SEQ ID NO: 8712 - DNA, 20 bp, Artificial Sequence
  B2M promoter targeting gRNA
gctggcttggagacaggtga

SEQ ID NO: 8713 - DNA, 20 bp, Artificial Sequence
  B2M promoter targeting gRNA
gagacaggtgacggtccctg

SEQ ID NO: 8714 - DNA, 20 bp, Artificial Sequence
  B2M promoter targeting gRNA
agacaggtgacggtccctgc

SEQ ID NO: 8715 - DNA, 20 bp, Artificial Sequence
  B2M promoter targeting gRNA
cctgcgggccttgtcctgat

SEQ ID NO: 8716 - DNA, 20 bp, Artificial Sequence
  B2M promoter targeting gRNA
cgggccttgtcctgattggc

SEQ ID NO: 8717 - DNA, 20 bp, Artificial Sequence
  B2M promoter targeting gRNA
gggccttgtcctgattggct

SEQ ID NO: 8718 - DNA, 20 bp, Artificial Sequence
  B2M promoter targeting gRNA
gggcacgcgtttaatataag

SEQ ID NO: 8719 - DNA, 20 bp, Artificial Sequence
  B2M promoter targeting gRNA
cacgcgtttaatataagtgg

SEQ ID NO: 8720 - DNA, 20 bp, Artificial Sequence
  B2M promoter targeting gRNA
tataagtggaggcgtcgcgc

SEQ ID NO: 8721 - DNA, 20 bp, Artificial Sequence
  B2M promoter targeting gRNA
aagtggaggcgtcgcgctgg

SEQ ID NO: 8722 - DNA, 20 bp, Artificial Sequence
  B2M promoter targeting gRNA
agtggaggcgtcgcgctggc

SEQ ID NO: 8723 - DNA, 20 bp, Artificial Sequence
  B2M promoter targeting gRNA
ttcctgaagctgacagcatt

SEQ ID NO: 8724 - DNA, 20 bp, Artificial Sequence
  B2M promoter targeting gRNA
tcctgaagctgacagcattc

SEQ ID NO: 8725 - DNA, 20 bp, Artificial Sequence
  B2M promoter targeting gRNA
gcccgaatgctgtcagcttc

SEQ ID NO: 8726 - DNA, 20 bp, Artificial Sequence
  B2M promoter targeting gRNA
aaacgcgtgcccagccaatc

SEQ ID NO: 8727 - DNA, 20 bp, Artificial Sequence
  B2M promoter targeting gRNA
gtgcccagccaatcaggaca

SEQ ID NO: 8728 - DNA, 20 bp, Artificial Sequence
  B2M promoter targeting gRNA
ccaatcaggacaaggcccgc

SEQ ID NO: 8729 - DNA, 20 bp, Artificial Sequence
  B2M promoter targeting gRNA
caatcaggacaaggcccgca

SEQ ID NO: 8730 - DNA, 20 bp, Artificial Sequence
  B2M promoter targeting gRNA
caagccagcgacgcagtgcc

SEQ ID NO: 8731 - DNA, 20 bp, Artificial Sequence
  B2M promoter targeting gRNA
cgcagtgccaggttagagag

SEQ ID NO: 8732 - DNA, 20 bp, Artificial Sequence
  B2M promoter targeting gRNA
gcagtgccaggttagagaga

SEQ ID NO: 8733 - DNA, 20 bp, Artificial Sequence
  B2M promoter targeting gRNA
gagtctcgtgatgtttaaga

SEQ ID NO: 8734 - DNA, 20 bp, Artificial Sequence
  B2M promoter targeting gRNA
taagaaggcatgcactagac

SEQ ID NO: 8735 - DNA, 20 bp, Artificial Sequence
  B2M promoter targeting gRNA
aagaaggcatgcactagact

SEQ ID NO: 8736 - DNA, 20 bp, Artificial Sequence
  B2M promoter targeting gRNA
tgagtttgctgtctgtacat

SEQ ID NO: 8737 - DNA, 20 bp, Artificial Sequence
  B2M promoter targeting gRNA
tacatcggcgccctccgatc

SEQ ID NO: 8738 - DNA, 20 bp, Artificial Sequence
  B2M promoter targeting gRNA
acatcggcgccctccgatct

SEQ ID NO: 8739 - DNA, 20 bp, Artificial Sequence
  B2M promoter targeting gRNA
catcggcgccctccgatctg

SEQ ID NO: 8740 - DNA, 20 bp, Artificial Sequence
  B2M promoter targeting gRNA
ctggggtgcgcgccccagct

SEQ ID NO: 8741 - DNA, 20 bp, Artificial Sequence
  B2M promoter targeting gRNA
tggggtgcgcgccccagctt

SEQ ID NO: 8742 - DNA, 20 bp, Artificial Sequence
  B2M promoter targeting gRNA
cgcgccccagcttgggacac

SEQ ID NO: 8743 - DNA, 20 bp, Artificial Sequence
  B2M promoter targeting gRNA
gcgccccagcttgggacacc

SEQ ID NO: 8744 - DNA, 20 bp, Artificial Sequence
  B2M promoter targeting gRNA
caagtcacttagcatctctg

SEQ ID NO: 8745 - DNA, 20 bp, Artificial Sequence
  B2M promoter targeting gRNA
acagaagttctccttctgct

SEQ ID NO: 8746 - DNA, 20 bp, Artificial Sequence
  B2M promoter targeting gRNA
attcaaagatcttaatcttc

SEQ ID NO: 8747 - DNA, 20 bp, Artificial Sequence
  B2M promoter targeting gRNA
ttcaaagatcttaatcttct

SEQ ID NO: 8748 - DNA, 20 bp, Artificial Sequence
  B2M promoter targeting gRNA
ttttctcgaatgaaaaatgc

SEQ ID NO: 8749 - DNA, 20 bp, Artificial Sequence
  B2M promoter targeting gRNA
tgcaggtccgagcagttaac

SEQ ID NO: 8750 - DNA, 20 bp, Artificial Sequence
  B2M promoter targeting gRNA
ggtccgagcagttaactggc

SEQ ID NO: 8751 - DNA, 20 bp, Artificial Sequence
  B2M promoter targeting gRNA
gtccgagcagttaactggct

SEQ ID NO: 8752 - DNA, 20 bp, Artificial Sequence
  B2M promoter targeting gRNA
tccgagcagttaactggctg

SEQ ID NO: 8753 - DNA, 20 bp, Artificial Sequence
  B2M promoter targeting gRNA
agcaagtcacttagcatctc

SEQ ID NO: 8754 - DNA, 20 bp, Artificial Sequence
  B2M promoter targeting gRNA
gcaagtcacttagcatctct

SEQ ID NO: 8755 - DNA, 20 bp, Artificial Sequence
  B2M promoter targeting gRNA
tggggccagtctgcaaagcg

SEQ ID NO: 8756 - DNA, 20 bp, Artificial Sequence
  B2M promoter targeting gRNA
ggggccagtctgcaaagcga

SEQ ID NO: 8757 - DNA, 20 bp, Artificial Sequence
  B2M promoter targeting gRNA
gggccagtctgcaaagcgag

SEQ ID NO: 8758 - DNA, 20 bp, Artificial Sequence
  B2M promoter targeting gRNA
ggccagtctgcaaagcgagg

SEQ ID NO: 8759 - DNA, 20 bp, Artificial Sequence
  B2M promoter targeting gRNA
ggacaccgggcgctcattct

SEQ ID NO: 8760 - DNA, 20 bp, Artificial Sequence
  B2M promoter targeting gRNA
ggcgctcattctaggacttc

SEQ ID NO: 8761 - DNA, 20 bp, Artificial Sequence
  B2M promoter targeting gRNA
ctcattctaggacttcaggc

SEQ ID NO: 8762 - DNA, 20 bp, Artificial Sequence
  B2M promoter targeting gRNA
attctaggacttcaggctgg

SEQ ID NO: 8763 - DNA, 20 bp, Artificial Sequence
  B2M promoter targeting gRNA
ttcaggctggaggcacatta

SEQ ID NO: 8764 - DNA, 20 bp, Artificial Sequence
  B2M promoter targeting gRNA
tgccccctcgctttgcagac

SEQ ID NO: 8765 - DNA, 20 bp, Artificial Sequence
  B2M promoter targeting gRNA
gatgctaagtgacttgctaa

SEQ ID NO: 8766 - DNA, 20 bp, Artificial Sequence
  B2M promoter targeting gRNA
gccccagccagttaactgct

SEQ ID NO: 8767 - DNA, 20 bp, Artificial Sequence
  B2M promoter targeting gRNA
gcatttttcattcgagaaaa

SEQ ID NO: 8768 - DNA, 20 bp, Artificial Sequence
  B2M promoter targeting gRNA
tttgaatgctacctagcaga

SEQ ID NO: 8769 - DNA, 20 bp, Artificial Sequence
  B2M promoter targeting gRNA
ttctgtttataactacagct

SEQ ID NO: 8770 - DNA, 20 bp, Artificial Sequence
  B2M promoter targeting gRNA
tctgtttataactacagctt

SEQ ID NO: 8771 - DNA, 21 bp, Artificial Sequence
  Target B2M Sequence complement
agagaatggaaagtcaaattt

SEQ ID NO: 8772 - DNA, 21 bp, Artificial Sequence
  Target B2M Sequence complement
atggacatgatcttctttata

SEQ ID NO: 8773 - DNA, 21 bp, Artificial Sequence
  Target B2M Sequence complement
tggacatgatcttctttataa

SEQ ID NO: 8774 - DNA, 21 bp, Artificial Sequence
  Target B2M Sequence complement
ggacatgatcttctttataat

SEQ ID NO: 8775 - DNA, 21 bp, Artificial Sequence
  Target B2M Sequence complement
tgacaggattattggaaattt

SEQ ID NO: 8776 - DNA, 21 bp, Artificial Sequence
  Target B2M Sequence complement
ttgtggttaatctggtttatt

SEQ ID NO: 8777 - DNA, 21 bp, Artificial Sequence
  Target B2M Sequence complement
tgtggttaatctggtttattt

SEQ ID NO: 8778 - DNA, 21 bp, Artificial Sequence
  Target B2M Sequence complement
gcagagaatggaaagtcaaat

SEQ ID NO: 8779 - DNA, 21 bp, Artificial Sequence
  Target B2M Sequence complement
cagagaatggaaagtcaaatt

SEQ ID NO: 8780 - DNA, 21 bp, Artificial Sequence
  Target B2M Sequence complement
gagaatggaaagtcaaatttc

SEQ ID NO: 8781 - DNA, 21 bp, Artificial Sequence
  Target B2M Sequence complement
gtcacagcccaagatagttaa

SEQ ID NO: 8782 - DNA, 21 bp, Artificial Sequence
  Target B2M Sequence complement
tgcttatacacttacacttta

SEQ ID NO: 8783 - DNA, 21 bp, Artificial Sequence
  Target B2M Sequence complement
gcttatacacttacactttat

SEQ ID NO: 8784 - DNA, 21 bp, Artificial Sequence
  Target B2M Sequence complement
cttatacacttacactttatg

SEQ ID NO: 8785 - DNA, 21 bp, Artificial Sequence
  Target B2M Sequence complement
acatggacatgatcttcttta

SEQ ID NO: 8786 - DNA, 21 bp, Artificial Sequence
  Target B2M Sequence complement
catggacatgatcttctttat

SEQ ID NO: 8787 - DNA, 21 bp, Artificial Sequence
  Target B2M Sequence complement
atcaacatcttggtcagattt

SEQ ID NO: 8788 - DNA, 21 bp, Artificial Sequence
  Target B2M Sequence complement
cttgcactcaaagcttgttaa

SEQ ID NO: 8789 - DNA, 21 bp, Artificial Sequence
  Target B2M Sequence complement
agttaagcgtgcataagttaa

SEQ ID NO: 8790 - DNA, 21 bp, Artificial Sequence
  Target B2M Sequence complement
gcataagttaacttccaattt

SEQ ID NO: 8791 - DNA, 21 bp, Artificial Sequence
  Target B2M Sequence complement
tacatactctgcttagaattt

SEQ ID NO: 8792 - DNA, 21 bp, Artificial Sequence
  Target B2M Sequence complement
acatactctgcttagaatttg

SEQ ID NO: 8793 - DNA, 21 bp, Artificial Sequence
  Target B2M Sequence complement
ttgacaggattattggaaatt

SEQ ID NO: 8794 - DNA, 21 bp, Artificial Sequence
  Target B2M Sequence complement
gacaggattattggaaatttg

SEQ ID NO: 8795 - DNA, 21 bp, Artificial Sequence
  Target B2M Sequence complement
taaggcatggttgtggttaat

SEQ ID NO: 8796 - DNA, 21 bp, Artificial Sequence
  Target B2M Sequence complement
gttgtggttaatctggtttat

SEQ ID NO: 8797 - DNA, 21 bp, Artificial Sequence
  Target B2M Sequence complement
gttccacaagttaaataaatc

SEQ ID NO: 8798 - DNA, 21 bp, Artificial Sequence
  Target B2M Sequence complement
tccagcgtactccaaagattc

SEQ ID NO: 8799 - DNA, 21 bp, Artificial Sequence
  Target B2M Sequence complement
tactccaaagattcaggttta

SEQ ID NO: 8800 - DNA, 21 bp, Artificial Sequence
  Target B2M Sequence complement
actccaaagattcaggtttac

SEQ ID NO: 8801 - DNA, 21 bp, Artificial Sequence
  Target B2M Sequence complement
cacgtcatccagcagagaatg

SEQ ID NO: 8802 - DNA, 21 bp, Artificial Sequence
  Target B2M Sequence complement
ggtttcatccatccgacattg

SEQ ID NO: 8803 - DNA, 21 bp, Artificial Sequence
  Target B2M Sequence complement
ccgacattgaagttgacttac

SEQ ID NO: 8804 - DNA, 21 bp, Artificial Sequence
  Target B2M Sequence complement
tgaagaatggagagagaattg

SEQ ID NO: 8805 - DNA, 21 bp, Artificial Sequence
  Target B2M Sequence complement
gagcattcagacttgtctttc

SEQ ID NO: 8806 - DNA, 21 bp, Artificial Sequence
  Target B2M Sequence complement
ttcagcaaggactggtctttc

SEQ ID NO: 8807 - DNA, 21 bp, Artificial Sequence
  Target B2M Sequence complement
gcaaggactggtctttctatc

SEQ ID NO: 8808 - DNA, 21 bp, Artificial Sequence
  Target B2M Sequence complement
cgtgtgaaccatgtgactttg

SEQ ID NO: 8809 - DNA, 21 bp, Artificial Sequence
  Target B2M Sequence complement
ctttgtcacagcccaagatag

SEQ ID NO: 8810 - DNA, 21 bp, Artificial Sequence
  Target B2M Sequence complement
tcacagcccaagatagttaag

SEQ ID NO: 8811 - DNA, 21 bp, Artificial Sequence
  Target B2M Sequence complement
agtgggatcgagacatgtaag

SEQ ID NO: 8812 - DNA, 21 bp, Artificial Sequence
  Target B2M Sequence complement
aggtttgaagatgccgcattt

SEQ ID NO: 8813 - DNA, 21 bp, Artificial Sequence
  Target B2M Sequence complement
ggtttgaagatgccgcatttg

SEQ ID NO: 8814 - DNA, 21 bp, Artificial Sequence
  Target B2M Sequence complement
ttgatatgcttatacacttac

SEQ ID NO: 8815 - DNA, 21 bp, Artificial Sequence
  Target B2M Sequence complement
tgagtgctgtctccatgtttg

SEQ ID NO: 8816 - DNA, 21 bp, Artificial Sequence
  Target B2M Sequence complement
tgtctccatgtttgatgtatc

SEQ ID NO: 8817 - DNA, 21 bp, Artificial Sequence
  Target B2M Sequence complement
tcaacatcttggtcagatttg

SEQ ID NO: 8818 - DNA, 21 bp, Artificial Sequence
  Target B2M Sequence complement
tcagatttgaactcttcaatc

SEQ ID NO: 8819 - DNA, 21 bp, Artificial Sequence
  Target B2M Sequence complement
ttcaatctcttgcactcaaag

SEQ ID NO: 8820 - DNA, 21 bp, Artificial Sequence
  Target B2M Sequence complement
ttgcactcaaagcttgttaag

SEQ ID NO: 8821 - DNA, 21 bp, Artificial Sequence
  Target B2M Sequence complement
actcaaagcttgttaagatag

SEQ ID NO: 8822 - DNA, 21 bp, Artificial Sequence
  Target B2M Sequence complement
agatagttaagcgtgcataag

SEQ ID NO: 8823 - DNA, 21 bp, Artificial Sequence
  Target B2M Sequence complement
tgcataagttaacttccaatt

SEQ ID NO: 8824 - DNA, 21 bp, Artificial Sequence
  Target B2M Sequence complement
gttaacttccaatttacatac

SEQ ID NO: 8825 - DNA, 21 bp, Artificial Sequence
  Target B2M Sequence complement
attgacaggattattggaaat

SEQ ID NO: 8826 - DNA, 21 bp, Artificial Sequence
  Target B2M Sequence complement
gtaaggcatggttgtggttaa

SEQ ID NO: 8827 - DNA, 21 bp, Artificial Sequence
  Target B2M Sequence complement
ggttgtggttaatctggttta

SEQ ID NO: 8828 - DNA, 21 bp, Artificial Sequence
  Target B2M Sequence complement
ttcctgaagctgacagcattc

SEQ ID NO: 8829 - DNA, 21 bp, Artificial Sequence
  Target B2M Sequence complement
gctatccagcgtactccaaag

SEQ ID NO: 8830 - DNA, 21 bp, Artificial Sequence
  Target B2M Sequence complement
catccagcagagaatggaaag

SEQ ID NO: 8831 - DNA, 21 bp, Artificial Sequence
  Target B2M Sequence complement
caaatttcctgaattgctatg

SEQ ID NO: 8832 - DNA, 21 bp, Artificial Sequence
  Target B2M Sequence complement
attgctatgtgtctgggtttc

SEQ ID NO: 8833 - DNA, 21 bp, Artificial Sequence
  Target B2M Sequence complement
gaagatgccgcatttggattg

SEQ ID NO: 8834 - DNA, 21 bp, Artificial Sequence
  Target B2M Sequence complement
caatttacatactctgcttag

SEQ ID NO: 8835 - DNA, 21 bp, Artificial Sequence
  Target B2M Sequence complement
tatccagcgtactccaaagat

SEQ ID NO: 8836 - DNA, 21 bp, Artificial Sequence
  Target B2M Sequence complement
atccagcgtactccaaagatt

SEQ ID NO: 8837 - DNA, 21 bp, Artificial Sequence
  Target B2M Sequence complement
ctccaaagattcaggtttact

SEQ ID NO: 8838 - DNA, 21 bp, Artificial Sequence
  Target B2M Sequence complement
tgctatgtgtctgggtttcat

SEQ ID NO: 8839 - DNA, 21 bp, Artificial Sequence
  Target B2M Sequence complement
tttcatccatccgacattgaa

SEQ ID NO: 8840 - DNA, 21 bp, Artificial Sequence
  Target B2M Sequence complement
gaagttgacttactgaagaat

SEQ ID NO: 8841 - DNA, 21 bp, Artificial Sequence
  Target B2M Sequence complement
gaagaatggagagagaattga

SEQ ID NO: 8842 - DNA, 21 bp, Artificial Sequence
  Target B2M Sequence complement
agaatggagagagaattgaaa

SEQ ID NO: 8843 - DNA, 21 bp, Artificial Sequence
  Target B2M Sequence complement
cagcaaggactggtctttcta

SEQ ID NO: 8844 - DNA, 21 bp, Artificial Sequence
  Target B2M Sequence complement
agcaaggactggtctttctat

SEQ ID NO: 8845 - DNA, 21 bp, Artificial Sequence
  Target B2M Sequence complement
actttgtcacagcccaagata

SEQ ID NO: 8846 - DNA, 21 bp, Artificial Sequence
  Target B2M Sequence complement
ttgtcacagcccaagatagtt

SEQ ID NO: 8847 - DNA, 21 bp, Artificial Sequence
  Target B2M Sequence complement
tgtcacagcccaagatagtta

SEQ ID NO: 8848 - DNA, 21 bp, Artificial Sequence
  Target B2M Sequence complement
cacagcccaagatagttaagt

SEQ ID NO: 8849 - DNA, 21 bp, Artificial Sequence
  Target B2M Sequence complement
gcagcatcatggaggtttgaa

SEQ ID NO: 8850 - DNA, 21 bp, Artificial Sequence
  Target B2M Sequence complement
ccgcatttggattggatgaat

SEQ ID NO: 8851 - DNA, 21 bp, Artificial Sequence
  Target B2M Sequence complement
ttgagtgctgtctccatgttt

SEQ ID NO: 8852 - DNA, 21 bp, Artificial Sequence
  Target B2M Sequence complement
agtgctgtctccatgtttgat

SEQ ID NO: 8853 - DNA, 21 bp, Artificial Sequence
  Target B2M Sequence complement
ctgtctccatgtttgatgtat

SEQ ID NO: 8854 - DNA, 21 bp, Artificial Sequence
  Target B2M Sequence complement
tctaggagggctggcaactta

SEQ ID NO: 8855 - DNA, 21 bp, Artificial Sequence
  Target B2M Sequence complement
caacatcttggtcagatttga

SEQ ID NO: 8856 - DNA, 21 bp, Artificial Sequence
  Target B2M Sequence complement
gtcagatttgaactcttcaat

SEQ ID NO: 8857 - DNA, 21 bp, Artificial Sequence
  Target B2M Sequence complement
tcttgcactcaaagcttgtta

SEQ ID NO: 8858 - DNA, 21 bp, Artificial Sequence
  Target B2M Sequence complement
tgcactcaaagcttgttaaga

SEQ ID NO: 8859 - DNA, 21 bp, Artificial Sequence
  Target B2M Sequence complement
gcactcaaagcttgttaagat

SEQ ID NO: 8860 - DNA, 21 bp, Artificial Sequence
  Target B2M Sequence complement
cactcaaagcttgttaagata

SEQ ID NO: 8861 - DNA, 21 bp, Artificial Sequence
  Target B2M Sequence complement
tcaaagcttgttaagatagtt

SEQ ID NO: 8862 - DNA, 21 bp, Artificial Sequence
  Target B2M Sequence complement
caaagcttgttaagatagtta

SEQ ID NO: 8863 - DNA, 21 bp, Artificial Sequence
  Target B2M Sequence complement
gatagttaagcgtgcataagt

SEQ ID NO: 8864 - DNA, 21 bp, Artificial Sequence
  Target B2M Sequence complement
atagttaagcgtgcataagtt

SEQ ID NO: 8865 - DNA, 21 bp, Artificial Sequence
  Target B2M Sequence complement
tagttaagcgtgcataagtta

SEQ ID NO: 8866 - DNA, 21 bp, Artificial Sequence
  Target B2M Sequence complement
ttaagcgtgcataagttaact

SEQ ID NO: 8867 - DNA, 21 bp, Artificial Sequence
  Target B2M Sequence complement
taagcgtgcataagttaactt

SEQ ID NO: 8868 - DNA, 21 bp, Artificial Sequence
  Target B2M Sequence complement
atttacatactctgcttagaa

SEQ ID NO: 8869 - DNA, 21 bp, Artificial Sequence
  Target B2M Sequence complement
tttacatactctgcttagaat

SEQ ID NO: 8870 - DNA, 21 bp, Artificial Sequence
  Target B2M Sequence complement
acaggattattggaaatttgt

SEQ ID NO: 8871 - DNA, 21 bp, Artificial Sequence
  Target B2M Sequence complement
caggattattggaaatttgtt

SEQ ID NO: 8872 - DNA, 21 bp, Artificial Sequence
  Target B2M Sequence complement
aggcatggttgtggttaatct

SEQ ID NO: 8873 - DNA, 21 bp, Artificial Sequence
  Target B2M Sequence complement
cagcagagaatggaaagtcaa

SEQ ID NO: 8874 - DNA, 21 bp, Artificial Sequence
  Target B2M Sequence complement
tccgacattgaagttgactta

SEQ ID NO: 8875 - DNA, 21 bp, Artificial Sequence
  Target B2M Sequence complement
ctggtctttctatctcttgta

SEQ ID NO: 8876 - DNA, 21 bp, Artificial Sequence
  Target B2M Sequence complement
ccgtgtgaaccatgtgacttt

SEQ ID NO: 8877 - DNA, 21 bp, Artificial Sequence
  Target B2M Sequence complement
cccaagatagttaagtgggat

SEQ ID NO: 8878 - DNA, 21 bp, Artificial Sequence
  Target B2M Sequence complement
ggttgctccacaggtagctct

SEQ ID NO: 8879 - DNA, 21 bp, Artificial Sequence
  Target B2M Sequence complement
gctccacaggtagctctagga

SEQ ID NO: 8880 - DNA, 21 bp, Artificial Sequence
  Target B2M Sequence complement
gggagcagagaattctcttat

SEQ ID NO: 8881 - DNA, 21 bp, Artificial Sequence
  Target B2M Sequence complement
ggagcagagaattctcttatc

SEQ ID NO: 8882 - DNA, 21 bp, Artificial Sequence
  Target B2M Sequence complement
gagcagagaattctcttatcc

SEQ ID NO: 8883 - DNA, 21 bp, Artificial Sequence
  Target B2M Sequence complement
gagaattctcttatccaacat

SEQ ID NO: 8884 - DNA, 21 bp, Artificial Sequence
  Target B2M Sequence complement
gaattctcttatccaacatca

SEQ ID NO: 8885 - DNA, 21 bp, Artificial Sequence
  Target B2M Sequence complement
aagtggagcattcagacttgt

SEQ ID NO: 8886 - DNA, 21 bp, Artificial Sequence
  Target B2M Sequence complement
aaggactggtctttctatctc

SEQ ID NO: 8887 - DNA, 21 bp, Artificial Sequence
  Target B2M Sequence complement
aagcttgttaagatagttaag

SEQ ID NO: 8888 - DNA, 21 bp, Artificial Sequence
  Target B2M Sequence complement
aagcgtgcataagttaacttc

SEQ ID NO: 8889 - DNA, 21 bp, Artificial Sequence
  Target B2M Sequence complement
aagatgccgcatttggattgg

SEQ ID NO: 8890 - DNA, 21 bp, Artificial Sequence
  Target B2M Sequence complement
aagaatggagagagaattgaa

SEQ ID NO: 8891 - DNA, 21 bp, Artificial Sequence
  Target B2M Sequence complement
aacatcaacatcttggtcaga

SEQ ID NO: 8892 - DNA, 21 bp, Artificial Sequence
  Target B2M Sequence complement
aaggcatggttgtggttaatc

SEQ ID NO: 8893 - DNA, 21 bp, Artificial Sequence
  Target B2M Sequence complement
aagcagcatcatggaggtttg

SEQ ID NO: 8894 - DNA, 21 bp, Artificial Sequence
  Target B2M Sequence complement
aagatgagtatgcctgccgtg

SEQ ID NO: 8895 - DNA, 21 bp, Artificial Sequence
  Target B2M Sequence complement
aagttgacttactgaagaatg

SEQ ID NO: 8896 - DNA, 21 bp, Artificial Sequence
  Target B2M Sequence complement
aagatagttaagcgtgcataa

SEQ ID NO: 8897 - DNA, 21 bp, Artificial Sequence
  Target B2M Sequence complement
aacttccaatttacatactct

SEQ ID NO: 8898 - DNA, 21 bp, Artificial Sequence
  Target B2M Sequence complement
aacatcttggtcagatttgaa

SEQ ID NO: 8899 - DNA, 21 bp, Artificial Sequence
  Target B2M Sequence complement
aactcttcaatctcttgcact

SEQ ID NO: 8900 - DNA, 21 bp, Artificial Sequence
  Target B2M Sequence complement
aatttcctgaattgctatgtg

SEQ ID NO: 8901 - DNA, 21 bp, Artificial Sequence
  Target B2M Sequence complement
aatggaaagtcaaatttcctg

SEQ ID NO: 8902 - DNA, 21 bp, Artificial Sequence
  Target B2M Sequence complement
aaccatgtgactttgtcacag

SEQ ID NO: 8903 - DNA, 21 bp, Artificial Sequence
  Target B2M Sequence complement
aattgacaggattattggaaa

SEQ ID NO: 8904 - DNA, 21 bp, Artificial Sequence
  Target B2M Sequence complement
aattctcttatccaacatcaa

SEQ ID NO: 8905 - DNA, 21 bp, Artificial Sequence
  Target B2M Sequence complement
aaagtggagcattcagacttg

SEQ ID NO: 8906 - DNA, 21 bp, Artificial Sequence
  Target B2M Sequence complement
aaagtcaaatttcctgaattg

SEQ ID NO: 8907 - DNA, 21 bp, Artificial Sequence
  Target B2M Sequence complement
gttgctccacaggtagctcta

SEQ ID NO: 8908 - DNA, 21 bp, Artificial Sequence
  Target B2M Sequence complement
aatttacatactctgcttaga

SEQ ID NO: 8909 - DNA, 21 bp, Artificial Sequence
  Target B2M Sequence complement
attcctgaagctgacagcatt

SEQ ID NO: 8910 - DNA, 21 bp, Artificial Sequence
  Target B2M Sequence complement
tgctcgcgctactctctcttt

SEQ ID NO: 8911 - DNA, 21 bp, Artificial Sequence
  Target B2M Sequence complement
ctcgcgctactctctctttct

SEQ ID NO: 8912 - DNA, 21 bp, Artificial Sequence
  Target B2M Sequence complement
tcgcgctactctctctttctg

SEQ ID NO: 8913 - DNA, 21 bp, Artificial Sequence
  Target B2M Sequence complement
ggctatccagcgtactccaaa

SEQ ID NO: 8914 - DNA, 21 bp, Artificial Sequence
  Target B2M Sequence complement
ctatccagcgtactccaaaga

SEQ ID NO: 8915 - DNA, 21 bp, Artificial Sequence
  Target B2M Sequence complement
ccagcgtactccaaagattca

SEQ ID NO: 8916 - DNA, 21 bp, Artificial Sequence
  Target B2M Sequence complement
cagcgtactccaaagattcag

SEQ ID NO: 8917 - DNA, 21 bp, Artificial Sequence
  Target B2M Sequence complement
gtactccaaagattcaggttt

SEQ ID NO: 8918 - DNA, 21 bp, Artificial Sequence
  Target B2M Sequence complement
tccaaagattcaggtttactc

SEQ ID NO: 8919 - DNA, 21 bp, Artificial Sequence
  Target B2M Sequence complement
ctcacgtcatccagcagagaa

SEQ ID NO: 8920 - DNA, 21 bp, Artificial Sequence
  Target B2M Sequence complement
tcacgtcatccagcagagaat

SEQ ID NO: 8921 - DNA, 21 bp, Artificial Sequence
  Target B2M Sequence complement
tcatccagcagagaatggaaa

SEQ ID NO: 8922 - DNA, 21 bp, Artificial Sequence
  Target B2M Sequence complement
atccagcagagaatggaaagt

SEQ ID NO: 8923 - DNA, 21 bp, Artificial Sequence
  Target B2M Sequence complement
tccagcagagaatggaaagtc

SEQ ID NO: 8924 - DNA, 21 bp, Artificial Sequence
  Target B2M Sequence complement
agcagagaatggaaagtcaaa

SEQ ID NO: 8925 - DNA, 21 bp, Artificial Sequence
  Target B2M Sequence complement
tcaaatttcctgaattgctat

SEQ ID NO: 8926 - DNA, 21 bp, Artificial Sequence
  Target B2M Sequence complement
ttgctatgtgtctgggtttca

SEQ ID NO: 8927 - DNA, 21 bp, Artificial Sequence
  Target B2M Sequence complement
gctatgtgtctgggtttcatc

SEQ ID NO: 8928 - DNA, 21 bp, Artificial Sequence
  Target B2M Sequence complement
gggtttcatccatccgacatt

SEQ ID NO: 8929 - DNA, 21 bp, Artificial Sequence
  Target B2M Sequence complement
gtttcatccatccgacattga

SEQ ID NO: 8930 - DNA, 21 bp, Artificial Sequence
  Target B2M Sequence complement
ttcatccatccgacattgaag

SEQ ID NO: 8931 - DNA, 21 bp, Artificial Sequence
  Target B2M Sequence complement
tcatccatccgacattgaagt

SEQ ID NO: 8932 - DNA, 21 bp, Artificial Sequence
  Target B2M Sequence complement
catccatccgacattgaagtt

SEQ ID NO: 8933 - DNA, 21 bp, Artificial Sequence
  Target B2M Sequence complement
atccatccgacattgaagttg

SEQ ID NO: 8934 - DNA, 21 bp, Artificial Sequence
  Target B2M Sequence complement
tccatccgacattgaagttga

SEQ ID NO: 8935 - DNA, 21 bp, Artificial Sequence
  Target B2M Sequence complement
atccgacattgaagttgactt

SEQ ID NO: 8936 - DNA, 21 bp, Artificial Sequence
  Target B2M Sequence complement
cgacattgaagttgacttact

SEQ ID NO: 8937 - DNA, 21 bp, Artificial Sequence
  Target B2M Sequence complement
gacattgaagttgacttactg

SEQ ID NO: 8938 - DNA, 21 bp, Artificial Sequence
  Target B2M Sequence complement
cattgaagttgacttactgaa

SEQ ID NO: 8939 - DNA, 21 bp, Artificial Sequence
  Target B2M Sequence complement
ttgaagttgacttactgaaga

SEQ ID NO: 8940 - DNA, 21 bp, Artificial Sequence
  Target B2M Sequence complement
tgaagttgacttactgaagaa

SEQ ID NO: 8941 - DNA, 21 bp, Artificial Sequence
  Target B2M Sequence complement
tactgaagaatggagagagaa

SEQ ID NO: 8942 - DNA, 21 bp, Artificial Sequence
  Target B2M Sequence complement
actgaagaatggagagagaat

SEQ ID NO: 8943 - DNA, 21 bp, Artificial Sequence
  Target B2M Sequence complement
tggagcattcagacttgtctt

SEQ ID NO: 8944 - DNA, 21 bp, Artificial Sequence
  Target B2M Sequence complement
ggagcattcagacttgtcttt

SEQ ID NO: 8945 - DNA, 21 bp, Artificial Sequence
  Target B2M Sequence complement
agcattcagacttgtctttca

SEQ ID NO: 8946 - DNA, 21 bp, Artificial Sequence
  Target B2M Sequence complement
gcattcagacttgtctttcag

SEQ ID NO: 8947 - DNA, 21 bp, Artificial Sequence
  Target B2M Sequence complement
tttcagcaaggactggtcttt

SEQ ID NO: 8948 - DNA, 21 bp, Artificial Sequence
  Target B2M Sequence complement
tcagcaaggactggtctttct

SEQ ID NO: 8949 - DNA, 21 bp, Artificial Sequence
  Target B2M Sequence complement
caaggactggtctttctatct

SEQ ID NO: 8950 - DNA, 21 bp, Artificial Sequence
  Target B2M Sequence complement
ggactggtctttctatctctt

SEQ ID NO: 8951 - DNA, 21 bp, Artificial Sequence
  Target B2M Sequence complement
actggtctttctatctcttgt

SEQ ID NO: 8952 - DNA, 21 bp, Artificial Sequence
  Target B2M Sequence complement
tggtctttctatctcttgtac

SEQ ID NO: 8953 - DNA, 21 bp, Artificial Sequence
  Target B2M Sequence complement
ggtctttctatctcttgtact

SEQ ID NO: 8954 - DNA, 21 bp, Artificial Sequence
  Target B2M Sequence complement
gtctttctatctcttgtacta

SEQ ID NO: 8955 - DNA, 21 bp, Artificial Sequence
  Target B2M Sequence complement
tctttctatctcttgtactac

SEQ ID NO: 8956 - DNA, 21 bp, Artificial Sequence
  Target B2M Sequence complement
ctttctatctcttgtactaca

SEQ ID NO: 8957 - DNA, 21 bp, Artificial Sequence
  Target B2M Sequence complement
tatctcttgtactacactgaa

SEQ ID NO: 8958 - DNA, 21 bp, Artificial Sequence
  Target B2M Sequence complement
atctcttgtactacactgaat

SEQ ID NO: 8959 - DNA, 21 bp, Artificial Sequence
  Target B2M Sequence complement
tgagtatgcctgccgtgtgaa

SEQ ID NO: 8960 - DNA, 21 bp, Artificial Sequence
  Target B2M Sequence complement
gccgtgtgaaccatgtgactt

SEQ ID NO: 8961 - DNA, 21 bp, Artificial Sequence
  Target B2M Sequence complement
gtgtgaaccatgtgactttgt

SEQ ID NO: 8962 - DNA, 21 bp, Artificial Sequence
  Target B2M Sequence complement
tgtgaaccatgtgactttgtc

SEQ ID NO: 8963 - DNA, 21 bp, Artificial Sequence
  Target B2M Sequence complement
gactttgtcacagcccaagat

SEQ ID NO: 8964 - DNA, 21 bp, Artificial Sequence
  Target B2M Sequence complement
tttgtcacagcccaagatagt

SEQ ID NO: 8965 - DNA, 21 bp, Artificial Sequence
  Target B2M Sequence complement
acagcccaagatagttaagtg

SEQ ID NO: 8966 - DNA, 21 bp, Artificial Sequence
  Target B2M Sequence complement
agttaagtgggatcgagacat

SEQ ID NO: 8967 - DNA, 21 bp, Artificial Sequence
  Target B2M Sequence complement
ttaagtgggatcgagacatgt

SEQ ID NO: 8968 - DNA, 21 bp, Artificial Sequence
  Target B2M Sequence complement
taagtgggatcgagacatgta

SEQ ID NO: 8969 - DNA, 21 bp, Artificial Sequence
  Target B2M Sequence complement
gagacatgtaagcagcatcat

SEQ ID NO: 8970 - DNA, 21 bp, Artificial Sequence
  Target B2M Sequence complement
agacatgtaagcagcatcatg

SEQ ID NO: 8971 - DNA, 21 bp, Artificial Sequence
  Target B2M Sequence complement
taagcagcatcatggaggttt

SEQ ID NO: 8972 - DNA, 21 bp, Artificial Sequence
  Target B2M Sequence complement
agcagcatcatggaggtttga

SEQ ID NO: 8973 - DNA, 21 bp, Artificial Sequence
  Target B2M Sequence complement
cagcatcatggaggtttgaag

SEQ ID NO: 8974 - DNA, 21 bp, Artificial Sequence
  Target B2M Sequence complement
agcatcatggaggtttgaaga

SEQ ID NO: 8975 - DNA, 21 bp, Artificial Sequence
  Target B2M Sequence complement
gcatcatggaggtttgaagat

SEQ ID NO: 8976 - DNA, 21 bp, Artificial Sequence
  Target B2M Sequence complement
catcatggaggtttgaagatg

SEQ ID NO: 8977 - DNA, 21 bp, Artificial Sequence
  Target B2M Sequence complement
gtttgaagatgccgcatttgg

SEQ ID NO: 8978 - DNA, 21 bp, Artificial Sequence
  Target B2M Sequence complement
tgaagatgccgcatttggatt

SEQ ID NO: 8979 - DNA, 21 bp, Artificial Sequence
  Target B2M Sequence complement
gccgcatttggattggatgaa

SEQ ID NO: 8980 - DNA, 21 bp, Artificial Sequence
  Target B2M Sequence complement
caaattctgcttgcttgcttt

SEQ ID NO: 8981 - DNA, 21 bp, Artificial Sequence
  Target B2M Sequence complement
tgatatgcttatacacttaca

SEQ ID NO: 8982 - DNA, 21 bp, Artificial Sequence
  Target B2M Sequence complement
gatatgcttatacacttacac

SEQ ID NO: 8983 - DNA, 21 bp, Artificial Sequence
  Target B2M Sequence complement
tatgcttatacacttacactt

SEQ ID NO: 8984 - DNA, 21 bp, Artificial Sequence
  Target B2M Sequence complement
atgcttatacacttacacttt

SEQ ID NO: 8985 - DNA, 21 bp, Artificial Sequence
  Target B2M Sequence complement
ttatacacttacactttatgc

SEQ ID NO: 8986 - DNA, 21 bp, Artificial Sequence
  Target B2M Sequence complement
cacttacactttatgcacaaa

SEQ ID NO: 8987 - DNA, 21 bp, Artificial Sequence
  Target B2M Sequence complement
ataatgttaacatggacatga

SEQ ID NO: 8988 - DNA, 21 bp, Artificial Sequence
  Target B2M Sequence complement
taatgttaacatggacatgat

SEQ ID NO: 8989 - DNA, 21 bp, Artificial Sequence
  Target B2M Sequence complement
atgttaacatggacatgatct

SEQ ID NO: 8990 - DNA, 21 bp, Artificial Sequence
  Target B2M Sequence complement
tgttaacatggacatgatctt

SEQ ID NO: 8991 - DNA, 21 bp, Artificial Sequence
  Target B2M Sequence complement
gttaacatggacatgatcttc

SEQ ID NO: 8992 - DNA, 21 bp, Artificial Sequence
  Target B2M Sequence complement
ttaacatggacatgatcttct

SEQ ID NO: 8993 - DNA, 21 bp, Artificial Sequence
  Target B2M Sequence complement
taacatggacatgatcttctt

SEQ ID NO: 8994 - DNA, 21 bp, Artificial Sequence
  Target B2M Sequence complement
tttgagtgctgtctccatgtt

SEQ ID NO: 8995 - DNA, 21 bp, Artificial Sequence
  Target B2M Sequence complement
gagtgctgtctccatgtttga

SEQ ID NO: 8996 - DNA, 21 bp, Artificial Sequence
  Target B2M Sequence complement
gtgctgtctccatgtttgatg

SEQ ID NO: 8997 - DNA, 21 bp, Artificial Sequence
  Target B2M Sequence complement
tgctgtctccatgtttgatgt

SEQ ID NO: 8998 - DNA, 21 bp, Artificial Sequence
  Target B2M Sequence complement
gctgtctccatgtttgatgta

SEQ ID NO: 8999 - DNA, 21 bp, Artificial Sequence
  Target B2M Sequence complement
gtctccatgtttgatgtatct

SEQ ID NO: 9000 - DNA, 21 bp, Artificial Sequence
  Target B2M Sequence complement
tctccatgtttgatgtatctg

SEQ ID NO: 9001 - DNA, 21 bp, Artificial Sequence
  Target B2M Sequence complement
taggagggctggcaacttaga

SEQ ID NO: 9002 - DNA, 21 bp, Artificial Sequence
  Target B2M Sequence complement
attctcttatccaacatcaac

SEQ ID NO: 9003 - DNA, 21 bp, Artificial Sequence
  Target B2M Sequence complement
ttctcttatccaacatcaaca

SEQ ID NO: 9004 - DNA, 21 bp, Artificial Sequence
  Target B2M Sequence complement
tctcttatccaacatcaacat

SEQ ID NO: 9005 - DNA, 21 bp, Artificial Sequence
  Target B2M Sequence complement
ctcttatccaacatcaacatc

SEQ ID NO: 9006 - DNA, 21 bp, Artificial Sequence
  Target B2M Sequence complement
tcttatccaacatcaacatct

SEQ ID NO: 9007 - DNA, 21 bp, Artificial Sequence
  Target B2M Sequence complement
cttatccaacatcaacatctt

SEQ ID NO: 9008 - DNA, 21 bp, Artificial Sequence
  Target B2M Sequence complement
ttatccaacatcaacatcttg

SEQ ID NO: 9009 - DNA, 21 bp, Artificial Sequence
  Target B2M Sequence complement
acatcaacatcttggtcagat

SEQ ID NO: 9010 - DNA, 21 bp, Artificial Sequence
  Target B2M Sequence complement
catcaacatcttggtcagatt

SEQ ID NO: 9011 - DNA, 21 bp, Artificial Sequence
  Target B2M Sequence complement
acatcttggtcagatttgaac

SEQ ID NO: 9012 - DNA, 21 bp, Artificial Sequence
  Target B2M Sequence complement
catcttggtcagatttgaact

SEQ ID NO: 9013 - DNA, 21 bp, Artificial Sequence
  Target B2M Sequence complement
cttggtcagatttgaactctt

SEQ ID NO: 9014 - DNA, 21 bp, Artificial Sequence
  Target B2M Sequence complement
tggtcagatttgaactcttca

SEQ ID NO: 9015 - DNA, 21 bp, Artificial Sequence
  Target B2M Sequence complement
ggtcagatttgaactcttcaa

SEQ ID NO: 9016 - DNA, 21 bp, Artificial Sequence
  Target B2M Sequence complement
atttgaactcttcaatctctt

SEQ ID NO: 9017 - DNA, 21 bp, Artificial Sequence
  Target B2M Sequence complement
tcttcaatctcttgcactcaa

SEQ ID NO: 9018 - DNA, 21 bp, Artificial Sequence
  Target B2M Sequence complement
cttcaatctcttgcactcaaa

SEQ ID NO: 9019 - DNA, 21 bp, Artificial Sequence
  Target B2M Sequence complement
ctcttgcactcaaagcttgtt

SEQ ID NO: 9020 - DNA, 21 bp, Artificial Sequence
  Target B2M Sequence complement
ctcaaagcttgttaagatagt

SEQ ID NO: 9021 - DNA, 21 bp, Artificial Sequence
  Target B2M Sequence complement
agcttgttaagatagttaagc

SEQ ID NO: 9022 - DNA, 21 bp, Artificial Sequence
  Target B2M Sequence complement
taagatagttaagcgtgcata

SEQ ID NO: 9023 - DNA, 21 bp, Artificial Sequence
  Target B2M Sequence complement
gtgcataagttaacttccaat

SEQ ID NO: 9024 - DNA, 21 bp, Artificial Sequence
  Target B2M Sequence complement
taacttccaatttacatactc

SEQ ID NO: 9025 - DNA, 21 bp, Artificial Sequence
  Target B2M Sequence complement
ccaatttacatactctgctta

SEQ ID NO: 9026 - DNA, 21 bp, Artificial Sequence
  Target B2M Sequence complement
catactctgcttagaatttgg

SEQ ID NO: 9027 - DNA, 21 bp, Artificial Sequence
  Target B2M Sequence complement
agtaaggcatggttgtggtta

SEQ ID NO: 9028 - DNA, 21 bp, Artificial Sequence
  Target B2M Sequence complement
ggcatggttgtggttaatctg

SEQ ID NO: 9029 - DNA, 21 bp, Artificial Sequence
  Target B2M Sequence complement
tggttgtggttaatctggttt

SEQ ID NO: 9030 - DNA, 21 bp, Artificial Sequence
  Target B2M Sequence complement
tcctgaagctgacagcattcg

SEQ ID NO: 9031 - DNA, 21 bp, Artificial Sequence
  Target B2M Sequence complement
tctttctggcctggaggctat

SEQ ID NO: 9032 - DNA, 21 bp, Artificial Sequence
  Target B2M Sequence complement
caaagattcaggtttactcac

SEQ ID NO: 9033 - DNA, 21 bp, Artificial Sequence
  Target B2M Sequence complement
attcaggtttactcacgtcat

SEQ ID NO: 9034 - DNA, 21 bp, Artificial Sequence
  Target B2M Sequence complement
ttcaggtttactcacgtcatc

SEQ ID NO: 9035 - DNA, 21 bp, Artificial Sequence
  Target B2M Sequence complement
tcaggtttactcacgtcatcc

SEQ ID NO: 9036 - DNA, 21 bp, Artificial Sequence
  Target B2M Sequence complement
acgtcatccagcagagaatgg

SEQ ID NO: 9037 - DNA, 21 bp, Artificial Sequence
  Target B2M Sequence complement
tttcctgaattgctatgtgtc

SEQ ID NO: 9038 - DNA, 21 bp, Artificial Sequence
  Target B2M Sequence complement
tcctgaattgctatgtgtctg

SEQ ID NO: 9039 - DNA, 21 bp, Artificial Sequence
  Target B2M Sequence complement
ctatgtgtctgggtttcatcc

SEQ ID NO: 9040 - DNA, 21 bp, Artificial Sequence
  Target B2M Sequence complement
tgtgtctgggtttcatccatc

SEQ ID NO: 9041 - DNA, 21 bp, Artificial Sequence
  Target B2M Sequence complement
tgggtttcatccatccgacat

SEQ ID NO: 9042 - DNA, 21 bp, Artificial Sequence
  Target B2M Sequence complement
ccatccgacattgaagttgac

SEQ ID NO: 9043 - DNA, 21 bp, Artificial Sequence
  Target B2M Sequence complement
attgaagttgacttactgaag

SEQ ID NO: 9044 - DNA, 21 bp, Artificial Sequence
  Target B2M Sequence complement
agttgacttactgaagaatgg

SEQ ID NO: 9045 - DNA, 21 bp, Artificial Sequence
  Target B2M Sequence complement
cttactgaagaatggagagag

SEQ ID NO: 9046 - DNA, 21 bp, Artificial Sequence
  Target B2M Sequence complement
agtggagcattcagacttgtc

SEQ ID NO: 9047 - DNA, 21 bp, Artificial Sequence
  Target B2M Sequence complement
tcagacttgtctttcagcaag

SEQ ID NO: 9048 - DNA, 21 bp, Artificial Sequence
  Target B2M Sequence complement
ctttcagcaaggactggtctt

SEQ ID NO: 9049 - DNA, 21 bp, Artificial Sequence
  Target B2M Sequence complement
gactggtctttctatctcttg

SEQ ID NO: 9050 - DNA, 21 bp, Artificial Sequence
  Target B2M Sequence complement
tttctatctcttgtactacac

SEQ ID NO: 9051 - DNA, 21 bp, Artificial Sequence
  Target B2M Sequence complement
tctatctcttgtactacactg

SEQ ID NO: 9052 - DNA, 21 bp, Artificial Sequence
  Target B2M Sequence complement
tgaaccatgtgactttgtcac

SEQ ID NO: 9053 - DNA, 21 bp, Artificial Sequence
  Target B2M Sequence complement
cctgaagctgacagcattcgg

SEQ ID NO: 9054 - DNA, 21 bp, Artificial Sequence
  Target B2M Sequence complement
ctgaagctgacagcattcggg

SEQ ID NO: 9055 - DNA, 21 bp, Artificial Sequence
  Target B2M Sequence complement
tgaagctgacagcattcgggc

SEQ ID NO: 9056 - DNA, 21 bp, Artificial Sequence
  Target B2M Sequence complement
atgtctcgctccgtggcctta

SEQ ID NO: 9057 - DNA, 21 bp, Artificial Sequence
  Target B2M Sequence complement
cttagctgtgctcgcgctact

SEQ ID NO: 9058 - DNA, 21 bp, Artificial Sequence
  Target B2M Sequence complement
ttagctgtgctcgcgctactc

SEQ ID NO: 9059 - DNA, 21 bp, Artificial Sequence
  Target B2M Sequence complement
tagctgtgctcgcgctactct

SEQ ID NO: 9060 - DNA, 21 bp, Artificial Sequence
  Target B2M Sequence complement
tgtgctcgcgctactctctct

SEQ ID NO: 9061 - DNA, 21 bp, Artificial Sequence
  Target B2M Sequence complement
gtgctcgcgctactctctctt

SEQ ID NO: 9062 - DNA, 21 bp, Artificial Sequence
  Target B2M Sequence complement
gctcgcgctactctctctttc

SEQ ID NO: 9063 - DNA, 21 bp, Artificial Sequence
  Target B2M Sequence complement
cgcgctactctctctttctgg

SEQ ID NO: 9064 - DNA, 21 bp, Artificial Sequence
  Target B2M Sequence complement
gcgctactctctctttctggc

SEQ ID NO: 9065 - DNA, 21 bp, Artificial Sequence
  Target B2M Sequence complement
cgctactctctctttctggcc

SEQ ID NO: 9066 - DNA, 21 bp, Artificial Sequence
  Target B2M Sequence complement
gctactctctctttctggcct

SEQ ID NO: 9067 - DNA, 21 bp, Artificial Sequence
  Target B2M Sequence complement
ctactctctctttctggcctg

SEQ ID NO: 9068 - DNA, 21 bp, Artificial Sequence
  Target B2M Sequence complement
tactctctctttctggcctgg

SEQ ID NO: 9069 - DNA, 21 bp, Artificial Sequence
  Target B2M Sequence complement
actctctctttctggcctgga

SEQ ID NO: 9070 - DNA, 21 bp, Artificial Sequence
  Target B2M Sequence complement
ctctctctttctggcctggag

SEQ ID NO: 9071 - DNA, 21 bp, Artificial Sequence
  Target B2M Sequence complement
tctctctttctggcctggagg

SEQ ID NO: 9072 - DNA, 21 bp, Artificial Sequence
  Target B2M Sequence complement
tctctttctggcctggaggct

SEQ ID NO: 9073 - DNA, 21 bp, Artificial Sequence
  Target B2M Sequence complement
ctctttctggcctggaggcta

SEQ ID NO: 9074 - DNA, 21 bp, Artificial Sequence
  Target B2M Sequence complement
ctttctggcctggaggctatc

SEQ ID NO: 9075 - DNA, 21 bp, Artificial Sequence
  Target B2M Sequence complement
tttctggcctggaggctatcc

SEQ ID NO: 9076 - DNA, 21 bp, Artificial Sequence
  Target B2M Sequence complement
ttctggcctggaggctatcca

SEQ ID NO: 9077 - DNA, 21 bp, Artificial Sequence
  Target B2M Sequence complement
ctggaggctatccagcgtact

SEQ ID NO: 9078 - DNA, 21 bp, Artificial Sequence
  Target B2M Sequence complement
tggaggctatccagcgtactc

SEQ ID NO: 9079 - DNA, 21 bp, Artificial Sequence
  Target B2M Sequence complement
gaggctatccagcgtactcca

SEQ ID NO: 9080 - DNA, 21 bp, Artificial Sequence
  Target B2M Sequence complement
aggctatccagcgtactccaa

SEQ ID NO: 9081 - DNA, 21 bp, Artificial Sequence
  Target B2M Sequence complement
agcgtactccaaagattcagg

SEQ ID NO: 9082 - DNA, 21 bp, Artificial Sequence
  Target B2M Sequence complement
gcgtactccaaagattcaggt

SEQ ID NO: 9083 - DNA, 21 bp, Artificial Sequence
  Target B2M Sequence complement
cgtactccaaagattcaggtt

SEQ ID NO: 9084 - DNA, 21 bp, Artificial Sequence
  Target B2M Sequence complement
ccaaagattcaggtttactca

SEQ ID NO: 9085 - DNA, 21 bp, Artificial Sequence
  Target B2M Sequence complement
aaagattcaggtttactcacg

SEQ ID NO: 9086 - DNA, 21 bp, Artificial Sequence
  Target B2M Sequence complement
aagattcaggtttactcacgt

SEQ ID NO: 9087 - DNA, 21 bp, Artificial Sequence
  Target B2M Sequence complement
agattcaggtttactcacgtc

SEQ ID NO: 9088 - DNA, 21 bp, Artificial Sequence
  Target B2M Sequence complement
gattcaggtttactcacgtca

SEQ ID NO: 9089 - DNA, 21 bp, Artificial Sequence
  Target B2M Sequence complement
caggtttactcacgtcatcca

SEQ ID NO: 9090 - DNA, 21 bp, Artificial Sequence
  Target B2M Sequence complement
aggtttactcacgtcatccag

SEQ ID NO: 9091 - DNA, 21 bp, Artificial Sequence
  Target B2M Sequence complement
ggtttactcacgtcatccagc

SEQ ID NO: 9092 - DNA, 21 bp, Artificial Sequence
  Target B2M Sequence complement
gtttactcacgtcatccagca

SEQ ID NO: 9093 - DNA, 21 bp, Artificial Sequence
  Target B2M Sequence complement
tttactcacgtcatccagcag

SEQ ID NO: 9094 - DNA, 21 bp, Artificial Sequence
  Target B2M Sequence complement
ttactcacgtcatccagcaga

SEQ ID NO: 9095 - DNA, 21 bp, Artificial Sequence
  Target B2M Sequence complement
tactcacgtcatccagcagag

SEQ ID NO: 9096 - DNA, 21 bp, Artificial Sequence
  Target B2M Sequence complement
actcacgtcatccagcagaga

SEQ ID NO: 9097 - DNA, 21 bp, Artificial Sequence
  Target B2M Sequence complement
cgtcatccagcagagaatgga

SEQ ID NO: 9098 - DNA, 21 bp, Artificial Sequence
  Target B2M Sequence complement
gtcatccagcagagaatggaa

SEQ ID NO: 9099 - DNA, 21 bp, Artificial Sequence
  Target B2M Sequence complement
ccagcagagaatggaaagtca

SEQ ID NO: 9100 - DNA, 21 bp, Artificial Sequence
  Target B2M Sequence complement
agaatggaaagtcaaatttcc

SEQ ID NO: 9101 - DNA, 21 bp, Artificial Sequence
  Target B2M Sequence complement
gaatggaaagtcaaatttcct

SEQ ID NO: 9102 - DNA, 21 bp, Artificial Sequence
  Target B2M Sequence complement
atggaaagtcaaatttcctga

SEQ ID NO: 9103 - DNA, 21 bp, Artificial Sequence
  Target B2M Sequence complement
tggaaagtcaaatttcctgaa

SEQ ID NO: 9104 - DNA, 21 bp, Artificial Sequence
  Target B2M Sequence complement
ggaaagtcaaatttcctgaat

SEQ ID NO: 9105 - DNA, 21 bp, Artificial Sequence
  Target B2M Sequence complement
gaaagtcaaatttcctgaatt

SEQ ID NO: 9106 - DNA, 21 bp, Artificial Sequence
  Target B2M Sequence complement
aagtcaaatttcctgaattgc

SEQ ID NO: 9107 - DNA, 21 bp, Artificial Sequence
  Target B2M Sequence complement
agtcaaatttcctgaattgct

SEQ ID NO: 9108 - DNA, 21 bp, Artificial Sequence
  Target B2M Sequence complement
gtcaaatttcctgaattgcta

SEQ ID NO: 9109 - DNA, 21 bp, Artificial Sequence
  Target B2M Sequence complement
aaatttcctgaattgctatgt

SEQ ID NO: 9110 - DNA, 21 bp, Artificial Sequence
  Target B2M Sequence complement
atttcctgaattgctatgtgt

SEQ ID NO: 9111 - DNA, 21 bp, Artificial Sequence
  Target B2M Sequence complement
ttcctgaattgctatgtgtct

SEQ ID NO: 9112 - DNA, 21 bp, Artificial Sequence
  Target B2M Sequence complement
cctgaattgctatgtgtctgg

SEQ ID NO: 9113 - DNA, 21 bp, Artificial Sequence
  Target B2M Sequence complement
ctgaattgctatgtgtctggg

SEQ ID NO: 9114 - DNA, 21 bp, Artificial Sequence
  Target B2M Sequence complement
tgaattgctatgtgtctgggt

SEQ ID NO: 9115 - DNA, 21 bp, Artificial Sequence
  Target B2M Sequence complement
gaattgctatgtgtctgggtt

SEQ ID NO: 9116 - DNA, 21 bp, Artificial Sequence
  Target B2M Sequence complement
aattgctatgtgtctgggttt

SEQ ID NO: 9117 - DNA, 21 bp, Artificial Sequence
  Target B2M Sequence complement
tatgtgtctgggtttcatcca

SEQ ID NO: 9118 - DNA, 21 bp, Artificial Sequence
  Target B2M Sequence complement
atgtgtctgggtttcatccat

SEQ ID NO: 9119 - DNA, 21 bp, Artificial Sequence
  Target B2M Sequence complement
gtgtctgggtttcatccatcc

SEQ ID NO: 9120 - DNA, 21 bp, Artificial Sequence
  Target B2M Sequence complement
tgtctgggtttcatccatccg

SEQ ID NO: 9121 - DNA, 21 bp, Artificial Sequence
  Target B2M Sequence complement
gtctgggtttcatccatccga

SEQ ID NO: 9122 - DNA, 21 bp, Artificial Sequence
  Target B2M Sequence complement
tctgggtttcatccatccgac

SEQ ID NO: 9123 - DNA, 21 bp, Artificial Sequence
  Target B2M Sequence complement
ctgggtttcatccatccgaca

SEQ ID NO: 9124 - DNA, 21 bp, Artificial Sequence
  Target B2M Sequence complement
catccgacattgaagttgact

SEQ ID NO: 9125 - DNA, 21 bp, Artificial Sequence
  Target B2M Sequence complement
acattgaagttgacttactga

SEQ ID NO: 9126 - DNA, 21 bp, Artificial Sequence
  Target B2M Sequence complement
gttgacttactgaagaatgga

SEQ ID NO: 9127 - DNA, 21 bp, Artificial Sequence
  Target B2M Sequence complement
ttgacttactgaagaatggag

SEQ ID NO: 9128 - DNA, 21 bp, Artificial Sequence
  Target B2M Sequence complement
tgacttactgaagaatggaga

SEQ ID NO: 9129 - DNA, 21 bp, Artificial Sequence
  Target B2M Sequence complement
gacttactgaagaatggagag

SEQ ID NO: 9130 - DNA, 21 bp, Artificial Sequence
  Target B2M Sequence complement
acttactgaagaatggagaga

SEQ ID NO: 9131 - DNA, 21 bp, Artificial Sequence
  Target B2M Sequence complement
ttactgaagaatggagagaga

SEQ ID NO: 9132 - DNA, 21 bp, Artificial Sequence
  Target B2M Sequence complement
ctgaagaatggagagagaatt

SEQ ID NO: 9133 - DNA, 21 bp, Artificial Sequence
  Target B2M Sequence complement
gtggagcattcagacttgtct

SEQ ID NO: 9134 - DNA, 21 bp, Artificial Sequence
  Target B2M Sequence complement
cattcagacttgtctttcagc

SEQ ID NO: 9135 - DNA, 21 bp, Artificial Sequence
  Target B2M Sequence complement
attcagacttgtctttcagca

SEQ ID NO: 9136 - DNA, 21 bp, Artificial Sequence
  Target B2M Sequence complement
ttcagacttgtctttcagcaa

SEQ ID NO: 9137 - DNA, 21 bp, Artificial Sequence
  Target B2M Sequence complement
cagacttgtctttcagcaagg

SEQ ID NO: 9138 - DNA, 21 bp, Artificial Sequence
  Target B2M Sequence complement
agacttgtctttcagcaagga

SEQ ID NO: 9139 - DNA, 21 bp, Artificial Sequence
  Target B2M Sequence complement
gacttgtctttcagcaaggac

SEQ ID NO: 9140 - DNA, 21 bp, Artificial Sequence
  Target B2M Sequence complement
acttgtctttcagcaaggact

SEQ ID NO: 9141 - DNA, 21 bp, Artificial Sequence
  Target B2M Sequence complement
cttgtctttcagcaaggactg

SEQ ID NO: 9142 - DNA, 21 bp, Artificial Sequence
  Target B2M Sequence complement
ttgtctttcagcaaggactgg

SEQ ID NO: 9143 - DNA, 21 bp, Artificial Sequence
  Target B2M Sequence complement
tgtctttcagcaaggactggt

SEQ ID NO: 9144 - DNA, 21 bp, Artificial Sequence
  Target B2M Sequence complement
gtctttcagcaaggactggtc

SEQ ID NO: 9145 - DNA, 21 bp, Artificial Sequence
  Target B2M Sequence complement
tctttcagcaaggactggtct

SEQ ID NO: 9146 - DNA, 21 bp, Artificial Sequence
  Target B2M Sequence complement
aggactggtctttctatctct

SEQ ID NO: 9147 - DNA, 21 bp, Artificial Sequence
  Target B2M Sequence complement
ttctatctcttgtactacact

SEQ ID NO: 9148 - DNA, 21 bp, Artificial Sequence
  Target B2M Sequence complement
ctatctcttgtactacactga

SEQ ID NO: 9149 - DNA, 21 bp, Artificial Sequence
  Target B2M Sequence complement
tctcttgtactacactgaatt

SEQ ID NO: 9150 - DNA, 21 bp, Artificial Sequence
  Target B2M Sequence complement
ctcttgtactacactgaattc

SEQ ID NO: 9151 - DNA, 21 bp, Artificial Sequence
  Target B2M Sequence complement
tcttgtactacactgaattca

SEQ ID NO: 9152 - DNA, 21 bp, Artificial Sequence
  Target B2M Sequence complement
cttgtactacactgaattcac

SEQ ID NO: 9153 - DNA, 21 bp, Artificial Sequence
  Target B2M Sequence complement
ttgtactacactgaattcacc

SEQ ID NO: 9154 - DNA, 21 bp, Artificial Sequence
  Target B2M Sequence complement
tgtactacactgaattcaccc

SEQ ID NO: 9155 - DNA, 21 bp, Artificial Sequence
  Target B2M Sequence complement
aaagatgagtatgcctgccgt

SEQ ID NO: 9156 - DNA, 21 bp, Artificial Sequence
  Target B2M Sequence complement
agatgagtatgcctgccgtgt

SEQ ID NO: 9157 - DNA, 21 bp, Artificial Sequence
  Target B2M Sequence complement
gatgagtatgcctgccgtgtg

SEQ ID NO: 9158 - DNA, 21 bp, Artificial Sequence
  Target B2M Sequence complement
atgagtatgcctgccgtgtga

SEQ ID NO: 9159 - DNA, 21 bp, Artificial Sequence
  Target B2M Sequence complement
gagtatgcctgccgtgtgaac

SEQ ID NO: 9160 - DNA, 21 bp, Artificial Sequence
  Target B2M Sequence complement
agtatgcctgccgtgtgaacc

SEQ ID NO: 9161 - DNA, 21 bp, Artificial Sequence
  Target B2M Sequence complement
gtatgcctgccgtgtgaacca

SEQ ID NO: 9162 - DNA, 21 bp, Artificial Sequence
  Target B2M Sequence complement
tatgcctgccgtgtgaaccat

SEQ ID NO: 9163 - DNA, 21 bp, Artificial Sequence
  Target B2M Sequence complement
atgcctgccgtgtgaaccatg

SEQ ID NO: 9164 - DNA, 21 bp, Artificial Sequence
  Target B2M Sequence complement
tgcctgccgtgtgaaccatgt

SEQ ID NO: 9165 - DNA, 21 bp, Artificial Sequence
  Target B2M Sequence complement
cctgccgtgtgaaccatgtga

SEQ ID NO: 9166 - DNA, 21 bp, Artificial Sequence
  Target B2M Sequence complement
ctgccgtgtgaaccatgtgac

SEQ ID NO: 9167 - DNA, 21 bp, Artificial Sequence
  Target B2M Sequence complement
tgccgtgtgaaccatgtgact

SEQ ID NO: 9168 - DNA, 21 bp, Artificial Sequence
  Target B2M Sequence complement
gtgaaccatgtgactttgtca

SEQ ID NO: 9169 - DNA, 21 bp, Artificial Sequence
  Target B2M Sequence complement
gaaccatgtgactttgtcaca

SEQ ID NO: 9170 - DNA, 21 bp, Artificial Sequence
  Target B2M Sequence complement
accatgtgactttgtcacagc

SEQ ID NO: 9171 - DNA, 21 bp, Artificial Sequence
  Target B2M Sequence complement
ccatgtgactttgtcacagcc

SEQ ID NO: 9172 - DNA, 21 bp, Artificial Sequence
  Target B2M Sequence complement
catgtgactttgtcacagccc

SEQ ID NO: 9173 - DNA, 21 bp, Artificial Sequence
  Target B2M Sequence complement
atgtgactttgtcacagccca

SEQ ID NO: 9174 - DNA, 21 bp, Artificial Sequence
  Target B2M Sequence complement
tgtgactttgtcacagcccaa

SEQ ID NO: 9175 - DNA, 21 bp, Artificial Sequence
  Target B2M Sequence complement
gtgactttgtcacagcccaag

SEQ ID NO: 9176 - DNA, 21 bp, Artificial Sequence
  Target B2M Sequence complement
tgactttgtcacagcccaaga

SEQ ID NO: 9177 - DNA, 21 bp, Artificial Sequence
  Target B2M Sequence complement
cagcccaagatagttaagtgg

SEQ ID NO: 9178 - DNA, 21 bp, Artificial Sequence
  Target B2M Sequence complement
agcccaagatagttaagtggg

SEQ ID NO: 9179 - DNA, 21 bp, Artificial Sequence
  Target B2M Sequence complement
gcccaagatagttaagtggga

SEQ ID NO: 9180 - DNA, 21 bp, Artificial Sequence
  Target B2M Sequence complement
ccaagatagttaagtgggatc

SEQ ID NO: 9181 - DNA, 21 bp, Artificial Sequence
  Target B2M Sequence complement
caagatagttaagtgggatcg

SEQ ID NO: 9182 - DNA, 21 bp, Artificial Sequence
  Target B2M Sequence complement
aagatagttaagtgggatcga

SEQ ID NO: 9183 - DNA, 21 bp, Artificial Sequence
  Target B2M Sequence complement
agatagttaagtgggatcgag

SEQ ID NO: 9184 - DNA, 21 bp, Artificial Sequence
  Target B2M Sequence complement
gatagttaagtgggatcgaga

SEQ ID NO: 9185 - DNA, 21 bp, Artificial Sequence
  Target B2M Sequence complement
atagttaagtgggatcgagac

SEQ ID NO: 9186 - DNA, 21 bp, Artificial Sequence
  Target B2M Sequence complement
tagttaagtgggatcgagaca

SEQ ID NO: 9187 - DNA, 21 bp, Artificial Sequence
  Target B2M Sequence complement
gttaagtgggatcgagacatg

SEQ ID NO: 9188 - DNA, 21 bp, Artificial Sequence
  Target B2M Sequence complement
aagtgggatcgagacatgtaa

SEQ ID NO: 9189 - DNA, 21 bp, Artificial Sequence
  Target B2M Sequence complement
gtgggatcgagacatgtaagc

SEQ ID NO: 9190 - DNA, 21 bp, Artificial Sequence
  Target B2M Sequence complement
tgggatcgagacatgtaagca

SEQ ID NO: 9191 - DNA, 21 bp, Artificial Sequence
  Target B2M Sequence complement
gggatcgagacatgtaagcag

SEQ ID NO: 9192 - DNA, 21 bp, Artificial Sequence
  Target B2M Sequence complement
ggatcgagacatgtaagcagc

SEQ ID NO: 9193 - DNA, 21 bp, Artificial Sequence
  Target B2M Sequence complement
gatcgagacatgtaagcagca

SEQ ID NO: 9194 - DNA, 21 bp, Artificial Sequence
  Target B2M Sequence complement
atcgagacatgtaagcagcat

SEQ ID NO: 9195 - DNA, 21 bp, Artificial Sequence
  Target B2M Sequence complement
tcgagacatgtaagcagcatc

SEQ ID NO: 9196 - DNA, 21 bp, Artificial Sequence
  Target B2M Sequence complement
cgagacatgtaagcagcatca

SEQ ID NO: 9197 - DNA, 21 bp, Artificial Sequence
  Target B2M Sequence complement
gacatgtaagcagcatcatgg

SEQ ID NO: 9198 - DNA, 21 bp, Artificial Sequence
  Target B2M Sequence complement
acatgtaagcagcatcatgga

SEQ ID NO: 9199 - DNA, 21 bp, Artificial Sequence
  Target B2M Sequence complement
catgtaagcagcatcatggag

SEQ ID NO: 9200 - DNA, 21 bp, Artificial Sequence
  Target B2M Sequence complement
atgtaagcagcatcatggagg

SEQ ID NO: 9201 - DNA, 21 bp, Artificial Sequence
  Target B2M Sequence complement
tgtaagcagcatcatggaggt

SEQ ID NO: 9202 - DNA, 21 bp, Artificial Sequence
  Target B2M Sequence complement
gtaagcagcatcatggaggtt

SEQ ID NO: 9203 - DNA, 21 bp, Artificial Sequence
  Target B2M Sequence complement
atcatggaggtttgaagatgc

SEQ ID NO: 9204 - DNA, 21 bp, Artificial Sequence
  Target B2M Sequence complement
tcatggaggtttgaagatgcc

SEQ ID NO: 9205 - DNA, 21 bp, Artificial Sequence
  Target B2M Sequence complement
catggaggtttgaagatgccg

SEQ ID NO: 9206 - DNA, 21 bp, Artificial Sequence
  Target B2M Sequence complement
atggaggtttgaagatgccgc

SEQ ID NO: 9207 - DNA, 21 bp, Artificial Sequence
  Target B2M Sequence complement
tggaggtttgaagatgccgca

SEQ ID NO: 9208 - DNA, 21 bp, Artificial Sequence
  Target B2M Sequence complement
ggaggtttgaagatgccgcat

SEQ ID NO: 9209 - DNA, 21 bp, Artificial Sequence
  Target B2M Sequence complement
gaggtttgaagatgccgcatt

SEQ ID NO: 9210 - DNA, 21 bp, Artificial Sequence
  Target B2M Sequence complement
tttgaagatgccgcatttgga

SEQ ID NO: 9211 - DNA, 21 bp, Artificial Sequence
  Target B2M Sequence complement
ttgaagatgccgcatttggat

SEQ ID NO: 9212 - DNA, 21 bp, Artificial Sequence
  Target B2M Sequence complement
agatgccgcatttggattgga

SEQ ID NO: 9213 - DNA, 21 bp, Artificial Sequence
  Target B2M Sequence complement
gatgccgcatttggattggat

SEQ ID NO: 9214 - DNA, 21 bp, Artificial Sequence
  Target B2M Sequence complement
atgccgcatttggattggatg

SEQ ID NO: 9215 - DNA, 21 bp, Artificial Sequence
  Target B2M Sequence complement
tgccgcatttggattggatga

SEQ ID NO: 9216 - DNA, 21 bp, Artificial Sequence
  Target B2M Sequence complement
cgcatttggattggatgaatt

SEQ ID NO: 9217 - DNA, 21 bp, Artificial Sequence
  Target B2M Sequence complement
gcatttggattggatgaattc

SEQ ID NO: 9218 - DNA, 21 bp, Artificial Sequence
  Target B2M Sequence complement
catttggattggatgaattcc

SEQ ID NO: 9219 - DNA, 21 bp, Artificial Sequence
  Target B2M Sequence complement
atttggattggatgaattcca

SEQ ID NO: 9220 - DNA, 21 bp, Artificial Sequence
  Target B2M Sequence complement
tttggattggatgaattccaa

SEQ ID NO: 9221 - DNA, 21 bp, Artificial Sequence
  Target B2M Sequence complement
ttggattggatgaattccaaa

SEQ ID NO: 9222 - DNA, 21 bp, Artificial Sequence
  Target B2M Sequence complement
tggattggatgaattccaaat

SEQ ID NO: 9223 - DNA, 21 bp, Artificial Sequence
  Target B2M Sequence complement
ggattggatgaattccaaatt

SEQ ID NO: 9224 - DNA, 21 bp, Artificial Sequence
  Target B2M Sequence complement
gattggatgaattccaaattc

SEQ ID NO: 9225 - DNA, 21 bp, Artificial Sequence
  Target B2M Sequence complement
attggatgaattccaaattct

SEQ ID NO: 9226 - DNA, 21 bp, Artificial Sequence
  Target B2M Sequence complement
ttggatgaattccaaattctg

SEQ ID NO: 9227 - DNA, 21 bp, Artificial Sequence
  Target B2M Sequence complement
tggatgaattccaaattctgc

SEQ ID NO: 9228 - DNA, 21 bp, Artificial Sequence
  Target B2M Sequence complement
ggatgaattccaaattctgct

SEQ ID NO: 9229 - DNA, 21 bp, Artificial Sequence
  Target B2M Sequence complement
gatgaattccaaattctgctt

SEQ ID NO: 9230 - DNA, 21 bp, Artificial Sequence
  Target B2M Sequence complement
atgaattccaaattctgcttg

SEQ ID NO: 9231 - DNA, 21 bp, Artificial Sequence
  Target B2M Sequence complement
tgaattccaaattctgcttgc

SEQ ID NO: 9232 - DNA, 21 bp, Artificial Sequence
  Target B2M Sequence complement
gaattccaaattctgcttgct

SEQ ID NO: 9233 - DNA, 21 bp, Artificial Sequence
  Target B2M Sequence complement
aattccaaattctgcttgctt

SEQ ID NO: 9234 - DNA, 21 bp, Artificial Sequence
  Target B2M Sequence complement
attccaaattctgcttgcttg

SEQ ID NO: 9235 - DNA, 21 bp, Artificial Sequence
  Target B2M Sequence complement
ttccaaattctgcttgcttgc

SEQ ID NO: 9236 - DNA, 21 bp, Artificial Sequence
  Target B2M Sequence complement
tccaaattctgcttgcttgct

SEQ ID NO: 9237 - DNA, 21 bp, Artificial Sequence
  Target B2M Sequence complement
ccaaattctgcttgcttgctt

SEQ ID NO: 9238 - DNA, 21 bp, Artificial Sequence
  Target B2M Sequence complement
atatgcttatacacttacact

SEQ ID NO: 9239 - DNA, 21 bp, Artificial Sequence
  Target B2M Sequence complement
tatacacttacactttatgca

SEQ ID NO: 9240 - DNA, 21 bp, Artificial Sequence
  Target B2M Sequence complement
atacacttacactttatgcac

SEQ ID NO: 9241 - DNA, 21 bp, Artificial Sequence
  Target B2M Sequence complement
tacacttacactttatgcaca

SEQ ID NO: 9242 - DNA, 21 bp, Artificial Sequence
  Target B2M Sequence complement
acacttacactttatgcacaa

SEQ ID NO: 9243 - DNA, 21 bp, Artificial Sequence
  Target B2M Sequence complement
aataatgttaacatggacatg

SEQ ID NO: 9244 - DNA, 21 bp, Artificial Sequence
  Target B2M Sequence complement
aatgttaacatggacatgatc

SEQ ID NO: 9245 - DNA, 21 bp, Artificial Sequence
  Target B2M Sequence complement
aacatggacatgatcttcttt

SEQ ID NO: 9246 - DNA, 21 bp, Artificial Sequence
  Target B2M Sequence complement
ttataattctactttgagtgc

SEQ ID NO: 9247 - DNA, 21 bp, Artificial Sequence
  Target B2M Sequence complement
tataattctactttgagtgct

SEQ ID NO: 9248 - DNA, 21 bp, Artificial Sequence
  Target B2M Sequence complement
ataattctactttgagtgctg

SEQ ID NO: 9249 - DNA, 21 bp, Artificial Sequence
  Target B2M Sequence complement
taattctactttgagtgctgt

SEQ ID NO: 9250 - DNA, 21 bp, Artificial Sequence
  Target B2M Sequence complement
aattctactttgagtgctgtc

SEQ ID NO: 9251 - DNA, 21 bp, Artificial Sequence
  Target B2M Sequence complement
attctactttgagtgctgtct

SEQ ID NO: 9252 - DNA, 21 bp, Artificial Sequence
  Target B2M Sequence complement
ttctactttgagtgctgtctc

SEQ ID NO: 9253 - DNA, 21 bp, Artificial Sequence
  Target B2M Sequence complement
tctactttgagtgctgtctcc

SEQ ID NO: 9254 - DNA, 21 bp, Artificial Sequence
  Target B2M Sequence complement
ctactttgagtgctgtctcca

SEQ ID NO: 9255 - DNA, 21 bp, Artificial Sequence
  Target B2M Sequence complement
tactttgagtgctgtctccat

SEQ ID NO: 9256 - DNA, 21 bp, Artificial Sequence
  Target B2M Sequence complement
actttgagtgctgtctccatg

SEQ ID NO: 9257 - DNA, 21 bp, Artificial Sequence
  Target B2M Sequence complement
ctttgagtgctgtctccatgt

SEQ ID NO: 9258 - DNA, 21 bp, Artificial Sequence
  Target B2M Sequence complement
ctccatgtttgatgtatctga

SEQ ID NO: 9259 - DNA, 21 bp, Artificial Sequence
  Target B2M Sequence complement
tccatgtttgatgtatctgag

SEQ ID NO: 9260 - DNA, 21 bp, Artificial Sequence
  Target B2M Sequence complement
ccatgtttgatgtatctgagc

SEQ ID NO: 9261 - DNA, 21 bp, Artificial Sequence
  Target B2M Sequence complement
catgtttgatgtatctgagca

SEQ ID NO: 9262 - DNA, 21 bp, Artificial Sequence
  Target B2M Sequence complement
atgtttgatgtatctgagcag

SEQ ID NO: 9263 - DNA, 21 bp, Artificial Sequence
  Target B2M Sequence complement
tgtttgatgtatctgagcagg

SEQ ID NO: 9264 - DNA, 21 bp, Artificial Sequence
  Target B2M Sequence complement
gtttgatgtatctgagcaggt

SEQ ID NO: 9265 - DNA, 21 bp, Artificial Sequence
  Target B2M Sequence complement
tttgatgtatctgagcaggtt

SEQ ID NO: 9266 - DNA, 21 bp, Artificial Sequence
  Target B2M Sequence complement
ttgatgtatctgagcaggttg

SEQ ID NO: 9267 - DNA, 21 bp, Artificial Sequence
  Target B2M Sequence complement
tgatgtatctgagcaggttgc

SEQ ID NO: 9268 - DNA, 21 bp, Artificial Sequence
  Target B2M Sequence complement
gatgtatctgagcaggttgct

SEQ ID NO: 9269 - DNA, 21 bp, Artificial Sequence
  Target B2M Sequence complement
atgtatctgagcaggttgctc

SEQ ID NO: 9270 - DNA, 21 bp, Artificial Sequence
  Target B2M Sequence complement
tgtatctgagcaggttgctcc

SEQ ID NO: 9271 - DNA, 21 bp, Artificial Sequence
  Target B2M Sequence complement
gtatctgagcaggttgctcca

SEQ ID NO: 9272 - DNA, 21 bp, Artificial Sequence
  Target B2M Sequence complement
tatctgagcaggttgctccac

SEQ ID NO: 9273 - DNA, 21 bp, Artificial Sequence
  Target B2M Sequence complement
atctgagcaggttgctccaca

SEQ ID NO: 9274 - DNA, 21 bp, Artificial Sequence
  Target B2M Sequence complement
tctgagcaggttgctccacag

SEQ ID NO: 9275 - DNA, 21 bp, Artificial Sequence
  Target B2M Sequence complement
tgagcaggttgctccacaggt

SEQ ID NO: 9276 - DNA, 21 bp, Artificial Sequence
  Target B2M Sequence complement
gagcaggttgctccacaggta

SEQ ID NO: 9277 - DNA, 21 bp, Artificial Sequence
  Target B2M Sequence complement
agcaggttgctccacaggtag

SEQ ID NO: 9278 - DNA, 21 bp, Artificial Sequence
  Target B2M Sequence complement
caggttgctccacaggtagct

SEQ ID NO: 9279 - DNA, 21 bp, Artificial Sequence
  Target B2M Sequence complement
aggttgctccacaggtagctc

SEQ ID NO: 9280 - DNA, 21 bp, Artificial Sequence
  Target B2M Sequence complement
ttgctccacaggtagctctag

SEQ ID NO: 9281 - DNA, 21 bp, Artificial Sequence
  Target B2M Sequence complement
tgctccacaggtagctctagg

SEQ ID NO: 9282 - DNA, 21 bp, Artificial Sequence
  Target B2M Sequence complement
ctccacaggtagctctaggag

SEQ ID NO: 9283 - DNA, 21 bp, Artificial Sequence
  Target B2M Sequence complement
tccacaggtagctctaggagg

SEQ ID NO: 9284 - DNA, 21 bp, Artificial Sequence
  Target B2M Sequence complement
acaggtagctctaggagggct

SEQ ID NO: 9285 - DNA, 21 bp, Artificial Sequence
  Target B2M Sequence complement
tagctctaggagggctggcaa

SEQ ID NO: 9286 - DNA, 21 bp, Artificial Sequence
  Target B2M Sequence complement
ctctaggagggctggcaactt

SEQ ID NO: 9287 - DNA, 21 bp, Artificial Sequence
  Target B2M Sequence complement
ctaggagggctggcaacttag

SEQ ID NO: 9288 - DNA, 21 bp, Artificial Sequence
  Target B2M Sequence complement
aggagggctggcaacttagag

SEQ ID NO: 9289 - DNA, 21 bp, Artificial Sequence
  Target B2M Sequence complement
gagggctggcaacttagaggt

SEQ ID NO: 9290 - DNA, 21 bp, Artificial Sequence
  Target B2M Sequence complement
agggctggcaacttagaggtg

SEQ ID NO: 9291 - DNA, 21 bp, Artificial Sequence
  Target B2M Sequence complement
agcagagaattctcttatcca

SEQ ID NO: 9292 - DNA, 21 bp, Artificial Sequence
  Target B2M Sequence complement
gcagagaattctcttatccaa

SEQ ID NO: 9293 - DNA, 21 bp, Artificial Sequence
  Target B2M Sequence complement
cagagaattctcttatccaac

SEQ ID NO: 9294 - DNA, 21 bp, Artificial Sequence
  Target B2M Sequence complement
agagaattctcttatccaaca

SEQ ID NO: 9295 - DNA, 21 bp, Artificial Sequence
  Target B2M Sequence complement
agaattctcttatccaacatc

SEQ ID NO: 9296 - DNA, 21 bp, Artificial Sequence
  Target B2M Sequence complement
tatccaacatcaacatcttgg

SEQ ID NO: 9297 - DNA, 21 bp, Artificial Sequence
  Target B2M Sequence complement
atccaacatcaacatcttggt

SEQ ID NO: 9298 - DNA, 21 bp, Artificial Sequence
  Target B2M Sequence complement
tccaacatcaacatcttggtc

SEQ ID NO: 9299 - DNA, 21 bp, Artificial Sequence
  Target B2M Sequence complement
ccaacatcaacatcttggtca

SEQ ID NO: 9300 - DNA, 21 bp, Artificial Sequence
  Target B2M Sequence complement
caacatcaacatcttggtcag

SEQ ID NO: 9301 - DNA, 21 bp, Artificial Sequence
  Target B2M Sequence complement
atcttggtcagatttgaactc

SEQ ID NO: 9302 - DNA, 21 bp, Artificial Sequence
  Target B2M Sequence complement
tcttggtcagatttgaactct

SEQ ID NO: 9303 - DNA, 21 bp, Artificial Sequence
  Target B2M Sequence complement
ttggtcagatttgaactcttc

SEQ ID NO: 9304 - DNA, 21 bp, Artificial Sequence
  Target B2M Sequence complement
cagatttgaactcttcaatct

SEQ ID NO: 9305 - DNA, 21 bp, Artificial Sequence
  Target B2M Sequence complement
agatttgaactcttcaatctc

SEQ ID NO: 9306 - DNA, 21 bp, Artificial Sequence
  Target B2M Sequence complement
gatttgaactcttcaatctct

SEQ ID NO: 9307 - DNA, 21 bp, Artificial Sequence
  Target B2M Sequence complement
tttgaactcttcaatctcttg

SEQ ID NO: 9308 - DNA, 21 bp, Artificial Sequence
  Target B2M Sequence complement
ttgaactcttcaatctcttgc

SEQ ID NO: 9309 - DNA, 21 bp, Artificial Sequence
  Target B2M Sequence complement
tgaactcttcaatctcttgca

SEQ ID NO: 9310 - DNA, 21 bp, Artificial Sequence
  Target B2M Sequence complement
gaactcttcaatctcttgcac

SEQ ID NO: 9311 - DNA, 21 bp, Artificial Sequence
  Target B2M Sequence complement
actcttcaatctcttgcactc

SEQ ID NO: 9312 - DNA, 21 bp, Artificial Sequence
  Target B2M Sequence complement
ctcttcaatctcttgcactca

SEQ ID NO: 9313 - DNA, 21 bp, Artificial Sequence
  Target B2M Sequence complement
tcaatctcttgcactcaaagc

SEQ ID NO: 9314 - DNA, 21 bp, Artificial Sequence
  Target B2M Sequence complement
caatctcttgcactcaaagct

SEQ ID NO: 9315 - DNA, 21 bp, Artificial Sequence
  Target B2M Sequence complement
aatctcttgcactcaaagctt

SEQ ID NO: 9316 - DNA, 21 bp, Artificial Sequence
  Target B2M Sequence complement
atctcttgcactcaaagcttg

SEQ ID NO: 9317 - DNA, 21 bp, Artificial Sequence
  Target B2M Sequence complement
tctcttgcactcaaagcttgt

SEQ ID NO: 9318 - DNA, 21 bp, Artificial Sequence
  Target B2M Sequence complement
gcttgttaagatagttaagcg

SEQ ID NO: 9319 - DNA, 21 bp, Artificial Sequence
  Target B2M Sequence complement
cttgttaagatagttaagcgt

SEQ ID NO: 9320 - DNA, 21 bp, Artificial Sequence
  Target B2M Sequence complement
ttgttaagatagttaagcgtg

SEQ ID NO: 9321 - DNA, 21 bp, Artificial Sequence
  Target B2M Sequence complement
tgttaagatagttaagcgtgc

SEQ ID NO: 9322 - DNA, 21 bp, Artificial Sequence
  Target B2M Sequence complement
gttaagatagttaagcgtgca

SEQ ID NO: 9323 - DNA, 21 bp, Artificial Sequence
  Target B2M Sequence complement
ttaagatagttaagcgtgcat

SEQ ID NO: 9324 - DNA, 21 bp, Artificial Sequence
  Target B2M Sequence complement
gttaagcgtgcataagttaac

SEQ ID NO: 9325 - DNA, 21 bp, Artificial Sequence
  Target B2M Sequence complement
agcgtgcataagttaacttcc

SEQ ID NO: 9326 - DNA, 21 bp, Artificial Sequence
  Target B2M Sequence complement
gcgtgcataagttaacttcca

SEQ ID NO: 9327 - DNA, 21 bp, Artificial Sequence
  Target B2M Sequence complement
cgtgcataagttaacttccaa

SEQ ID NO: 9328 - DNA, 21 bp, Artificial Sequence
  Target B2M Sequence complement
acttccaatttacatactctg

SEQ ID NO: 9329 - DNA, 21 bp, Artificial Sequence
  Target B2M Sequence complement
cttccaatttacatactctgc

SEQ ID NO: 9330 - DNA, 21 bp, Artificial Sequence
  Target B2M Sequence complement
ttccaatttacatactctgct

SEQ ID NO: 9331 - DNA, 21 bp, Artificial Sequence
  Target B2M Sequence complement
tccaatttacatactctgctt

SEQ ID NO: 9332 - DNA, 21 bp, Artificial Sequence
  Target B2M Sequence complement
ttacatactctgcttagaatt

SEQ ID NO: 9333 - DNA, 21 bp, Artificial Sequence
  Target B2M Sequence complement
atactctgcttagaatttggg

SEQ ID NO: 9334 - DNA, 21 bp, Artificial Sequence
  Target B2M Sequence complement
tataattgacaggattattgg

SEQ ID NO: 9335 - DNA, 21 bp, Artificial Sequence
  Target B2M Sequence complement
ataattgacaggattattgga

SEQ ID NO: 9336 - DNA, 21 bp, Artificial Sequence
  Target B2M Sequence complement
taattgacaggattattggaa

SEQ ID NO: 9337 - DNA, 21 bp, Artificial Sequence
  Target B2M Sequence complement
atacatttgataaagtaaggc

SEQ ID NO: 9338 - DNA, 21 bp, Artificial Sequence
  Target B2M Sequence complement
tacatttgataaagtaaggca

SEQ ID NO: 9339 - DNA, 21 bp, Artificial Sequence
  Target B2M Sequence complement
acatttgataaagtaaggcat

SEQ ID NO: 9340 - DNA, 21 bp, Artificial Sequence
  Target B2M Sequence complement
catttgataaagtaaggcatg

SEQ ID NO: 9341 - DNA, 21 bp, Artificial Sequence
  Target B2M Sequence complement
atttgataaagtaaggcatgg

SEQ ID NO: 9342 - DNA, 21 bp, Artificial Sequence
  Target B2M Sequence complement
tttgataaagtaaggcatggt

SEQ ID NO: 9343 - DNA, 21 bp, Artificial Sequence
  Target B2M Sequence complement
ttgataaagtaaggcatggtt

SEQ ID NO: 9344 - DNA, 21 bp, Artificial Sequence
  Target B2M Sequence complement
tgataaagtaaggcatggttg

SEQ ID NO: 9345 - DNA, 21 bp, Artificial Sequence
  Target B2M Sequence complement
gataaagtaaggcatggttgt

SEQ ID NO: 9346 - DNA, 21 bp, Artificial Sequence
  Target B2M Sequence complement
ataaagtaaggcatggttgtg

SEQ ID NO: 9347 - DNA, 21 bp, Artificial Sequence
  Target B2M Sequence complement
taaagtaaggcatggttgtgg

SEQ ID NO: 9348 - DNA, 21 bp, Artificial Sequence
  Target B2M Sequence complement
aaagtaaggcatggttgtggt

SEQ ID NO: 9349 - DNA, 21 bp, Artificial Sequence
  Target B2M Sequence complement
aagtaaggcatggttgtggtt

SEQ ID NO: 9350 - DNA, 21 bp, Artificial Sequence
  Target B2M Sequence complement
gcatggttgtggttaatctgg

SEQ ID NO: 9351 - DNA, 21 bp, Artificial Sequence
  Target B2M Sequence complement
catggttgtggttaatctggt

SEQ ID NO: 9352 - DNA, 21 bp, Artificial Sequence
  Target B2M Sequence complement
atggttgtggttaatctggtt

SEQ ID NO: 9353 - DNA, 18 bp, Artificial Sequence
  Target B2M Sequence complement
attcctgaagctgacagc

SEQ ID NO: 9354 - DNA, 18 bp, Artificial Sequence
  Target B2M Sequence complement
ttcctgaagctgacagca

SEQ ID NO: 9355 - DNA, 18 bp, Artificial Sequence
  Target B2M Sequence complement
tcctgaagctgacagcat

SEQ ID NO: 9356 - DNA, 18 bp, Artificial Sequence
  Target B2M Sequence complement
cctgaagctgacagcatt

SEQ ID NO: 9357 - DNA, 18 bp, Artificial Sequence
  Target B2M Sequence complement
ctgaagctgacagcattc

SEQ ID NO: 9358 - DNA, 18 bp, Artificial Sequence
  Target B2M Sequence complement
tgaagctgacagcattcg

SEQ ID NO: 9359 - DNA, 18 bp, Artificial Sequence
  Target B2M Sequence complement
gaagctgacagcattcgg

SEQ ID NO: 9360 - DNA, 18 bp, Artificial Sequence
  Target B2M Sequence complement
aagctgacagcattcggg

SEQ ID NO: 9361 - DNA, 18 bp, Artificial Sequence
  Target B2M Sequence complement
ttagctgtgctcgcgcta

SEQ ID NO: 9362 - DNA, 18 bp, Artificial Sequence
  Target B2M Sequence complement
ctcgcgctactctctctt

SEQ ID NO: 9363 - DNA, 18 bp, Artificial Sequence
  Target B2M Sequence complement
tcgcgctactctctcttt

SEQ ID NO: 9364 - DNA, 18 bp, Artificial Sequence
  Target B2M Sequence complement
cgcgctactctctctttc

SEQ ID NO: 9365 - DNA, 18 bp, Artificial Sequence
  Target B2M Sequence complement
gcgctactctctctttct

SEQ ID NO: 9366 - DNA, 18 bp, Artificial Sequence
  Target B2M Sequence complement
cgctactctctctttctg

SEQ ID NO: 9367 - DNA, 18 bp, Artificial Sequence
  Target B2M Sequence complement
gctactctctctttctgg

SEQ ID NO: 9368 - DNA, 18 bp, Artificial Sequence
  Target B2M Sequence complement
ctactctctctttctggc

SEQ ID NO: 9369 - DNA, 18 bp, Artificial Sequence
  Target B2M Sequence complement
tactctctctttctggcc

SEQ ID NO: 9370 - DNA, 18 bp, Artificial Sequence
  Target B2M Sequence complement
actctctctttctggcct

SEQ ID NO: 9371 - DNA, 18 bp, Artificial Sequence
  Target B2M Sequence complement
ctctctctttctggcctg

SEQ ID NO: 9372 - DNA, 18 bp, Artificial Sequence
  Target B2M Sequence complement
tctctctttctggcctgg

SEQ ID NO: 9373 - DNA, 18 bp, Artificial Sequence
  Target B2M Sequence complement
ctctctttctggcctgga

SEQ ID NO: 9374 - DNA, 18 bp, Artificial Sequence
  Target B2M Sequence complement
tctctttctggcctggag

SEQ ID NO: 9375 - DNA, 18 bp, Artificial Sequence
  Target B2M Sequence complement
tttctggcctggaggcta

SEQ ID NO: 9376 - DNA, 18 bp, Artificial Sequence
  Target B2M Sequence complement
ttctggcctggaggctat

SEQ ID NO: 9377 - DNA, 18 bp, Artificial Sequence
  Target B2M Sequence complement
tggaggctatccagcgta

SEQ ID NO: 9378 - DNA, 18 bp, Artificial Sequence
  Target B2M Sequence complement
gaggctatccagcgtact

SEQ ID NO: 9379 - DNA, 18 bp, Artificial Sequence
  Target B2M Sequence complement
aggctatccagcgtactc

SEQ ID NO: 9380 - DNA, 18 bp, Artificial Sequence
  Target B2M Sequence complement
gctatccagcgtactcca

SEQ ID NO: 9381 - DNA, 18 bp, Artificial Sequence
  Target B2M Sequence complement
ctatccagcgtactccaa

SEQ ID NO: 9382 - DNA, 18 bp, Artificial Sequence
  Target B2M Sequence complement
tatccagcgtactccaaa

SEQ ID NO: 9383 - DNA, 18 bp, Artificial Sequence
  Target B2M Sequence complement
atccagcgtactccaaag

SEQ ID NO: 9384 - DNA, 18 bp, Artificial Sequence
  Target B2M Sequence complement
tccagcgtactccaaaga

SEQ ID NO: 9385 - DNA, 18 bp, Artificial Sequence
  Target B2M Sequence complement
ccagcgtactccaaagat

SEQ ID NO: 9386 - DNA, 18 bp, Artificial Sequence
  Target B2M Sequence complement
cagcgtactccaaagatt

SEQ ID NO: 9387 - DNA, 18 bp, Artificial Sequence
  Target B2M Sequence complement
agcgtactccaaagattc

SEQ ID NO: 9388 - DNA, 18 bp, Artificial Sequence
  Target B2M Sequence complement
gcgtactccaaagattca

SEQ ID NO: 9389 - DNA, 18 bp, Artificial Sequence
  Target B2M Sequence complement
cgtactccaaagattcag

SEQ ID NO: 9390 - DNA, 18 bp, Artificial Sequence
  Target B2M Sequence complement
gtactccaaagattcagg

SEQ ID NO: 9391 - DNA, 18 bp, Artificial Sequence
  Target B2M Sequence complement
tactccaaagattcaggt

SEQ ID NO: 9392 - DNA, 18 bp, Artificial Sequence
  Target B2M Sequence complement
actccaaagattcaggtt

SEQ ID NO: 9393 - DNA, 18 bp, Artificial Sequence
  Target B2M Sequence complement
ctccaaagattcaggttt

SEQ ID NO: 9394 - DNA, 18 bp, Artificial Sequence
  Target B2M Sequence complement
tccaaagattcaggttta

SEQ ID NO: 9395 - DNA, 18 bp, Artificial Sequence
  Target B2M Sequence complement
ccaaagattcaggtttac

SEQ ID NO: 9396 - DNA, 18 bp, Artificial Sequence
  Target B2M Sequence complement
caaagattcaggtttact

SEQ ID NO: 9397 - DNA, 18 bp, Artificial Sequence
  Target B2M Sequence complement
aaagattcaggtttactc

SEQ ID NO: 9398 - DNA, 18 bp, Artificial Sequence
  Target B2M Sequence complement
aagattcaggtttactca

SEQ ID NO: 9399 - DNA, 18 bp, Artificial Sequence
  Target B2M Sequence complement
agattcaggtttactcac

SEQ ID NO: 9400 - DNA, 18 bp, Artificial Sequence
  Target B2M Sequence complement
gattcaggtttactcacg

SEQ ID NO: 9401 - DNA, 18 bp, Artificial Sequence
  Target B2M Sequence complement
attcaggtttactcacgt

SEQ ID NO: 9402 - DNA, 18 bp, Artificial Sequence
  Target B2M Sequence complement
ttcaggtttactcacgtc

SEQ ID NO: 9403 - DNA, 18 bp, Artificial Sequence
  Target B2M Sequence complement
tcaggtttactcacgtca

SEQ ID NO: 9404 - DNA, 18 bp, Artificial Sequence
  Target B2M Sequence complement
caggtttactcacgtcat

SEQ ID NO: 9405 - DNA, 18 bp, Artificial Sequence
  Target B2M Sequence complement
aggtttactcacgtcatc

SEQ ID NO: 9406 - DNA, 18 bp, Artificial Sequence
  Target B2M Sequence complement
ggtttactcacgtcatcc

SEQ ID NO: 9407 - DNA, 18 bp, Artificial Sequence
  Target B2M Sequence complement
gtttactcacgtcatcca

SEQ ID NO: 9408 - DNA, 18 bp, Artificial Sequence
  Target B2M Sequence complement
tttactcacgtcatccag

SEQ ID NO: 9409 - DNA, 18 bp, Artificial Sequence
  Target B2M Sequence complement
ttactcacgtcatccagc

SEQ ID NO: 9410 - DNA, 18 bp, Artificial Sequence
  Target B2M Sequence complement
tactcacgtcatccagca

SEQ ID NO: 9411 - DNA, 18 bp, Artificial Sequence
  Target B2M Sequence complement
actcacgtcatccagcag

SEQ ID NO: 9412 - DNA, 18 bp, Artificial Sequence
  Target B2M Sequence complement
ctcacgtcatccagcaga

SEQ ID NO: 9413 - DNA, 18 bp, Artificial Sequence
  Target B2M Sequence complement
tcacgtcatccagcagag

SEQ ID NO: 9414 - DNA, 18 bp, Artificial Sequence
  Target B2M Sequence complement
cacgtcatccagcagaga

SEQ ID NO: 9415 - DNA, 18 bp, Artificial Sequence
  Target B2M Sequence complement
acgtcatccagcagagaa

SEQ ID NO: 9416 - DNA, 18 bp, Artificial Sequence
  Target B2M Sequence complement
cgtcatccagcagagaat

SEQ ID NO: 9417 - DNA, 18 bp, Artificial Sequence
  Target B2M Sequence complement
gtcatccagcagagaatg

SEQ ID NO: 9418 - DNA, 18 bp, Artificial Sequence
  Target B2M Sequence complement
tcatccagcagagaatgg

SEQ ID NO: 9419 - DNA, 18 bp, Artificial Sequence
  Target B2M Sequence complement
catccagcagagaatgga

SEQ ID NO: 9420 - DNA, 18 bp, Artificial Sequence
  Target B2M Sequence complement
atccagcagagaatggaa

SEQ ID NO: 9421 - DNA, 18 bp, Artificial Sequence
  Target B2M Sequence complement
tccagcagagaatggaaa

SEQ ID NO: 9422 - DNA, 18 bp, Artificial Sequence
  Target B2M Sequence complement
ccagcagagaatggaaag

SEQ ID NO: 9423 - DNA, 18 bp, Artificial Sequence
  Target B2M Sequence complement
cagcagagaatggaaagt

SEQ ID NO: 9424 - DNA, 18 bp, Artificial Sequence
  Target B2M Sequence complement
agcagagaatggaaagtc

SEQ ID NO: 9425 - DNA, 18 bp, Artificial Sequence
  Target B2M Sequence complement
gcagagaatggaaagtca

SEQ ID NO: 9426 - DNA, 18 bp, Artificial Sequence
  Target B2M Sequence complement
cagagaatggaaagtcaa

SEQ ID NO: 9427 - DNA, 18 bp, Artificial Sequence
  Target B2M Sequence complement
agagaatggaaagtcaaa

SEQ ID NO: 9428 - DNA, 18 bp, Artificial Sequence
  Target B2M Sequence complement
gagaatggaaagtcaaat

SEQ ID NO: 9429 - DNA, 18 bp, Artificial Sequence
  Target B2M Sequence complement
agaatggaaagtcaaatt

SEQ ID NO: 9430 - DNA, 18 bp, Artificial Sequence
  Target B2M Sequence complement
gaatggaaagtcaaattt

SEQ ID NO: 9431 - DNA, 18 bp, Artificial Sequence
  Target B2M Sequence complement
aatggaaagtcaaatttc

SEQ ID NO: 9432 - DNA, 18 bp, Artificial Sequence
  Target B2M Sequence complement
atggaaagtcaaatttcc

SEQ ID NO: 9433 - DNA, 18 bp, Artificial Sequence
  Target B2M Sequence complement
tggaaagtcaaatttcct

SEQ ID NO: 9434 - DNA, 18 bp, Artificial Sequence
  Target B2M Sequence complement
ggaaagtcaaatttcctg

SEQ ID NO: 9435 - DNA, 18 bp, Artificial Sequence
  Target B2M Sequence complement
gaaagtcaaatttcctga

SEQ ID NO: 9436 - DNA, 18 bp, Artificial Sequence
  Target B2M Sequence complement
aaagtcaaatttcctgaa

SEQ ID NO: 9437 - DNA, 18 bp, Artificial Sequence
  Target B2M Sequence complement
aagtcaaatttcctgaat

SEQ ID NO: 9438 - DNA, 18 bp, Artificial Sequence
  Target B2M Sequence complement
agtcaaatttcctgaatt

SEQ ID NO: 9439 - DNA, 18 bp, Artificial Sequence
  Target B2M Sequence complement
gtcaaatttcctgaattg

SEQ ID NO: 9440 - DNA, 18 bp, Artificial Sequence
  Target B2M Sequence complement
tcaaatttcctgaattgc

SEQ ID NO: 9441 - DNA, 18 bp, Artificial Sequence
  Target B2M Sequence complement
caaatttcctgaattgct

SEQ ID NO: 9442 - DNA, 18 bp, Artificial Sequence
  Target B2M Sequence complement
aaatttcctgaattgcta

SEQ ID NO: 9443 - DNA, 18 bp, Artificial Sequence
  Target B2M Sequence complement
aatttcctgaattgctat

SEQ ID NO: 9444 - DNA, 18 bp, Artificial Sequence
  Target B2M Sequence complement
atttcctgaattgctatg

SEQ ID NO: 9445 - DNA, 18 bp, Artificial Sequence
  Target B2M Sequence complement
tttcctgaattgctatgt

SEQ ID NO: 9446 - DNA, 18 bp, Artificial Sequence
  Target B2M Sequence complement
ttcctgaattgctatgtg

SEQ ID NO: 9447 - DNA, 18 bp, Artificial Sequence
  Target B2M Sequence complement
tcctgaattgctatgtgt

SEQ ID NO: 9448 - DNA, 18 bp, Artificial Sequence
  Target B2M Sequence complement
cctgaattgctatgtgtc

SEQ ID NO: 9449 - DNA, 18 bp, Artificial Sequence
  Target B2M Sequence complement
ctgaattgctatgtgtct

SEQ ID NO: 9450 - DNA, 18 bp, Artificial Sequence
  Target B2M Sequence complement
tgaattgctatgtgtctg

SEQ ID NO: 9451 - DNA, 18 bp, Artificial Sequence
  Target B2M Sequence complement
gaattgctatgtgtctgg

SEQ ID NO: 9452 - DNA, 18 bp, Artificial Sequence
  Target B2M Sequence complement
aattgctatgtgtctggg

SEQ ID NO: 9453 - DNA, 18 bp, Artificial Sequence
  Target B2M Sequence complement
attgctatgtgtctgggt

SEQ ID NO: 9454 - DNA, 18 bp, Artificial Sequence
  Target B2M Sequence complement
ttgctatgtgtctgggtt

SEQ ID NO: 9455 - DNA, 18 bp, Artificial Sequence
  Target B2M Sequence complement
tgctatgtgtctgggttt

SEQ ID NO: 9456 - DNA, 18 bp, Artificial Sequence
  Target B2M Sequence complement
gctatgtgtctgggtttc

SEQ ID NO: 9457 - DNA, 18 bp, Artificial Sequence
  Target B2M Sequence complement
ctatgtgtctgggtttca

SEQ ID NO: 9458 - DNA, 18 bp, Artificial Sequence
  Target B2M Sequence complement
tatgtgtctgggtttcat

SEQ ID NO: 9459 - DNA, 18 bp, Artificial Sequence
  Target B2M Sequence complement
atgtgtctgggtttcatc

SEQ ID NO: 9460 - DNA, 18 bp, Artificial Sequence
  Target B2M Sequence complement
tgtgtctgggtttcatcc

SEQ ID NO: 9461 - DNA, 18 bp, Artificial Sequence
  Target B2M Sequence complement
gtgtctgggtttcatcca

SEQ ID NO: 9462 - DNA, 18 bp, Artificial Sequence
  Target B2M Sequence complement
tgtctgggtttcatccat

SEQ ID NO: 9463 - DNA, 18 bp, Artificial Sequence
  Target B2M Sequence complement
gtctgggtttcatccatc

SEQ ID NO: 9464 - DNA, 18 bp, Artificial Sequence
  Target B2M Sequence complement
tctgggtttcatccatcc

SEQ ID NO: 9465 - DNA, 18 bp, Artificial Sequence
  Target B2M Sequence complement
ctgggtttcatccatccg

SEQ ID NO: 9466 - DNA, 18 bp, Artificial Sequence
  Target B2M Sequence complement
tgggtttcatccatccga

SEQ ID NO: 9467 - DNA, 18 bp, Artificial Sequence
  Target B2M Sequence complement
gggtttcatccatccgac

SEQ ID NO: 9468 - DNA, 18 bp, Artificial Sequence
  Target B2M Sequence complement
ggtttcatccatccgaca

SEQ ID NO: 9469 - DNA, 18 bp, Artificial Sequence
  Target B2M Sequence complement
gtttcatccatccgacat

SEQ ID NO: 9470 - DNA, 18 bp, Artificial Sequence
  Target B2M Sequence complement
tttcatccatccgacatt

SEQ ID NO: 9471 - DNA, 18 bp, Artificial Sequence
  Target B2M Sequence complement
ttcatccatccgacattg

SEQ ID NO: 9472 - DNA, 18 bp, Artificial Sequence
  Target B2M Sequence complement
tcatccatccgacattga

SEQ ID NO: 9473 - DNA, 18 bp, Artificial Sequence
  Target B2M Sequence complement
catccatccgacattgaa

SEQ ID NO: 9474 - DNA, 18 bp, Artificial Sequence
  Target B2M Sequence complement
atccatccgacattgaag

SEQ ID NO: 9475 - DNA, 18 bp, Artificial Sequence
  Target B2M Sequence complement
tccatccgacattgaagt

SEQ ID NO: 9476 - DNA, 18 bp, Artificial Sequence
  Target B2M Sequence complement
ccatccgacattgaagtt

SEQ ID NO: 9477 - DNA, 18 bp, Artificial Sequence
  Target B2M Sequence complement
catccgacattgaagttg

SEQ ID NO: 9478 - DNA, 18 bp, Artificial Sequence
  Target B2M Sequence complement
atccgacattgaagttga

SEQ ID NO: 9479 - DNA, 18 bp, Artificial Sequence
  Target B2M Sequence complement
tccgacattgaagttgac

SEQ ID NO: 9480 - DNA, 18 bp, Artificial Sequence
  Target B2M Sequence complement
ccgacattgaagttgact

SEQ ID NO: 9481 - DNA, 18 bp, Artificial Sequence
  Target B2M Sequence complement
cgacattgaagttgactt

SEQ ID NO: 9482 - DNA, 18 bp, Artificial Sequence
  Target B2M Sequence complement
gacattgaagttgactta

SEQ ID NO: 9483 - DNA, 18 bp, Artificial Sequence
  Target B2M Sequence complement
acattgaagttgacttac

SEQ ID NO: 9484 - DNA, 18 bp, Artificial Sequence
  Target B2M Sequence complement
cattgaagttgacttact

SEQ ID NO: 9485 - DNA, 18 bp, Artificial Sequence
  Target B2M Sequence complement
attgaagttgacttactg

SEQ ID NO: 9486 - DNA, 18 bp, Artificial Sequence
  Target B2M Sequence complement
ttgaagttgacttactga

SEQ ID NO: 9487 - DNA, 18 bp, Artificial Sequence
  Target B2M Sequence complement
tgaagttgacttactgaa

SEQ ID NO: 9488 - DNA, 18 bp, Artificial Sequence
  Target B2M Sequence complement
gaagttgacttactgaag

SEQ ID NO: 9489 - DNA, 18 bp, Artificial Sequence
  Target B2M Sequence complement
aagttgacttactgaaga

SEQ ID NO: 9490 - DNA, 18 bp, Artificial Sequence
  Target B2M Sequence complement
agttgacttactgaagaa

SEQ ID NO: 9491 - DNA, 18 bp, Artificial Sequence
  Target B2M Sequence complement
gttgacttactgaagaat

SEQ ID NO: 9492 - DNA, 18 bp, Artificial Sequence
  Target B2M Sequence complement
ttgacttactgaagaatg

SEQ ID NO: 9493 - DNA, 18 bp, Artificial Sequence
  Target B2M Sequence complement
tgacttactgaagaatgg

SEQ ID NO: 9494 - DNA, 18 bp, Artificial Sequence
  Target B2M Sequence complement
gacttactgaagaatgga

SEQ ID NO: 9495 - DNA, 18 bp, Artificial Sequence
  Target B2M Sequence complement
acttactgaagaatggag

SEQ ID NO: 9496 - DNA, 18 bp, Artificial Sequence
  Target B2M Sequence complement
cttactgaagaatggaga

SEQ ID NO: 9497 - DNA, 18 bp, Artificial Sequence
  Target B2M Sequence complement
ttactgaagaatggagag

SEQ ID NO: 9498 - DNA, 18 bp, Artificial Sequence
  Target B2M Sequence complement
tactgaagaatggagaga

SEQ ID NO: 9499 - DNA, 18 bp, Artificial Sequence
  Target B2M Sequence complement
actgaagaatggagagag

SEQ ID NO: 9500 - DNA, 18 bp, Artificial Sequence
  Target B2M Sequence complement
ctgaagaatggagagaga

SEQ ID NO: 9501 - DNA, 18 bp, Artificial Sequence
  Target B2M Sequence complement
tgaagaatggagagagaa

SEQ ID NO: 9502 - DNA, 18 bp, Artificial Sequence
  Target B2M Sequence complement
gaagaatggagagagaat

SEQ ID NO: 9503 - DNA, 18 bp, Artificial Sequence
  Target B2M Sequence complement
aagaatggagagagaatt

SEQ ID NO: 9504 - DNA, 18 bp, Artificial Sequence
  Target B2M Sequence complement
agaatggagagagaattg

SEQ ID NO: 9505 - DNA, 18 bp, Artificial Sequence
  Target B2M Sequence complement
gaatggagagagaattga

SEQ ID NO: 9506 - DNA, 18 bp, Artificial Sequence
  Target B2M Sequence complement
aatggagagagaattgaa

SEQ ID NO: 9507 - DNA, 18 bp, Artificial Sequence
  Target B2M Sequence complement
atggagagagaattgaaa

SEQ ID NO: 9508 - DNA, 18 bp, Artificial Sequence
  Target B2M Sequence complement
aaagtggagcattcagac

SEQ ID NO: 9509 - DNA, 18 bp, Artificial Sequence
  Target B2M Sequence complement
aagtggagcattcagact

SEQ ID NO: 9510 - DNA, 18 bp, Artificial Sequence
  Target B2M Sequence complement
agtggagcattcagactt

SEQ ID NO: 9511 - DNA, 18 bp, Artificial Sequence
  Target B2M Sequence complement
gtggagcattcagacttg

SEQ ID NO: 9512 - DNA, 18 bp, Artificial Sequence
  Target B2M Sequence complement
tggagcattcagacttgt

SEQ ID NO: 9513 - DNA, 18 bp, Artificial Sequence
  Target B2M Sequence complement
ggagcattcagacttgtc

SEQ ID NO: 9514 - DNA, 18 bp, Artificial Sequence
  Target B2M Sequence complement
gagcattcagacttgtct

SEQ ID NO: 9515 - DNA, 18 bp, Artificial Sequence
  Target B2M Sequence complement
agcattcagacttgtctt

SEQ ID NO: 9516 - DNA, 18 bp, Artificial Sequence
  Target B2M Sequence complement
gcattcagacttgtcttt

SEQ ID NO: 9517 - DNA, 18 bp, Artificial Sequence
  Target B2M Sequence complement
cattcagacttgtctttc

SEQ ID NO: 9518 - DNA, 18 bp, Artificial Sequence
  Target B2M Sequence complement
attcagacttgtctttca

SEQ ID NO: 9519 - DNA, 18 bp, Artificial Sequence
  Target B2M Sequence complement
ttcagacttgtctttcag

SEQ ID NO: 9520 - DNA, 18 bp, Artificial Sequence
  Target B2M Sequence complement
tcagacttgtctttcagc

SEQ ID NO: 9521 - DNA, 18 bp, Artificial Sequence
  Target B2M Sequence complement
cagacttgtctttcagca

SEQ ID NO: 9522 - DNA, 18 bp, Artificial Sequence
  Target B2M Sequence complement
agacttgtctttcagcaa

SEQ ID NO: 9523 - DNA, 18 bp, Artificial Sequence
  Target B2M Sequence complement
gacttgtctttcagcaag

SEQ ID NO: 9524 - DNA, 18 bp, Artificial Sequence
  Target B2M Sequence complement
acttgtctttcagcaagg

SEQ ID NO: 9525 - DNA, 18 bp, Artificial Sequence
  Target B2M Sequence complement
cttgtctttcagcaagga

SEQ ID NO: 9526 - DNA, 18 bp, Artificial Sequence
  Target B2M Sequence complement
ttgtctttcagcaaggac

SEQ ID NO: 9527 - DNA, 18 bp, Artificial Sequence
  Target B2M Sequence complement
tgtctttcagcaaggact

SEQ ID NO: 9528 - DNA, 18 bp, Artificial Sequence
  Target B2M Sequence complement
gtctttcagcaaggactg

SEQ ID NO: 9529 - DNA, 18 bp, Artificial Sequence
  Target B2M Sequence complement
tctttcagcaaggactgg

SEQ ID NO: 9530 - DNA, 18 bp, Artificial Sequence
  Target B2M Sequence complement
ctttcagcaaggactggt

SEQ ID NO: 9531 - DNA, 18 bp, Artificial Sequence
  Target B2M Sequence complement
tttcagcaaggactggtc

SEQ ID NO: 9532 - DNA, 18 bp, Artificial Sequence
  Target B2M Sequence complement
ttcagcaaggactggtct

SEQ ID NO: 9533 - DNA, 18 bp, Artificial Sequence
  Target B2M Sequence complement
tcagcaaggactggtctt

SEQ ID NO: 9534 - DNA, 18 bp, Artificial Sequence
  Target B2M Sequence complement
cagcaaggactggtcttt

SEQ ID NO: 9535 - DNA, 18 bp, Artificial Sequence
  Target B2M Sequence complement
agcaaggactggtctttc

SEQ ID NO: 9536 - DNA, 18 bp, Artificial Sequence
  Target B2M Sequence complement
gcaaggactggtctttct

SEQ ID NO: 9537 - DNA, 18 bp, Artificial Sequence
  Target B2M Sequence complement
caaggactggtctttcta

SEQ ID NO: 9538 - DNA, 18 bp, Artificial Sequence
  Target B2M Sequence complement
aaggactggtctttctat

SEQ ID NO: 9539 - DNA, 18 bp, Artificial Sequence
  Target B2M Sequence complement
aggactggtctttctatc

SEQ ID NO: 9540 - DNA, 18 bp, Artificial Sequence
  Target B2M Sequence complement
ggactggtctttctatct

SEQ ID NO: 9541 - DNA, 18 bp, Artificial Sequence
  Target B2M Sequence complement
gactggtctttctatctc

SEQ ID NO: 9542 - DNA, 18 bp, Artificial Sequence
  Target B2M Sequence complement
actggtctttctatctct

SEQ ID NO: 9543 - DNA, 18 bp, Artificial Sequence
  Target B2M Sequence complement
ctggtctttctatctctt

SEQ ID NO: 9544 - DNA, 18 bp, Artificial Sequence
  Target B2M Sequence complement
tggtctttctatctcttg

SEQ ID NO: 9545 - DNA, 18 bp, Artificial Sequence
  Target B2M Sequence complement
ggtctttctatctcttgt

SEQ ID NO: 9546 - DNA, 18 bp, Artificial Sequence
  Target B2M Sequence complement
gtctttctatctcttgta

SEQ ID NO: 9547 - DNA, 18 bp, Artificial Sequence
  Target B2M Sequence complement
tctttctatctcttgtac

SEQ ID NO: 9548 - DNA, 18 bp, Artificial Sequence
  Target B2M Sequence complement
ctttctatctcttgtact

SEQ ID NO: 9549 - DNA, 18 bp, Artificial Sequence
  Target B2M Sequence complement
tttctatctcttgtacta

SEQ ID NO: 9550 - DNA, 18 bp, Artificial Sequence
  Target B2M Sequence complement
ttctatctcttgtactac

SEQ ID NO: 9551 - DNA, 18 bp, Artificial Sequence
  Target B2M Sequence complement
tctatctcttgtactaca

SEQ ID NO: 9552 - DNA, 18 bp, Artificial Sequence
  Target B2M Sequence complement
ctatctcttgtactacac

SEQ ID NO: 9553 - DNA, 18 bp, Artificial Sequence
  Target B2M Sequence complement
tatctcttgtactacact

SEQ ID NO: 9554 - DNA, 18 bp, Artificial Sequence
  Target B2M Sequence complement
atctcttgtactacactg

SEQ ID NO: 9555 - DNA, 18 bp, Artificial Sequence
  Target B2M Sequence complement
tctcttgtactacactga

SEQ ID NO: 9556 - DNA, 18 bp, Artificial Sequence
  Target B2M Sequence complement
ctcttgtactacactgaa

SEQ ID NO: 9557 - DNA, 18 bp, Artificial Sequence
  Target B2M Sequence complement
tcttgtactacactgaat

SEQ ID NO: 9558 - DNA, 18 bp, Artificial Sequence
  Target B2M Sequence complement
cttgtactacactgaatt

SEQ ID NO: 9559 - DNA, 18 bp, Artificial Sequence
  Target B2M Sequence complement
ttgtactacactgaattc

SEQ ID NO: 9560 - DNA, 18 bp, Artificial Sequence
  Target B2M Sequence complement
tgtactacactgaattca

SEQ ID NO: 9561 - DNA, 18 bp, Artificial Sequence
  Target B2M Sequence complement
gtactacactgaattcac

SEQ ID NO: 9562 - DNA, 18 bp, Artificial Sequence
  Target B2M Sequence complement
tactacactgaattcacc

SEQ ID NO: 9563 - DNA, 18 bp, Artificial Sequence
  Target B2M Sequence complement
actacactgaattcaccc

SEQ ID NO: 9564 - DNA, 18 bp, Artificial Sequence
  Target B2M Sequence complement
aaagatgagtatgcctgc

SEQ ID NO: 9565 - DNA, 18 bp, Artificial Sequence
  Target B2M Sequence complement
aagatgagtatgcctgcc

SEQ ID NO: 9566 - DNA, 18 bp, Artificial Sequence
  Target B2M Sequence complement
agatgagtatgcctgccg

SEQ ID NO: 9567 - DNA, 18 bp, Artificial Sequence
  Target B2M Sequence complement
gatgagtatgcctgccgt

SEQ ID NO: 9568 - DNA, 18 bp, Artificial Sequence
  Target B2M Sequence complement
atgagtatgcctgccgtg

SEQ ID NO: 9569 - DNA, 18 bp, Artificial Sequence
  Target B2M Sequence complement
tgagtatgcctgccgtgt

SEQ ID NO: 9570 - DNA, 18 bp, Artificial Sequence
  Target B2M Sequence complement
agtatgcctgccgtgtga

SEQ ID NO: 9571 - DNA, 18 bp, Artificial Sequence
  Target B2M Sequence complement
gtatgcctgccgtgtgaa

SEQ ID NO: 9572 - DNA, 18 bp, Artificial Sequence
  Target B2M Sequence complement
tatgcctgccgtgtgaac

SEQ ID NO: 9573 - DNA, 18 bp, Artificial Sequence
  Target B2M Sequence complement
ctgccgtgtgaaccatgt

SEQ ID NO: 9574 - DNA, 18 bp, Artificial Sequence
  Target B2M Sequence complement
tgccgtgtgaaccatgtg

SEQ ID NO: 9575 - DNA, 18 bp, Artificial Sequence
  Target B2M Sequence complement
gccgtgtgaaccatgtga

SEQ ID NO: 9576 - DNA, 18 bp, Artificial Sequence
  Target B2M Sequence complement
ccgtgtgaaccatgtgac

SEQ ID NO: 9577 - DNA, 18 bp, Artificial Sequence
  Target B2M Sequence complement
cgtgtgaaccatgtgact

SEQ ID NO: 9578 - DNA, 18 bp, Artificial Sequence
  Target B2M Sequence complement
gtgtgaaccatgtgactt

SEQ ID NO: 9579 - DNA, 18 bp, Artificial Sequence
  Target B2M Sequence complement
tgtgaaccatgtgacttt

SEQ ID NO: 9580 - DNA, 18 bp, Artificial Sequence
  Target B2M Sequence complement
gtgaaccatgtgactttg

SEQ ID NO: 9581 - DNA, 18 bp, Artificial Sequence
  Target B2M Sequence complement
tgaaccatgtgactttgt

SEQ ID NO: 9582 - DNA, 18 bp, Artificial Sequence
  Target B2M Sequence complement
gaaccatgtgactttgtc

SEQ ID NO: 9583 - DNA, 18 bp, Artificial Sequence
  Target B2M Sequence complement
aaccatgtgactttgtca

SEQ ID NO: 9584 - DNA, 18 bp, Artificial Sequence
  Target B2M Sequence complement
accatgtgactttgtcac

SEQ ID NO: 9585 - DNA, 18 bp, Artificial Sequence
  Target B2M Sequence complement
ccatgtgactttgtcaca

SEQ ID NO: 9586 - DNA, 18 bp, Artificial Sequence
  Target B2M Sequence complement
catgtgactttgtcacag

SEQ ID NO: 9587 - DNA, 18 bp, Artificial Sequence
  Target B2M Sequence complement
atgtgactttgtcacagc

SEQ ID NO: 9588 - DNA, 18 bp, Artificial Sequence
  Target B2M Sequence complement
tgtgactttgtcacagcc

SEQ ID NO: 9589 - DNA, 18 bp, Artificial Sequence
  Target B2M Sequence complement
gtgactttgtcacagccc

SEQ ID NO: 9590 - DNA, 18 bp, Artificial Sequence
  Target B2M Sequence complement
tgactttgtcacagccca

SEQ ID NO: 9591 - DNA, 18 bp, Artificial Sequence
  Target B2M Sequence complement
gactttgtcacagcccaa

SEQ ID NO: 9592 - DNA, 18 bp, Artificial Sequence
  Target B2M Sequence complement
actttgtcacagcccaag

SEQ ID NO: 9593 - DNA, 18 bp, Artificial Sequence
  Target B2M Sequence complement
ctttgtcacagcccaaga

SEQ ID NO: 9594 - DNA, 18 bp, Artificial Sequence
  Target B2M Sequence complement
tttgtcacagcccaagat

SEQ ID NO: 9595 - DNA, 18 bp, Artificial Sequence
  Target B2M Sequence complement
ttgtcacagcccaagata

SEQ ID NO: 9596 - DNA, 18 bp, Artificial Sequence
  Target B2M Sequence complement
tgtcacagcccaagatag

SEQ ID NO: 9597 - DNA, 18 bp, Artificial Sequence
  Target B2M Sequence complement
gtcacagcccaagatagt

SEQ ID NO: 9598 - DNA, 18 bp, Artificial Sequence
  Target B2M Sequence complement
tcacagcccaagatagtt

SEQ ID NO: 9599 - DNA, 18 bp, Artificial Sequence
  Target B2M Sequence complement
cacagcccaagatagtta

SEQ ID NO: 9600 - DNA, 18 bp, Artificial Sequence
  Target B2M Sequence complement
acagcccaagatagttaa

SEQ ID NO: 9601 - DNA, 18 bp, Artificial Sequence
  Target B2M Sequence complement
cagcccaagatagttaag

SEQ ID NO: 9602 - DNA, 18 bp, Artificial Sequence
  Target B2M Sequence complement
agcccaagatagttaagt

SEQ ID NO: 9603 - DNA, 18 bp, Artificial Sequence
  Target B2M Sequence complement
gcccaagatagttaagtg

SEQ ID NO: 9604 - DNA, 18 bp, Artificial Sequence
  Target B2M Sequence complement
cccaagatagttaagtgg

SEQ ID NO: 9605 - DNA, 18 bp, Artificial Sequence
  Target B2M Sequence complement
ccaagatagttaagtggg

SEQ ID NO: 9606 - DNA, 18 bp, Artificial Sequence
  Target B2M Sequence complement
caagatagttaagtggga

SEQ ID NO: 9607 - DNA, 18 bp, Artificial Sequence
  Target B2M Sequence complement
aagatagttaagtgggat

SEQ ID NO: 9608 - DNA, 18 bp, Artificial Sequence
  Target B2M Sequence complement
agatagttaagtgggatc

SEQ ID NO: 9609 - DNA, 18 bp, Artificial Sequence
  Target B2M Sequence complement
gatagttaagtgggatcg

SEQ ID NO: 9610 - DNA, 18 bp, Artificial Sequence
  Target B2M Sequence complement
atagttaagtgggatcga

SEQ ID NO: 9611 - DNA, 18 bp, Artificial Sequence
  Target B2M Sequence complement
tagttaagtgggatcgag

SEQ ID NO: 9612 - DNA, 18 bp, Artificial Sequence
  Target B2M Sequence complement
agttaagtgggatcgaga

SEQ ID NO: 9613 - DNA, 18 bp, Artificial Sequence
  Target B2M Sequence complement
gttaagtgggatcgagac

SEQ ID NO: 9614 - DNA, 18 bp, Artificial Sequence
  Target B2M Sequence complement
ttaagtgggatcgagaca

SEQ ID NO: 9615 - DNA, 18 bp, Artificial Sequence
  Target B2M Sequence complement
taagtgggatcgagacat

SEQ ID NO: 9616 - DNA, 18 bp, Artificial Sequence
  Target B2M Sequence complement
aagtgggatcgagacatg

SEQ ID NO: 9617 - DNA, 18 bp, Artificial Sequence
  Target B2M Sequence complement
agtgggatcgagacatgt

SEQ ID NO: 9618 - DNA, 18 bp, Artificial Sequence
  Target B2M Sequence complement
gtgggatcgagacatgta

SEQ ID NO: 9619 - DNA, 18 bp, Artificial Sequence
  Target B2M Sequence complement
tgggatcgagacatgtaa

SEQ ID NO: 9620 - DNA, 18 bp, Artificial Sequence
  Target B2M Sequence complement
gggatcgagacatgtaag

SEQ ID NO: 9621 - DNA, 18 bp, Artificial Sequence
  Target B2M Sequence complement
ggatcgagacatgtaagc

SEQ ID NO: 9622 - DNA, 18 bp, Artificial Sequence
  Target B2M Sequence complement
gatcgagacatgtaagca

SEQ ID NO: 9623 - DNA, 18 bp, Artificial Sequence
  Target B2M Sequence complement
atcgagacatgtaagcag

SEQ ID NO: 9624 - DNA, 18 bp, Artificial Sequence
  Target B2M Sequence complement
tcgagacatgtaagcagc

SEQ ID NO: 9625 - DNA, 18 bp, Artificial Sequence
  Target B2M Sequence complement
cgagacatgtaagcagca

SEQ ID NO: 9626 - DNA, 18 bp, Artificial Sequence
  Target B2M Sequence complement
gagacatgtaagcagcat

SEQ ID NO: 9627 - DNA, 18 bp, Artificial Sequence
  Target B2M Sequence complement
agacatgtaagcagcatc

SEQ ID NO: 9628 - DNA, 18 bp, Artificial Sequence
  Target B2M Sequence complement
gacatgtaagcagcatca

SEQ ID NO: 9629 - DNA, 18 bp, Artificial Sequence
  Target B2M Sequence complement
acatgtaagcagcatcat

SEQ ID NO: 9630 - DNA, 18 bp, Artificial Sequence
  Target B2M Sequence complement
catgtaagcagcatcatg

SEQ ID NO: 9631 - DNA, 18 bp, Artificial Sequence
  Target B2M Sequence complement
atgtaagcagcatcatgg

SEQ ID NO: 9632 - DNA, 18 bp, Artificial Sequence
  Target B2M Sequence complement
tgtaagcagcatcatgga

SEQ ID NO: 9633 - DNA, 18 bp, Artificial Sequence
  Target B2M Sequence complement
gtaagcagcatcatggag

SEQ ID NO: 9634 - DNA, 18 bp, Artificial Sequence
  Target B2M Sequence complement
taagcagcatcatggagg

SEQ ID NO: 9635 - DNA, 18 bp, Artificial Sequence
  Target B2M Sequence complement
aagcagcatcatggaggt

SEQ ID NO: 9636 - DNA, 18 bp, Artificial Sequence
  Target B2M Sequence complement
agcagcatcatggaggtt

SEQ ID NO: 9637 - DNA, 18 bp, Artificial Sequence
  Target B2M Sequence complement
gcagcatcatggaggttt

SEQ ID NO: 9638 - DNA, 18 bp, Artificial Sequence
  Target B2M Sequence complement
cagcatcatggaggtttg

SEQ ID NO: 9639 - DNA, 18 bp, Artificial Sequence
  Target B2M Sequence complement
agcatcatggaggtttga

SEQ ID NO: 9640 - DNA, 18 bp, Artificial Sequence
  Target B2M Sequence complement
gcatcatggaggtttgaa

SEQ ID NO: 9641 - DNA, 18 bp, Artificial Sequence
  Target B2M Sequence complement
catcatggaggtttgaag

SEQ ID NO: 9642 - DNA, 18 bp, Artificial Sequence
  Target B2M Sequence complement
atcatggaggtttgaaga

SEQ ID NO: 9643 - DNA, 18 bp, Artificial Sequence
  Target B2M Sequence complement
tcatggaggtttgaagat

SEQ ID NO: 9644 - DNA, 18 bp, Artificial Sequence
  Target B2M Sequence complement
catggaggtttgaagatg

SEQ ID NO: 9645 - DNA, 18 bp, Artificial Sequence
  Target B2M Sequence complement
atggaggtttgaagatgc

SEQ ID NO: 9646 - DNA, 18 bp, Artificial Sequence
  Target B2M Sequence complement
tggaggtttgaagatgcc

SEQ ID NO: 9647 - DNA, 18 bp, Artificial Sequence
  Target B2M Sequence complement
ggaggtttgaagatgccg

SEQ ID NO: 9648 - DNA, 18 bp, Artificial Sequence
  Target B2M Sequence complement
gaggtttgaagatgccgc

SEQ ID NO: 9649 - DNA, 18 bp, Artificial Sequence
  Target B2M Sequence complement
aggtttgaagatgccgca

SEQ ID NO: 9650 - DNA, 18 bp, Artificial Sequence
  Target B2M Sequence complement
ggtttgaagatgccgcat

SEQ ID NO: 9651 - DNA, 18 bp, Artificial Sequence
  Target B2M Sequence complement
gtttgaagatgccgcatt

SEQ ID NO: 9652 - DNA, 18 bp, Artificial Sequence
  Target B2M Sequence complement
tttgaagatgccgcattt

SEQ ID NO: 9653 - DNA, 18 bp, Artificial Sequence
  Target B2M Sequence complement
ttgaagatgccgcatttg

SEQ ID NO: 9654 - DNA, 18 bp, Artificial Sequence
  Target B2M Sequence complement
tgaagatgccgcatttgg

SEQ ID NO: 9655 - DNA, 18 bp, Artificial Sequence
  Target B2M Sequence complement
gaagatgccgcatttgga

SEQ ID NO: 9656 - DNA, 18 bp, Artificial Sequence
  Target B2M Sequence complement
aagatgccgcatttggat

SEQ ID NO: 9657 - DNA, 18 bp, Artificial Sequence
  Target B2M Sequence complement
agatgccgcatttggatt

SEQ ID NO: 9658 - DNA, 18 bp, Artificial Sequence
  Target B2M Sequence complement
gatgccgcatttggattg

SEQ ID NO: 9659 - DNA, 18 bp, Artificial Sequence
  Target B2M Sequence complement
atgccgcatttggattgg

SEQ ID NO: 9660 - DNA, 18 bp, Artificial Sequence
  Target B2M Sequence complement
tgccgcatttggattgga

SEQ ID NO: 9661 - DNA, 18 bp, Artificial Sequence
  Target B2M Sequence complement
gccgcatttggattggat

SEQ ID NO: 9662 - DNA, 18 bp, Artificial Sequence
  Target B2M Sequence complement
ccgcatttggattggatg

SEQ ID NO: 9663 - DNA, 18 bp, Artificial Sequence
  Target B2M Sequence complement
cgcatttggattggatga

SEQ ID NO: 9664 - DNA, 18 bp, Artificial Sequence
  Target B2M Sequence complement
gcatttggattggatgaa

SEQ ID NO: 9665 - DNA, 18 bp, Artificial Sequence
  Target B2M Sequence complement
catttggattggatgaat

SEQ ID NO: 9666 - DNA, 18 bp, Artificial Sequence
  Target B2M Sequence complement
atttggattggatgaatt

SEQ ID NO: 9667 - DNA, 18 bp, Artificial Sequence
  Target B2M Sequence complement
tttggattggatgaattc

SEQ ID NO: 9668 - DNA, 18 bp, Artificial Sequence
  Target B2M Sequence complement
ttggattggatgaattcc

SEQ ID NO: 9669 - DNA, 18 bp, Artificial Sequence
  Target B2M Sequence complement
tggattggatgaattcca

SEQ ID NO: 9670 - DNA, 18 bp, Artificial Sequence
  Target B2M Sequence complement
ggattggatgaattccaa

SEQ ID NO: 9671 - DNA, 18 bp, Artificial Sequence
  Target B2M Sequence complement
gattggatgaattccaaa

SEQ ID NO: 9672 - DNA, 18 bp, Artificial Sequence
  Target B2M Sequence complement
attggatgaattccaaat

SEQ ID NO: 9673 - DNA, 18 bp, Artificial Sequence
  Target B2M Sequence complement
ttggatgaattccaaatt

SEQ ID NO: 9674 - DNA, 18 bp, Artificial Sequence
  Target B2M Sequence complement
tggatgaattccaaattc

SEQ ID NO: 9675 - DNA, 18 bp, Artificial Sequence
  Target B2M Sequence complement
ggatgaattccaaattct

SEQ ID NO: 9676 - DNA, 18 bp, Artificial Sequence
  Target B2M Sequence complement
gatgaattccaaattctg

SEQ ID NO: 9677 - DNA, 18 bp, Artificial Sequence
  Target B2M Sequence complement
atgaattccaaattctgc

SEQ ID NO: 9678 - DNA, 18 bp, Artificial Sequence
  Target B2M Sequence complement
tgaattccaaattctgct

SEQ ID NO: 9679 - DNA, 18 bp, Artificial Sequence
  Target B2M Sequence complement
gaattccaaattctgctt

SEQ ID NO: 9680 - DNA, 18 bp, Artificial Sequence
  Target B2M Sequence complement
aattccaaattctgcttg

SEQ ID NO: 9681 - DNA, 18 bp, Artificial Sequence
  Target B2M Sequence complement
attccaaattctgcttgc

SEQ ID NO: 9682 - DNA, 18 bp, Artificial Sequence
  Target B2M Sequence complement
ttccaaattctgcttgct

SEQ ID NO: 9683 - DNA, 18 bp, Artificial Sequence
  Target B2M Sequence complement
tccaaattctgcttgctt

SEQ ID NO: 9684 - DNA, 18 bp, Artificial Sequence
  Target B2M Sequence complement
ccaaattctgcttgcttg

SEQ ID NO: 9685 - DNA, 18 bp, Artificial Sequence
  Target B2M Sequence complement
caaattctgcttgcttgc

SEQ ID NO: 9686 - DNA, 18 bp, Artificial Sequence
  Target B2M Sequence complement
aaattctgcttgcttgct

SEQ ID NO: 9687 - DNA, 18 bp, Artificial Sequence
  Target B2M Sequence complement
aattctgcttgcttgctt

SEQ ID NO: 9688 - DNA, 18 bp, Artificial Sequence
  Target B2M Sequence complement
attctgcttgcttgcttt

SEQ ID NO: 9689 - DNA, 18 bp, Artificial Sequence
  Target B2M Sequence complement
attgatatgcttatacac

SEQ ID NO: 9690 - DNA, 18 bp, Artificial Sequence
  Target B2M Sequence complement
ttgatatgcttatacact

SEQ ID NO: 9691 - DNA, 18 bp, Artificial Sequence
  Target B2M Sequence complement
tgatatgcttatacactt

SEQ ID NO: 9692 - DNA, 18 bp, Artificial Sequence
  Target B2M Sequence complement
gatatgcttatacactta

SEQ ID NO: 9693 - DNA, 18 bp, Artificial Sequence
  Target B2M Sequence complement
atatgcttatacacttac

SEQ ID NO: 9694 - DNA, 18 bp, Artificial Sequence
  Target B2M Sequence complement
tatgcttatacacttaca

SEQ ID NO: 9695 - DNA, 18 bp, Artificial Sequence
  Target B2M Sequence complement
atgcttatacacttacac

SEQ ID NO: 9696 - DNA, 18 bp, Artificial Sequence
  Target B2M Sequence complement
tgcttatacacttacact

SEQ ID NO: 9697 - DNA, 18 bp, Artificial Sequence
  Target B2M Sequence complement
gcttatacacttacactt

SEQ ID NO: 9698 - DNA, 18 bp, Artificial Sequence
  Target B2M Sequence complement
cttatacacttacacttt

SEQ ID NO: 9699 - DNA, 18 bp, Artificial Sequence
  Target B2M Sequence complement
atacacttacactttatg

SEQ ID NO: 9700 - DNA, 18 bp, Artificial Sequence
  Target B2M Sequence complement
tacacttacactttatgc

SEQ ID NO: 9701 - DNA, 18 bp, Artificial Sequence
  Target B2M Sequence complement
acacttacactttatgca

SEQ ID NO: 9702 - DNA, 18 bp, Artificial Sequence
  Target B2M Sequence complement
cacttacactttatgcac

SEQ ID NO: 9703 - DNA, 18 bp, Artificial Sequence
  Target B2M Sequence complement
acttacactttatgcaca

SEQ ID NO: 9704 - DNA, 18 bp, Artificial Sequence
  Target B2M Sequence complement
cttacactttatgcacaa

SEQ ID NO: 9705 - DNA, 18 bp, Artificial Sequence
  Target B2M Sequence complement
ttacactttatgcacaaa

SEQ ID NO: 9706 - DNA, 18 bp, Artificial Sequence
  Target B2M Sequence complement
tgtagggttataataatg

SEQ ID NO: 9707 - DNA, 18 bp, Artificial Sequence
  Target B2M Sequence complement
gtagggttataataatgt

SEQ ID NO: 9708 - DNA, 18 bp, Artificial Sequence
  Target B2M Sequence complement
aataatgttaacatggac

SEQ ID NO: 9709 - DNA, 18 bp, Artificial Sequence
  Target B2M Sequence complement
ataatgttaacatggaca

SEQ ID NO: 9710 - DNA, 18 bp, Artificial Sequence
  Target B2M Sequence complement
taatgttaacatggacat

SEQ ID NO: 9711 - DNA, 18 bp, Artificial Sequence
  Target B2M Sequence complement
aatgttaacatggacatg

SEQ ID NO: 9712 - DNA, 18 bp, Artificial Sequence
  Target B2M Sequence complement
atgttaacatggacatga

SEQ ID NO: 9713 - DNA, 18 bp, Artificial Sequence
  Target B2M Sequence complement
tgttaacatggacatgat

SEQ ID NO: 9714 - DNA, 18 bp, Artificial Sequence
  Target B2M Sequence complement
gttaacatggacatgatc

SEQ ID NO: 9715 - DNA, 18 bp, Artificial Sequence
  Target B2M Sequence complement
ttaacatggacatgatct

SEQ ID NO: 9716 - DNA, 18 bp, Artificial Sequence
  Target B2M Sequence complement
taacatggacatgatctt

SEQ ID NO: 9717 - DNA, 18 bp, Artificial Sequence
  Target B2M Sequence complement
aacatggacatgatcttc

SEQ ID NO: 9718 - DNA, 18 bp, Artificial Sequence
  Target B2M Sequence complement
acatggacatgatcttct

SEQ ID NO: 9719 - DNA, 18 bp, Artificial Sequence
  Target B2M Sequence complement
catggacatgatcttctt

SEQ ID NO: 9720 - DNA, 18 bp, Artificial Sequence
  Target B2M Sequence complement
atggacatgatcttcttt

SEQ ID NO: 9721 - DNA, 18 bp, Artificial Sequence
  Target B2M Sequence complement
tggacatgatcttcttta

SEQ ID NO: 9722 - DNA, 18 bp, Artificial Sequence
  Target B2M Sequence complement
ggacatgatcttctttat

SEQ ID NO: 9723 - DNA, 18 bp, Artificial Sequence
  Target B2M Sequence complement
gacatgatcttctttata

SEQ ID NO: 9724 - DNA, 18 bp, Artificial Sequence
  Target B2M Sequence complement
ataattctactttgagtg

SEQ ID NO: 9725 - DNA, 18 bp, Artificial Sequence
  Target B2M Sequence complement
taattctactttgagtgc

SEQ ID NO: 9726 - DNA, 18 bp, Artificial Sequence
  Target B2M Sequence complement
aattctactttgagtgct

SEQ ID NO: 9727 - DNA, 18 bp, Artificial Sequence
  Target B2M Sequence complement
attctactttgagtgctg

SEQ ID NO: 9728 - DNA, 18 bp, Artificial Sequence
  Target B2M Sequence complement
ttctactttgagtgctgt

SEQ ID NO: 9729 - DNA, 18 bp, Artificial Sequence
  Target B2M Sequence complement
tctactttgagtgctgtc

SEQ ID NO: 9730 - DNA, 18 bp, Artificial Sequence
  Target B2M Sequence complement
ctactttgagtgctgtct

SEQ ID NO: 9731 - DNA, 18 bp, Artificial Sequence
  Target B2M Sequence complement
tactttgagtgctgtctc

SEQ ID NO: 9732 - DNA, 18 bp, Artificial Sequence
  Target B2M Sequence complement
actttgagtgctgtctcc

SEQ ID NO: 9733 - DNA, 18 bp, Artificial Sequence
  Target B2M Sequence complement
ctttgagtgctgtctcca

SEQ ID NO: 9734 - DNA, 18 bp, Artificial Sequence
  Target B2M Sequence complement
tttgagtgctgtctccat

SEQ ID NO: 9735 - DNA, 18 bp, Artificial Sequence
  Target B2M Sequence complement
ttgagtgctgtctccatg

SEQ ID NO: 9736 - DNA, 18 bp, Artificial Sequence
  Target B2M Sequence complement
tgagtgctgtctccatgt

SEQ ID NO: 9737 - DNA, 18 bp, Artificial Sequence
  Target B2M Sequence complement
gagtgctgtctccatgtt

SEQ ID NO: 9738 - DNA, 18 bp, Artificial Sequence
  Target B2M Sequence complement
agtgctgtctccatgttt

SEQ ID NO: 9739 - DNA, 18 bp, Artificial Sequence
  Target B2M Sequence complement
gtgctgtctccatgtttg

SEQ ID NO: 9740 - DNA, 18 bp, Artificial Sequence
  Target B2M Sequence complement
tgctgtctccatgtttga

SEQ ID NO: 9741 - DNA, 18 bp, Artificial Sequence
  Target B2M Sequence complement
gctgtctccatgtttgat

SEQ ID NO: 9742 - DNA, 18 bp, Artificial Sequence
  Target B2M Sequence complement
ctgtctccatgtttgatg

SEQ ID NO: 9743 - DNA, 18 bp, Artificial Sequence
  Target B2M Sequence complement
tgtctccatgtttgatgt

SEQ ID NO: 9744 - DNA, 18 bp, Artificial Sequence
  Target B2M Sequence complement
gtctccatgtttgatgta

SEQ ID NO: 9745 - DNA, 18 bp, Artificial Sequence
  Target B2M Sequence complement
tctccatgtttgatgtat

SEQ ID NO: 9746 - DNA, 18 bp, Artificial Sequence
  Target B2M Sequence complement
ctccatgtttgatgtatc

SEQ ID NO: 9747 - DNA, 18 bp, Artificial Sequence
  Target B2M Sequence complement
tccatgtttgatgtatct

SEQ ID NO: 9748 - DNA, 18 bp, Artificial Sequence
  Target B2M Sequence complement
ccatgtttgatgtatctg

SEQ ID NO: 9749 - DNA, 18 bp, Artificial Sequence
  Target B2M Sequence complement
catgtttgatgtatctga

SEQ ID NO: 9750 - DNA, 18 bp, Artificial Sequence
  Target B2M Sequence complement
atgtttgatgtatctgag

SEQ ID NO: 9751 - DNA, 18 bp, Artificial Sequence
  Target B2M Sequence complement
tgtttgatgtatctgagc

SEQ ID NO: 9752 - DNA, 18 bp, Artificial Sequence
  Target B2M Sequence complement
gtttgatgtatctgagca

SEQ ID NO: 9753 - DNA, 18 bp, Artificial Sequence
  Target B2M Sequence complement
tttgatgtatctgagcag

SEQ ID NO: 9754 - DNA, 18 bp, Artificial Sequence
  Target B2M Sequence complement
ttgatgtatctgagcagg

SEQ ID NO: 9755 - DNA, 18 bp, Artificial Sequence
  Target B2M Sequence complement
tgatgtatctgagcaggt

SEQ ID NO: 9756 - DNA, 18 bp, Artificial Sequence
  Target B2M Sequence complement
gatgtatctgagcaggtt

SEQ ID NO: 9757 - DNA, 18 bp, Artificial Sequence
  Target B2M Sequence complement
atgtatctgagcaggttg

SEQ ID NO: 9758 - DNA, 18 bp, Artificial Sequence
  Target B2M Sequence complement
tgtatctgagcaggttgc

SEQ ID NO: 9759 - DNA, 18 bp, Artificial Sequence
  Target B2M Sequence complement
gtatctgagcaggttgct

SEQ ID NO: 9760 - DNA, 18 bp, Artificial Sequence
  Target B2M Sequence complement
tatctgagcaggttgctc

SEQ ID NO: 9761 - DNA, 18 bp, Artificial Sequence
  Target B2M Sequence complement
atctgagcaggttgctcc

SEQ ID NO: 9762 - DNA, 18 bp, Artificial Sequence
  Target B2M Sequence complement
tctgagcaggttgctcca

SEQ ID NO: 9763 - DNA, 18 bp, Artificial Sequence
  Target B2M Sequence complement
tgagcaggttgctccaca

SEQ ID NO: 9764 - DNA, 18 bp, Artificial Sequence
  Target B2M Sequence complement
caggttgctccacaggta

SEQ ID NO: 9765 - DNA, 18 bp, Artificial Sequence
  Target B2M Sequence complement
aggttgctccacaggtag

SEQ ID NO: 9766 - DNA, 18 bp, Artificial Sequence
  Target B2M Sequence complement
gttgctccacaggtagct

SEQ ID NO: 9767 - DNA, 18 bp, Artificial Sequence
  Target B2M Sequence complement
ttgctccacaggtagctc

SEQ ID NO: 9768 - DNA, 18 bp, Artificial Sequence
  Target B2M Sequence complement
tgctccacaggtagctct

SEQ ID NO: 9769 - DNA, 18 bp, Artificial Sequence
  Target B2M Sequence complement
gctccacaggtagctcta

SEQ ID NO: 9770 - DNA, 18 bp, Artificial Sequence
  Target B2M Sequence complement
ctccacaggtagctctag

SEQ ID NO: 9771 - DNA, 18 bp, Artificial Sequence
  Target B2M Sequence complement
tccacaggtagctctagg

SEQ ID NO: 9772 - DNA, 18 bp, Artificial Sequence
  Target B2M Sequence complement
ccacaggtagctctagga

SEQ ID NO: 9773 - DNA, 18 bp, Artificial Sequence
  Target B2M Sequence complement
cacaggtagctctaggag

SEQ ID NO: 9774 - DNA, 18 bp, Artificial Sequence
  Target B2M Sequence complement
acaggtagctctaggagg

SEQ ID NO: 9775 - DNA, 18 bp, Artificial Sequence
  Target B2M Sequence complement
taggagggctggcaactt

SEQ ID NO: 9776 - DNA, 18 bp, Artificial Sequence
  Target B2M Sequence complement
aggagggctggcaactta

SEQ ID NO: 9777 - DNA, 18 bp, Artificial Sequence
  Target B2M Sequence complement
gagggctggcaacttaga

SEQ ID NO: 9778 - DNA, 18 bp, Artificial Sequence
  Target B2M Sequence complement
agggctggcaacttagag

SEQ ID NO: 9779 - DNA, 18 bp, Artificial Sequence
  Target B2M Sequence complement
ggctggcaacttagaggt

SEQ ID NO: 9780 - DNA, 18 bp, Artificial Sequence
  Target B2M Sequence complement
gctggcaacttagaggtg

SEQ ID NO: 9781 - DNA, 18 bp, Artificial Sequence
  Target B2M Sequence complement
ctggcaacttagaggtgg

SEQ ID NO: 9782 - DNA, 18 bp, Artificial Sequence
  Target B2M Sequence complement
tggcaacttagaggtggg

SEQ ID NO: 9783 - DNA, 18 bp, Artificial Sequence
  Target B2M Sequence complement
gggagcagagaattctct

SEQ ID NO: 9784 - DNA, 18 bp, Artificial Sequence
  Target B2M Sequence complement
ggagcagagaattctctt

SEQ ID NO: 9785 - DNA, 18 bp, Artificial Sequence
  Target B2M Sequence complement
gagcagagaattctctta

SEQ ID NO: 9786 - DNA, 18 bp, Artificial Sequence
  Target B2M Sequence complement
agcagagaattctcttat

SEQ ID NO: 9787 - DNA, 18 bp, Artificial Sequence
  Target B2M Sequence complement
gcagagaattctcttatc

SEQ ID NO: 9788 - DNA, 18 bp, Artificial Sequence
  Target B2M Sequence complement
cagagaattctcttatcc

SEQ ID NO: 9789 - DNA, 18 bp, Artificial Sequence
  Target B2M Sequence complement
agagaattctcttatcca

SEQ ID NO: 9790 - DNA, 18 bp, Artificial Sequence
  Target B2M Sequence complement
gagaattctcttatccaa

SEQ ID NO: 9791 - DNA, 18 bp, Artificial Sequence
  Target B2M Sequence complement
agaattctcttatccaac

SEQ ID NO: 9792 - DNA, 18 bp, Artificial Sequence
  Target B2M Sequence complement
gaattctcttatccaaca

SEQ ID NO: 9793 - DNA, 18 bp, Artificial Sequence
  Target B2M Sequence complement
aattctcttatccaacat

SEQ ID NO: 9794 - DNA, 18 bp, Artificial Sequence
  Target B2M Sequence complement
attctcttatccaacatc

SEQ ID NO: 9795 - DNA, 18 bp, Artificial Sequence
  Target B2M Sequence complement
ttctcttatccaacatca

SEQ ID NO: 9796 - DNA, 18 bp, Artificial Sequence
  Target B2M Sequence complement
tctcttatccaacatcaa

SEQ ID NO: 9797 - DNA, 18 bp, Artificial Sequence
  Target B2M Sequence complement
ctcttatccaacatcaac

SEQ ID NO: 9798 - DNA, 18 bp, Artificial Sequence
  Target B2M Sequence complement
tcttatccaacatcaaca

SEQ ID NO: 9799 - DNA, 18 bp, Artificial Sequence
  Target B2M Sequence complement
cttatccaacatcaacat

SEQ ID NO: 9800 - DNA, 18 bp, Artificial Sequence
  Target B2M Sequence complement
ttatccaacatcaacatc

SEQ ID NO: 9801 - DNA, 18 bp, Artificial Sequence
  Target B2M Sequence complement
tatccaacatcaacatct

SEQ ID NO: 9802 - DNA, 18 bp, Artificial Sequence
  Target B2M Sequence complement
atccaacatcaacatctt

SEQ ID NO: 9803 - DNA, 18 bp, Artificial Sequence
  Target B2M Sequence complement
tccaacatcaacatcttg

SEQ ID NO: 9804 - DNA, 18 bp, Artificial Sequence
  Target B2M Sequence complement
ccaacatcaacatcttgg

SEQ ID NO: 9805 - DNA, 18 bp, Artificial Sequence
  Target B2M Sequence complement
caacatcaacatcttggt

SEQ ID NO: 9806 - DNA, 18 bp, Artificial Sequence
  Target B2M Sequence complement
aacatcaacatcttggtc

SEQ ID NO: 9807 - DNA, 18 bp, Artificial Sequence
  Target B2M Sequence complement
acatcaacatcttggtca

SEQ ID NO: 9808 - DNA, 18 bp, Artificial Sequence
  Target B2M Sequence complement
catcaacatcttggtcag

SEQ ID NO: 9809 - DNA, 18 bp, Artificial Sequence
  Target B2M Sequence complement
atcaacatcttggtcaga

SEQ ID NO: 9810 - DNA, 18 bp, Artificial Sequence
  Target B2M Sequence complement
tcaacatcttggtcagat

SEQ ID NO: 9811 - DNA, 18 bp, Artificial Sequence
  Target B2M Sequence complement
caacatcttggtcagatt

SEQ ID NO: 9812 - DNA, 18 bp, Artificial Sequence
  Target B2M Sequence complement
aacatcttggtcagattt

SEQ ID NO: 9813 - DNA, 18 bp, Artificial Sequence
  Target B2M Sequence complement
acatcttggtcagatttg

SEQ ID NO: 9814 - DNA, 18 bp, Artificial Sequence
  Target B2M Sequence complement
catcttggtcagatttga

SEQ ID NO: 9815 - DNA, 18 bp, Artificial Sequence
  Target B2M Sequence complement
atcttggtcagatttgaa

SEQ ID NO: 9816 - DNA, 18 bp, Artificial Sequence
  Target B2M Sequence complement
tcttggtcagatttgaac

SEQ ID NO: 9817 - DNA, 18 bp, Artificial Sequence
  Target B2M Sequence complement
cttggtcagatttgaact

SEQ ID NO: 9818 - DNA, 18 bp, Artificial Sequence
  Target B2M Sequence complement
ttggtcagatttgaactc

SEQ ID NO: 9819 - DNA, 18 bp, Artificial Sequence
  Target B2M Sequence complement
tggtcagatttgaactct

SEQ ID NO: 9820 - DNA, 18 bp, Artificial Sequence
  Target B2M Sequence complement
ggtcagatttgaactctt

SEQ ID NO: 9821 - DNA, 18 bp, Artificial Sequence
  Target B2M Sequence complement
gtcagatttgaactcttc

SEQ ID NO: 9822 - DNA, 18 bp, Artificial Sequence
  Target B2M Sequence complement
tcagatttgaactcttca

SEQ ID NO: 9823 - DNA, 18 bp, Artificial Sequence
  Target B2M Sequence complement
cagatttgaactcttcaa

SEQ ID NO: 9824 - DNA, 18 bp, Artificial Sequence
  Target B2M Sequence complement
agatttgaactcttcaat

SEQ ID NO: 9825 - DNA, 18 bp, Artificial Sequence
  Target B2M Sequence complement
gatttgaactcttcaatc

SEQ ID NO: 9826 - DNA, 18 bp, Artificial Sequence
  Target B2M Sequence complement
atttgaactcttcaatct

SEQ ID NO: 9827 - DNA, 18 bp, Artificial Sequence
  Target B2M Sequence complement
tttgaactcttcaatctc

SEQ ID NO: 9828 - DNA, 18 bp, Artificial Sequence
  Target B2M Sequence complement
ttgaactcttcaatctct

SEQ ID NO: 9829 - DNA, 18 bp, Artificial Sequence
  Target B2M Sequence complement
tgaactcttcaatctctt

SEQ ID NO: 9830 - DNA, 18 bp, Artificial Sequence
  Target B2M Sequence complement
gaactcttcaatctcttg

SEQ ID NO: 9831 - DNA, 18 bp, Artificial Sequence
  Target B2M Sequence complement
aactcttcaatctcttgc

SEQ ID NO: 9832 - DNA, 18 bp, Artificial Sequence
  Target B2M Sequence complement
actcttcaatctcttgca

SEQ ID NO: 9833 - DNA, 18 bp, Artificial Sequence
  Target B2M Sequence complement
ctcttcaatctcttgcac

SEQ ID NO: 9834 - DNA, 18 bp, Artificial Sequence
  Target B2M Sequence complement
tcttcaatctcttgcact

SEQ ID NO: 9835 - DNA, 18 bp, Artificial Sequence
  Target B2M Sequence complement
cttcaatctcttgcactc

SEQ ID NO: 9836 - DNA, 18 bp, Artificial Sequence
  Target B2M Sequence complement
ttcaatctcttgcactca

SEQ ID NO: 9837 - DNA, 18 bp, Artificial Sequence
  Target B2M Sequence complement
tcaatctcttgcactcaa

SEQ ID NO: 9838 - DNA, 18 bp, Artificial Sequence
  Target B2M Sequence complement
caatctcttgcactcaaa

SEQ ID NO: 9839 - DNA, 18 bp, Artificial Sequence
  Target B2M Sequence complement
aatctcttgcactcaaag

SEQ ID NO: 9840 - DNA, 18 bp, Artificial Sequence
  Target B2M Sequence complement
atctcttgcactcaaagc

SEQ ID NO: 9841 - DNA, 18 bp, Artificial Sequence
  Target B2M Sequence complement
tctcttgcactcaaagct

SEQ ID NO: 9842 - DNA, 18 bp, Artificial Sequence
  Target B2M Sequence complement
ctcttgcactcaaagctt

SEQ ID NO: 9843 - DNA, 18 bp, Artificial Sequence
  Target B2M Sequence complement
tcttgcactcaaagcttg

SEQ ID NO: 9844 - DNA, 18 bp, Artificial Sequence
  Target B2M Sequence complement
cttgcactcaaagcttgt

SEQ ID NO: 9845 - DNA, 18 bp, Artificial Sequence
  Target B2M Sequence complement
ttgcactcaaagcttgtt

SEQ ID NO: 9846 - DNA, 18 bp, Artificial Sequence
  Target B2M Sequence complement
tgcactcaaagcttgtta

SEQ ID NO: 9847 - DNA, 18 bp, Artificial Sequence
  Target B2M Sequence complement
gcactcaaagcttgttaa

SEQ ID NO: 9848 - DNA, 18 bp, Artificial Sequence
  Target B2M Sequence complement
cactcaaagcttgttaag

SEQ ID NO: 9849 - DNA, 18 bp, Artificial Sequence
  Target B2M Sequence complement
actcaaagcttgttaaga

SEQ ID NO: 9850 - DNA, 18 bp, Artificial Sequence
  Target B2M Sequence complement
ctcaaagcttgttaagat

SEQ ID NO: 9851 - DNA, 18 bp, Artificial Sequence
  Target B2M Sequence complement
tcaaagcttgttaagata

SEQ ID NO: 9852 - DNA, 18 bp, Artificial Sequence
  Target B2M Sequence complement
caaagcttgttaagatag

SEQ ID NO: 9853 - DNA, 18 bp, Artificial Sequence
  Target B2M Sequence complement
aaagcttgttaagatagt

SEQ ID NO: 9854 - DNA, 18 bp, Artificial Sequence
  Target B2M Sequence complement
aagcttgttaagatagtt

SEQ ID NO: 9855 - DNA, 18 bp, Artificial Sequence
  Target B2M Sequence complement
agcttgttaagatagtta

SEQ ID NO: 9856 - DNA, 18 bp, Artificial Sequence
  Target B2M Sequence complement
gcttgttaagatagttaa

SEQ ID NO: 9857 - DNA, 18 bp, Artificial Sequence
  Target B2M Sequence complement
cttgttaagatagttaag

SEQ ID NO: 9858 - DNA, 18 bp, Artificial Sequence
  Target B2M Sequence complement
ttgttaagatagttaagc

SEQ ID NO: 9859 - DNA, 18 bp, Artificial Sequence
  Target B2M Sequence complement
tgttaagatagttaagcg

SEQ ID NO: 9860 - DNA, 18 bp, Artificial Sequence
  Target B2M Sequence complement
gttaagatagttaagcgt

SEQ ID NO: 9861 - DNA, 18 bp, Artificial Sequence
  Target B2M Sequence complement
ttaagatagttaagcgtg

SEQ ID NO: 9862 - DNA, 18 bp, Artificial Sequence
  Target B2M Sequence complement
taagatagttaagcgtgc

SEQ ID NO: 9863 - DNA, 18 bp, Artificial Sequence
  Target B2M Sequence complement
aagatagttaagcgtgca

SEQ ID NO: 9864 - DNA, 18 bp, Artificial Sequence
  Target B2M Sequence complement
agatagttaagcgtgcat

SEQ ID NO: 9865 - DNA, 18 bp, Artificial Sequence
  Target B2M Sequence complement
gatagttaagcgtgcata

SEQ ID NO: 9866 - DNA, 18 bp, Artificial Sequence
  Target B2M Sequence complement
atagttaagcgtgcataa

SEQ ID NO: 9867 - DNA, 18 bp, Artificial Sequence
  Target B2M Sequence complement
tagttaagcgtgcataag

SEQ ID NO: 9868 - DNA, 18 bp, Artificial Sequence
  Target B2M Sequence complement
agttaagcgtgcataagt

SEQ ID NO: 9869 - DNA, 18 bp, Artificial Sequence
  Target B2M Sequence complement
gttaagcgtgcataagtt

SEQ ID NO: 9870 - DNA, 18 bp, Artificial Sequence
  Target B2M Sequence complement
ttaagcgtgcataagtta

SEQ ID NO: 9871 - DNA, 18 bp, Artificial Sequence
  Target B2M Sequence complement
taagcgtgcataagttaa

SEQ ID NO: 9872 - DNA, 18 bp, Artificial Sequence
  Target B2M Sequence complement
aagcgtgcataagttaac

SEQ ID NO: 9873 - DNA, 18 bp, Artificial Sequence
  Target B2M Sequence complement
agcgtgcataagttaact

SEQ ID NO: 9874 - DNA, 18 bp, Artificial Sequence
  Target B2M Sequence complement
gcgtgcataagttaactt

SEQ ID NO: 9875 - DNA, 18 bp, Artificial Sequence
  Target B2M Sequence complement
cgtgcataagttaacttc

SEQ ID NO: 9876 - DNA, 18 bp, Artificial Sequence
  Target B2M Sequence complement
gtgcataagttaacttcc

SEQ ID NO: 9877 - DNA, 18 bp, Artificial Sequence
  Target B2M Sequence complement
tgcataagttaacttcca

SEQ ID NO: 9878 - DNA, 18 bp, Artificial Sequence
  Target B2M Sequence complement
gcataagttaacttccaa

SEQ ID NO: 9879 - DNA, 18 bp, Artificial Sequence
  Target B2M Sequence complement
cataagttaacttccaat

SEQ ID NO: 9880 - DNA, 18 bp, Artificial Sequence
  Target B2M Sequence complement
agttaacttccaatttac

SEQ ID NO: 9881 - DNA, 18 bp, Artificial Sequence
  Target B2M Sequence complement
gttaacttccaatttaca

SEQ ID NO: 9882 - DNA, 18 bp, Artificial Sequence
  Target B2M Sequence complement
aacttccaatttacatac

SEQ ID NO: 9883 - DNA, 18 bp, Artificial Sequence
  Target B2M Sequence complement
acttccaatttacatact

SEQ ID NO: 9884 - DNA, 18 bp, Artificial Sequence
  Target B2M Sequence complement
cttccaatttacatactc

SEQ ID NO: 9885 - DNA, 18 bp, Artificial Sequence
  Target B2M Sequence complement
ttccaatttacatactct

SEQ ID NO: 9886 - DNA, 18 bp, Artificial Sequence
  Target B2M Sequence complement
tccaatttacatactctg

SEQ ID NO: 9887 - DNA, 18 bp, Artificial Sequence
  Target B2M Sequence complement
ccaatttacatactctgc

SEQ ID NO: 9888 - DNA, 18 bp, Artificial Sequence
  Target B2M Sequence complement
caatttacatactctgct

SEQ ID NO: 9889 - DNA, 18 bp, Artificial Sequence
  Target B2M Sequence complement
aatttacatactctgctt

SEQ ID NO: 9890 - DNA, 18 bp, Artificial Sequence
  Target B2M Sequence complement
atttacatactctgctta

SEQ ID NO: 9891 - DNA, 18 bp, Artificial Sequence
  Target B2M Sequence complement
tttacatactctgcttag

SEQ ID NO: 9892 - DNA, 18 bp, Artificial Sequence
  Target B2M Sequence complement
ttacatactctgcttaga

SEQ ID NO: 9893 - DNA, 18 bp, Artificial Sequence
  Target B2M Sequence complement
tacatactctgcttagaa

SEQ ID NO: 9894 - DNA, 18 bp, Artificial Sequence
  Target B2M Sequence complement
acatactctgcttagaat

SEQ ID NO: 9895 - DNA, 18 bp, Artificial Sequence
  Target B2M Sequence complement
catactctgcttagaatt

SEQ ID NO: 9896 - DNA, 18 bp, Artificial Sequence
  Target B2M Sequence complement
atactctgcttagaattt

SEQ ID NO: 9897 - DNA, 18 bp, Artificial Sequence
  Target B2M Sequence complement
tactctgcttagaatttg

SEQ ID NO: 9898 - DNA, 18 bp, Artificial Sequence
  Target B2M Sequence complement
actctgcttagaatttgg

SEQ ID NO: 9899 - DNA, 18 bp, Artificial Sequence
  Target B2M Sequence complement
ctctgcttagaatttggg

SEQ ID NO: 9900 - DNA, 18 bp, Artificial Sequence
  Target B2M Sequence complement
agaaatataattgacagg

SEQ ID NO: 9901 - DNA, 18 bp, Artificial Sequence
  Target B2M Sequence complement
gaaatataattgacagga

SEQ ID NO: 9902 - DNA, 18 bp, Artificial Sequence
  Target B2M Sequence complement
taattgacaggattattg

SEQ ID NO: 9903 - DNA, 18 bp, Artificial Sequence
  Target B2M Sequence complement
aattgacaggattattgg

SEQ ID NO: 9904 - DNA, 18 bp, Artificial Sequence
  Target B2M Sequence complement
attgacaggattattgga

SEQ ID NO: 9905 - DNA, 18 bp, Artificial Sequence
  Target B2M Sequence complement
ttgacaggattattggaa

SEQ ID NO: 9906 - DNA, 18 bp, Artificial Sequence
  Target B2M Sequence complement
tgacaggattattggaaa

SEQ ID NO: 9907 - DNA, 18 bp, Artificial Sequence
  Target B2M Sequence complement
gacaggattattggaaat

SEQ ID NO: 9908 - DNA, 18 bp, Artificial Sequence
  Target B2M Sequence complement
acaggattattggaaatt

SEQ ID NO: 9909 - DNA, 18 bp, Artificial Sequence
  Target B2M Sequence complement
caggattattggaaattt

SEQ ID NO: 9910 - DNA, 18 bp, Artificial Sequence
  Target B2M Sequence complement
aggattattggaaatttg

SEQ ID NO: 9911 - DNA, 18 bp, Artificial Sequence
  Target B2M Sequence complement
ggattattggaaatttgt

SEQ ID NO: 9912 - DNA, 18 bp, Artificial Sequence
  Target B2M Sequence complement
acatttgataaagtaagg

SEQ ID NO: 9913 - DNA, 18 bp, Artificial Sequence
  Target B2M Sequence complement
catttgataaagtaaggc

SEQ ID NO: 9914 - DNA, 18 bp, Artificial Sequence
  Target B2M Sequence complement
atttgataaagtaaggca

SEQ ID NO: 9915 - DNA, 18 bp, Artificial Sequence
  Target B2M Sequence complement
tttgataaagtaaggcat

SEQ ID NO: 9916 - DNA, 18 bp, Artificial Sequence
  Target B2M Sequence complement
ttgataaagtaaggcatg

SEQ ID NO: 9917 - DNA, 18 bp, Artificial Sequence
  Target B2M Sequence complement
tgataaagtaaggcatgg

SEQ ID NO: 9918 - DNA, 18 bp, Artificial Sequence
  Target B2M Sequence complement
gataaagtaaggcatggt

SEQ ID NO: 9919 - DNA, 18 bp, Artificial Sequence
  Target B2M Sequence complement
ataaagtaaggcatggtt

SEQ ID NO: 9920 - DNA, 18 bp, Artificial Sequence
  Target B2M Sequence complement
taaagtaaggcatggttg

SEQ ID NO: 9921 - DNA, 18 bp, Artificial Sequence
  Target B2M Sequence complement
aaagtaaggcatggttgt

SEQ ID NO: 9922 - DNA, 18 bp, Artificial Sequence
  Target B2M Sequence complement
aagtaaggcatggttgtg

SEQ ID NO: 9923 - DNA, 18 bp, Artificial Sequence
  Target B2M Sequence complement
agtaaggcatggttgtgg

SEQ ID NO: 9924 - DNA, 18 bp, Artificial Sequence
  Target B2M Sequence complement
gtaaggcatggttgtggt

SEQ ID NO: 9925 - DNA, 18 bp, Artificial Sequence
  Target B2M Sequence complement
taaggcatggttgtggtt

SEQ ID NO: 9926 - DNA, 18 bp, Artificial Sequence
  Target B2M Sequence complement
aaggcatggttgtggtta

SEQ ID NO: 9927 - DNA, 18 bp, Artificial Sequence
  Target B2M Sequence complement
aggcatggttgtggttaa

SEQ ID NO: 9928 - DNA, 18 bp, Artificial Sequence
  Target B2M Sequence complement
ggcatggttgtggttaat

SEQ ID NO: 9929 - DNA, 18 bp, Artificial Sequence
  Target B2M Sequence complement
gcatggttgtggttaatc

SEQ ID NO: 9930 - DNA, 18 bp, Artificial Sequence
  Target B2M Sequence complement
catggttgtggttaatct

SEQ ID NO: 9931 - DNA, 18 bp, Artificial Sequence
  Target B2M Sequence complement
atggttgtggttaatctg

SEQ ID NO: 9932 - DNA, 18 bp, Artificial Sequence
  Target B2M Sequence complement
tggttgtggttaatctgg

SEQ ID NO: 9933 - DNA, 18 bp, Artificial Sequence
  Target B2M Sequence complement
ggttgtggttaatctggt

SEQ ID NO: 9934 - DNA, 18 bp, Artificial Sequence
  Target B2M Sequence complement
gttgtggttaatctggtt

SEQ ID NO: 9935 - DNA, 18 bp, Artificial Sequence
  Target B2M Sequence complement
ttgtggttaatctggttt

SEQ ID NO: 9936 - DNA, 18 bp, Artificial Sequence
  Target B2M Sequence complement
tgtggttaatctggttta

SEQ ID NO: 9937 - DNA, 18 bp, Artificial Sequence
  Target B2M Sequence complement
gtggttaatctggtttat

SEQ ID NO: 9938 - DNA, 18 bp, Artificial Sequence
  Target B2M Sequence complement
tggttaatctggtttatt

SEQ ID NO: 9939 - DNA, 18 bp, Artificial Sequence
  Target B2M Sequence complement
ggttaatctggtttattt

SEQ ID NO: 9940 - DNA, 18 bp, Artificial Sequence
  Target B2M Sequence complement
tttgttccacaagttaaa

SEQ ID NO: 9941 - DNA, 18 bp, Artificial Sequence
  Target B2M Sequence complement
ttgttccacaagttaaat

SEQ ID NO: 9942 - DNA, 18 bp, Artificial Sequence
  Target B2M Sequence complement
tgttccacaagttaaata

SEQ ID NO: 9943 - DNA, 18 bp, Artificial Sequence
  Target B2M Sequence complement
gttccacaagttaaataa

SEQ ID NO: 9944 - DNA, 18 bp, Artificial Sequence
  Target B2M Sequence complement
ccacaagttaaataaatc

SEQ ID NO: 9945 - DNA, 19 bp, Artificial Sequence
  Target B2M Sequence complement
attcctgaagctgacagca

SEQ ID NO: 9946 - DNA, 19 bp, Artificial Sequence
  Target B2M Sequence complement
ttcctgaagctgacagcat

SEQ ID NO: 9947 - DNA, 19 bp, Artificial Sequence
  Target B2M Sequence complement
tcctgaagctgacagcatt

SEQ ID NO: 9948 - DNA, 19 bp, Artificial Sequence
  Target B2M Sequence complement
cctgaagctgacagcattc

SEQ ID NO: 9949 - DNA, 19 bp, Artificial Sequence
  Target B2M Sequence complement
ctgaagctgacagcattcg

SEQ ID NO: 9950 - DNA, 19 bp, Artificial Sequence
  Target B2M Sequence complement
tgaagctgacagcattcgg

SEQ ID NO: 9951 - DNA, 19 bp, Artificial Sequence
  Target B2M Sequence complement
gaagctgacagcattcggg

SEQ ID NO: 9952 - DNA, 19 bp, Artificial Sequence
  Target B2M Sequence complement
aagctgacagcattcgggc

SEQ ID NO: 9953 - DNA, 19 bp, Artificial Sequence
  Target B2M Sequence complement
cttagctgtgctcgcgcta

SEQ ID NO: 9954 - DNA, 19 bp, Artificial Sequence
  Target B2M Sequence complement
ttagctgtgctcgcgctac

SEQ ID NO: 9955 - DNA, 19 bp, Artificial Sequence
  Target B2M Sequence complement
tagctgtgctcgcgctact

SEQ ID NO: 9956 - DNA, 19 bp, Artificial Sequence
  Target B2M Sequence complement
tgtgctcgcgctactctct

SEQ ID NO: 9957 - DNA, 19 bp, Artificial Sequence
  Target B2M Sequence complement
tgctcgcgctactctctct

SEQ ID NO: 9958 - DNA, 19 bp, Artificial Sequence
  Target B2M Sequence complement
gctcgcgctactctctctt

SEQ ID NO: 9959 - DNA, 19 bp, Artificial Sequence
  Target B2M Sequence complement
ctcgcgctactctctcttt

SEQ ID NO: 9960 - DNA, 19 bp, Artificial Sequence
  Target B2M Sequence complement
tcgcgctactctctctttc

SEQ ID NO: 9961 - DNA, 19 bp, Artificial Sequence
  Target B2M Sequence complement
cgcgctactctctctttct

SEQ ID NO: 9962 - DNA, 19 bp, Artificial Sequence
  Target B2M Sequence complement
gcgctactctctctttctg

SEQ ID NO: 9963 - DNA, 19 bp, Artificial Sequence
  Target B2M Sequence complement
cgctactctctctttctgg

SEQ ID NO: 9964 - DNA, 19 bp, Artificial Sequence
  Target B2M Sequence complement
gctactctctctttctggc

SEQ ID NO: 9965 - DNA, 19 bp, Artificial Sequence
  Target B2M Sequence complement
ctactctctctttctggcc

SEQ ID NO: 9966 - DNA, 19 bp, Artificial Sequence
  Target B2M Sequence complement
tactctctctttctggcct

SEQ ID NO: 9967 - DNA, 19 bp, Artificial Sequence
  Target B2M Sequence complement
actctctctttctggcctg

SEQ ID NO: 9968 - DNA, 19 bp, Artificial Sequence
  Target B2M Sequence complement
ctctctctttctggcctgg

SEQ ID NO: 9969 - DNA, 19 bp, Artificial Sequence
  Target B2M Sequence complement
tctctctttctggcctgga

SEQ ID NO: 9970 - DNA, 19 bp, Artificial Sequence
  Target B2M Sequence complement
ctctctttctggcctggag

SEQ ID NO: 9971 - DNA, 19 bp, Artificial Sequence
  Target B2M Sequence complement
tctctttctggcctggagg

SEQ ID NO: 9972 - DNA, 19 bp, Artificial Sequence
  Target B2M Sequence complement
tctttctggcctggaggct

SEQ ID NO: 9973 - DNA, 19 bp, Artificial Sequence
  Target B2M Sequence complement
ctttctggcctggaggcta

SEQ ID NO: 9974 - DNA, 19 bp, Artificial Sequence
  Target B2M Sequence complement
tttctggcctggaggctat

SEQ ID NO: 9975 - DNA, 19 bp, Artificial Sequence
  Target B2M Sequence complement
ttctggcctggaggctatc

SEQ ID NO: 9976 - DNA, 19 bp, Artificial Sequence
  Target B2M Sequence complement
ctggaggctatccagcgta

SEQ ID NO: 9977 - DNA, 19 bp, Artificial Sequence
  Target B2M Sequence complement
tggaggctatccagcgtac

SEQ ID NO: 9978 - DNA, 19 bp, Artificial Sequence
  Target B2M Sequence complement
ggaggctatccagcgtact

SEQ ID NO: 9979 - DNA, 19 bp, Artificial Sequence
  Target B2M Sequence complement
gaggctatccagcgtactc

SEQ ID NO: 9980 - DNA, 19 bp, Artificial Sequence
  Target B2M Sequence complement
aggctatccagcgtactcc

SEQ ID NO: 9981 - DNA, 19 bp, Artificial Sequence
  Target B2M Sequence complement
ggctatccagcgtactcca

SEQ ID NO: 9982 - DNA, 19 bp, Artificial Sequence
  Target B2M Sequence complement
gctatccagcgtactccaa

SEQ ID NO: 9983 - DNA, 19 bp, Artificial Sequence
  Target B2M Sequence complement
ctatccagcgtactccaaa

SEQ ID NO: 9984 - DNA, 19 bp, Artificial Sequence
  Target B2M Sequence complement
tatccagcgtactccaaag

SEQ ID NO: 9985 - DNA, 19 bp, Artificial Sequence
  Target B2M Sequence complement
atccagcgtactccaaaga

SEQ ID NO: 9986 - DNA, 19 bp, Artificial Sequence
  Target B2M Sequence complement
tccagcgtactccaaagat

SEQ ID NO: 9987 - DNA, 19 bp, Artificial Sequence
  Target B2M Sequence complement
ccagcgtactccaaagatt

SEQ ID NO: 9988 - DNA, 19 bp, Artificial Sequence
  Target B2M Sequence complement
cagcgtactccaaagattc

SEQ ID NO: 9989 - DNA, 19 bp, Artificial Sequence
  Target B2M Sequence complement
agcgtactccaaagattca

SEQ ID NO: 9990 - DNA, 19 bp, Artificial Sequence
  Target B2M Sequence complement
gcgtactccaaagattcag

SEQ ID NO: 9991 - DNA, 19 bp, Artificial Sequence
  Target B2M Sequence complement
cgtactccaaagattcagg

SEQ ID NO: 9992 - DNA, 19 bp, Artificial Sequence
  Target B2M Sequence complement
gtactccaaagattcaggt

SEQ ID NO: 9993 - DNA, 19 bp, Artificial Sequence
  Target B2M Sequence complement
tactccaaagattcaggtt

SEQ ID NO: 9994 - DNA, 19 bp, Artificial Sequence
  Target B2M Sequence complement
actccaaagattcaggttt

SEQ ID NO: 9995 - DNA, 19 bp, Artificial Sequence
  Target B2M Sequence complement
ctccaaagattcaggttta

SEQ ID NO: 9996 - DNA, 19 bp, Artificial Sequence
  Target B2M Sequence complement
tccaaagattcaggtttac

SEQ ID NO: 9997 - DNA, 19 bp, Artificial Sequence
  Target B2M Sequence complement
ccaaagattcaggtttact

SEQ ID NO: 9998 - DNA, 19 bp, Artificial Sequence
  Target B2M Sequence complement
caaagattcaggtttactc

SEQ ID NO: 9999 - DNA, 19 bp, Artificial Sequence
  Target B2M Sequence complement
aaagattcaggtttactca

SEQ ID NO: 10000 - DNA, 19 bp, Artificial Sequence
  Target B2M Sequence complement
aagattcaggtttactcac

SEQ ID NO: 10001 - DNA, 19 bp, Artificial Sequence
  Target B2M Sequence complement
agattcaggtttactcacg

SEQ ID NO: 10002 - DNA, 19 bp, Artificial Sequence
  Target B2M Sequence complement
gattcaggtttactcacgt

SEQ ID NO: 10003 - DNA, 19 bp, Artificial Sequence
  Target B2M Sequence complement
attcaggtttactcacgtc

SEQ ID NO: 10004 - DNA, 19 bp, Artificial Sequence
  Target B2M Sequence complement
ttcaggtttactcacgtca

SEQ ID NO: 10005 - DNA, 19 bp, Artificial Sequence
  Target B2M Sequence complement
tcaggtttactcacgtcat

SEQ ID NO: 10006 - DNA, 19 bp, Artificial Sequence
  Target B2M Sequence complement
caggtttactcacgtcatc

SEQ ID NO: 10007 - DNA, 19 bp, Artificial Sequence
  Target B2M Sequence complement
aggtttactcacgtcatcc

SEQ ID NO: 10008 - DNA, 19 bp, Artificial Sequence
  Target B2M Sequence complement
ggtttactcacgtcatcca

SEQ ID NO: 10009 - DNA, 19 bp, Artificial Sequence
  Target B2M Sequence complement
gtttactcacgtcatccag

SEQ ID NO: 10010 - DNA, 19 bp, Artificial Sequence
  Target B2M Sequence complement
tttactcacgtcatccagc

SEQ ID NO: 10011 - DNA, 19 bp, Artificial Sequence
  Target B2M Sequence complement
ttactcacgtcatccagca

SEQ ID NO: 10012 - DNA, 19 bp, Artificial Sequence
  Target B2M Sequence complement
tactcacgtcatccagcag

SEQ ID NO: 10013 - DNA, 19 bp, Artificial Sequence
  Target B2M Sequence complement
actcacgtcatccagcaga

SEQ ID NO: 10014 - DNA, 19 bp, Artificial Sequence
  Target B2M Sequence complement
ctcacgtcatccagcagag

SEQ ID NO: 10015 - DNA, 19 bp, Artificial Sequence
  Target B2M Sequence complement
tcacgtcatccagcagaga

SEQ ID NO: 10016 - DNA, 19 bp, Artificial Sequence
  Target B2M Sequence complement
cacgtcatccagcagagaa

SEQ ID NO: 10017 - DNA, 19 bp, Artificial Sequence
  Target B2M Sequence complement
acgtcatccagcagagaat

SEQ ID NO: 10018 - DNA, 19 bp, Artificial Sequence
  Target B2M Sequence complement
cgtcatccagcagagaatg

SEQ ID NO: 10019 - DNA, 19 bp, Artificial Sequence
  Target B2M Sequence complement
gtcatccagcagagaatgg

SEQ ID NO: 10020 - DNA, 19 bp, Artificial Sequence
  Target B2M Sequence complement
tcatccagcagagaatgga

SEQ ID NO: 10021 - DNA, 19 bp, Artificial Sequence
  Target B2M Sequence complement
catccagcagagaatggaa

SEQ ID NO: 10022 - DNA, 19 bp, Artificial Sequence
  Target B2M Sequence complement
atccagcagagaatggaaa

SEQ ID NO: 10023 - DNA, 19 bp, Artificial Sequence
  Target B2M Sequence complement
tccagcagagaatggaaag

SEQ ID NO: 10024 - DNA, 19 bp, Artificial Sequence
  Target B2M Sequence complement
ccagcagagaatggaaagt

SEQ ID NO: 10025 - DNA, 19 bp, Artificial Sequence
  Target B2M Sequence complement
cagcagagaatggaaagtc

SEQ ID NO: 10026 - DNA, 19 bp, Artificial Sequence
  Target B2M Sequence complement
agcagagaatggaaagtca

SEQ ID NO: 10027 - DNA, 19 bp, Artificial Sequence
  Target B2M Sequence complement
gcagagaatggaaagtcaa

SEQ ID NO: 10028 - DNA, 19 bp, Artificial Sequence
  Target B2M Sequence complement
cagagaatggaaagtcaaa

SEQ ID NO: 10029 - DNA, 19 bp, Artificial Sequence
  Target B2M Sequence complement
agagaatggaaagtcaaat

SEQ ID NO: 10030 - DNA, 19 bp, Artificial Sequence
  Target B2M Sequence complement
gagaatggaaagtcaaatt

SEQ ID NO: 10031 - DNA, 19 bp, Artificial Sequence
  Target B2M Sequence complement
agaatggaaagtcaaattt

SEQ ID NO: 10032 - DNA, 19 bp, Artificial Sequence
  Target B2M Sequence complement
gaatggaaagtcaaatttc

SEQ ID NO: 10033 - DNA, 19 bp, Artificial Sequence
  Target B2M Sequence complement
aatggaaagtcaaatttcc

SEQ ID NO: 10034 - DNA, 19 bp, Artificial Sequence
  Target B2M Sequence complement
atggaaagtcaaatttcct

SEQ ID NO: 10035 - DNA, 19 bp, Artificial Sequence
  Target B2M Sequence complement
tggaaagtcaaatttcctg

SEQ ID NO: 10036 - DNA, 19 bp, Artificial Sequence
  Target B2M Sequence complement
ggaaagtcaaatttcctga

SEQ ID NO: 10037 - DNA, 19 bp, Artificial Sequence
  Target B2M Sequence complement
gaaagtcaaatttcctgaa

SEQ ID NO: 10038 - DNA, 19 bp, Artificial Sequence
  Target B2M Sequence complement
aaagtcaaatttcctgaat

SEQ ID NO: 10039 - DNA, 19 bp, Artificial Sequence
  Target B2M Sequence complement
aagtcaaatttcctgaatt

SEQ ID NO: 10040 - DNA, 19 bp, Artificial Sequence
  Target B2M Sequence complement
agtcaaatttcctgaattg

SEQ ID NO: 10041 - DNA, 19 bp, Artificial Sequence
  Target B2M Sequence complement
gtcaaatttcctgaattgc

SEQ ID NO: 10042 - DNA, 19 bp, Artificial Sequence
  Target B2M Sequence complement
tcaaatttcctgaattgct

SEQ ID NO: 10043 - DNA, 19 bp, Artificial Sequence
  Target B2M Sequence complement
caaatttcctgaattgcta

SEQ ID NO: 10044 - DNA, 19 bp, Artificial Sequence
  Target B2M Sequence complement
aaatttcctgaattgctat

SEQ ID NO: 10045 - DNA, 19 bp, Artificial Sequence
  Target B2M Sequence complement
aatttcctgaattgctatg

SEQ ID NO: 10046 - DNA, 19 bp, Artificial Sequence
  Target B2M Sequence complement
atttcctgaattgctatgt

SEQ ID NO: 10047 - DNA, 19 bp, Artificial Sequence
  Target B2M Sequence complement
tttcctgaattgctatgtg

SEQ ID NO: 10048 - DNA, 19 bp, Artificial Sequence
  Target B2M Sequence complement
ttcctgaattgctatgtgt

SEQ ID NO: 10049 - DNA, 19 bp, Artificial Sequence
  Target B2M Sequence complement
tcctgaattgctatgtgtc

SEQ ID NO: 10050 - DNA, 19 bp, Artificial Sequence
  Target B2M Sequence complement
cctgaattgctatgtgtct

SEQ ID NO: 10051 - DNA, 19 bp, Artificial Sequence
  Target B2M Sequence complement
ctgaattgctatgtgtctg

SEQ ID NO: 10052 - DNA, 19 bp, Artificial Sequence
  Target B2M Sequence complement
tgaattgctatgtgtctgg

SEQ ID NO: 10053 - DNA, 19 bp, Artificial Sequence
  Target B2M Sequence complement
gaattgctatgtgtctggg

SEQ ID NO: 10054 - DNA, 19 bp, Artificial Sequence
  Target B2M Sequence complement
aattgctatgtgtctgggt

SEQ ID NO: 10055 - DNA, 19 bp, Artificial Sequence
  Target B2M Sequence complement
attgctatgtgtctgggtt

SEQ ID NO: 10056 - DNA, 19 bp, Artificial Sequence
  Target B2M Sequence complement
ttgctatgtgtctgggttt

SEQ ID NO: 10057 - DNA, 19 bp, Artificial Sequence
  Target B2M Sequence complement
tgctatgtgtctgggtttc

SEQ ID NO: 10058 - DNA, 19 bp, Artificial Sequence
  Target B2M Sequence complement
gctatgtgtctgggtttca

SEQ ID NO: 10059 - DNA, 19 bp, Artificial Sequence
  Target B2M Sequence complement
ctatgtgtctgggtttcat

SEQ ID NO: 10060 - DNA, 19 bp, Artificial Sequence
  Target B2M Sequence complement
tatgtgtctgggtttcatc

SEQ ID NO: 10061 - DNA, 19 bp, Artificial Sequence
  Target B2M Sequence complement
atgtgtctgggtttcatcc

SEQ ID NO: 10062 - DNA, 19 bp, Artificial Sequence
  Target B2M Sequence complement
tgtgtctgggtttcatcca

SEQ ID NO: 10063 - DNA, 19 bp, Artificial Sequence
  Target B2M Sequence complement
gtgtctgggtttcatccat

SEQ ID NO: 10064 - DNA, 19 bp, Artificial Sequence
  Target B2M Sequence complement
tgtctgggtttcatccatc

SEQ ID NO: 10065 - DNA, 19 bp, Artificial Sequence
  Target B2M Sequence complement
gtctgggtttcatccatcc

SEQ ID NO: 10066 - DNA, 19 bp, Artificial Sequence
  Target B2M Sequence complement
tctgggtttcatccatccg

SEQ ID NO: 10067 - DNA, 19 bp, Artificial Sequence
  Target B2M Sequence complement
ctgggtttcatccatccga

SEQ ID NO: 10068 - DNA, 19 bp, Artificial Sequence
  Target B2M Sequence complement
tgggtttcatccatccgac

SEQ ID NO: 10069 - DNA, 19 bp, Artificial Sequence
  Target B2M Sequence complement
gggtttcatccatccgaca

SEQ ID NO: 10070 - DNA, 19 bp, Artificial Sequence
  Target B2M Sequence complement
ggtttcatccatccgacat

SEQ ID NO: 10071 - DNA, 19 bp, Artificial Sequence
  Target B2M Sequence complement
gtttcatccatccgacatt

SEQ ID NO: 10072 - DNA, 19 bp, Artificial Sequence
  Target B2M Sequence complement
tttcatccatccgacattg

SEQ ID NO: 10073 - DNA, 19 bp, Artificial Sequence
  Target B2M Sequence complement
ttcatccatccgacattga

SEQ ID NO: 10074 - DNA, 19 bp, Artificial Sequence
  Target B2M Sequence complement
tcatccatccgacattgaa

SEQ ID NO: 10075 - DNA, 19 bp, Artificial Sequence
  Target B2M Sequence complement
catccatccgacattgaag

SEQ ID NO: 10076 - DNA, 19 bp, Artificial Sequence
  Target B2M Sequence complement
atccatccgacattgaagt

SEQ ID NO: 10077 - DNA, 19 bp, Artificial Sequence
  Target B2M Sequence complement
tccatccgacattgaagtt

SEQ ID NO: 10078 - DNA, 19 bp, Artificial Sequence
  Target B2M Sequence complement
ccatccgacattgaagttg

SEQ ID NO: 10079 - DNA, 19 bp, Artificial Sequence
  Target B2M Sequence complement
catccgacattgaagttga

SEQ ID NO: 10080 - DNA, 19 bp, Artificial Sequence
  Target B2M Sequence complement
atccgacattgaagttgac

SEQ ID NO: 10081 - DNA, 19 bp, Artificial Sequence
  Target B2M Sequence complement
tccgacattgaagttgact

SEQ ID NO: 10082 - DNA, 19 bp, Artificial Sequence
  Target B2M Sequence complement
ccgacattgaagttgactt

SEQ ID NO: 10083 - DNA, 19 bp, Artificial Sequence
  Target B2M Sequence complement
cgacattgaagttgactta

SEQ ID NO: 10084 - DNA, 19 bp, Artificial Sequence
  Target B2M Sequence complement
gacattgaagttgacttac

SEQ ID NO: 10085 - DNA, 19 bp, Artificial Sequence
  Target B2M Sequence complement
acattgaagttgacttact

SEQ ID NO: 10086 - DNA, 19 bp, Artificial Sequence
  Target B2M Sequence complement
cattgaagttgacttactg

SEQ ID NO: 10087 - DNA, 19 bp, Artificial Sequence
  Target B2M Sequence complement
attgaagttgacttactga

SEQ ID NO: 10088 - DNA, 19 bp, Artificial Sequence
  Target B2M Sequence complement
ttgaagttgacttactgaa

SEQ ID NO: 10089 - DNA, 19 bp, Artificial Sequence
  Target B2M Sequence complement
tgaagttgacttactgaag

SEQ ID NO: 10090 - DNA, 19 bp, Artificial Sequence
  Target B2M Sequence complement
gaagttgacttactgaaga

SEQ ID NO: 10091 - DNA, 19 bp, Artificial Sequence
  Target B2M Sequence complement
aagttgacttactgaagaa

SEQ ID NO: 10092 - DNA, 19 bp, Artificial Sequence
  Target B2M Sequence complement
agttgacttactgaagaat

SEQ ID NO: 10093 - DNA, 19 bp, Artificial Sequence
  Target B2M Sequence complement
gttgacttactgaagaatg

SEQ ID NO: 10094 - DNA, 19 bp, Artificial Sequence
  Target B2M Sequence complement
ttgacttactgaagaatgg

SEQ ID NO: 10095 - DNA, 19 bp, Artificial Sequence
  Target B2M Sequence complement
tgacttactgaagaatgga

SEQ ID NO: 10096 - DNA, 19 bp, Artificial Sequence
  Target B2M Sequence complement
gacttactgaagaatggag

SEQ ID NO: 10097 - DNA, 19 bp, Artificial Sequence
  Target B2M Sequence complement
acttactgaagaatggaga

SEQ ID NO: 10098 - DNA, 19 bp, Artificial Sequence
  Target B2M Sequence complement
cttactgaagaatggagag

SEQ ID NO: 10099 - DNA, 19 bp, Artificial Sequence
  Target B2M Sequence complement
ttactgaagaatggagaga

SEQ ID NO: 10100 - DNA, 19 bp, Artificial Sequence
  Target B2M Sequence complement
tactgaagaatggagagag

SEQ ID NO: 10101 - DNA, 19 bp, Artificial Sequence
  Target B2M Sequence complement
actgaagaatggagagaga

SEQ ID NO: 10102 - DNA, 19 bp, Artificial Sequence
  Target B2M Sequence complement
ctgaagaatggagagagaa

SEQ ID NO: 10103 - DNA, 19 bp, Artificial Sequence
  Target B2M Sequence complement
tgaagaatggagagagaat

SEQ ID NO: 10104 - DNA, 19 bp, Artificial Sequence
  Target B2M Sequence complement
gaagaatggagagagaatt

SEQ ID NO: 10105 - DNA, 19 bp, Artificial Sequence
  Target B2M Sequence complement
aagaatggagagagaattg

SEQ ID NO: 10106 - DNA, 19 bp, Artificial Sequence
  Target B2M Sequence complement
agaatggagagagaattga

SEQ ID NO: 10107 - DNA, 19 bp, Artificial Sequence
  Target B2M Sequence complement
gaatggagagagaattgaa

SEQ ID NO: 10108 - DNA, 19 bp, Artificial Sequence
  Target B2M Sequence complement
aatggagagagaattgaaa

SEQ ID NO: 10109 - DNA, 19 bp, Artificial Sequence
  Target B2M Sequence complement
aaagtggagcattcagact

SEQ ID NO: 10110 - DNA, 19 bp, Artificial Sequence
  Target B2M Sequence complement
aagtggagcattcagactt

SEQ ID NO: 10111 - DNA, 19 bp, Artificial Sequence
  Target B2M Sequence complement
agtggagcattcagacttg

SEQ ID NO: 10112 - DNA, 19 bp, Artificial Sequence
  Target B2M Sequence complement
gtggagcattcagacttgt

SEQ ID NO: 10113 - DNA, 19 bp, Artificial Sequence
  Target B2M Sequence complement
tggagcattcagacttgtc

SEQ ID NO: 10114 - DNA, 19 bp, Artificial Sequence
  Target B2M Sequence complement
ggagcattcagacttgtct

SEQ ID NO: 10115 - DNA, 19 bp, Artificial Sequence
  Target B2M Sequence complement
gagcattcagacttgtctt

SEQ ID NO: 10116 - DNA, 19 bp, Artificial Sequence
  Target B2M Sequence complement
agcattcagacttgtcttt

SEQ ID NO: 10117 - DNA, 19 bp, Artificial Sequence
  Target B2M Sequence complement
gcattcagacttgtctttc

SEQ ID NO: 10118 - DNA, 19 bp, Artificial Sequence
  Target B2M Sequence complement
cattcagacttgtctttca

SEQ ID NO: 10119 - DNA, 19 bp, Artificial Sequence
  Target B2M Sequence complement
attcagacttgtctttcag

SEQ ID NO: 10120 - DNA, 19 bp, Artificial Sequence
  Target B2M Sequence complement
ttcagacttgtctttcagc

SEQ ID NO: 10121 - DNA, 19 bp, Artificial Sequence
  Target B2M Sequence complement
tcagacttgtctttcagca

SEQ ID NO: 10122 - DNA, 19 bp, Artificial Sequence
  Target B2M Sequence complement
cagacttgtctttcagcaa

SEQ ID NO: 10123 - DNA, 19 bp, Artificial Sequence
  Target B2M Sequence complement
agacttgtctttcagcaag

SEQ ID NO: 10124 - DNA, 19 bp, Artificial Sequence
  Target B2M Sequence complement
gacttgtctttcagcaagg

SEQ ID NO: 10125 - DNA, 19 bp, Artificial Sequence
  Target B2M Sequence complement
acttgtctttcagcaagga

SEQ ID NO: 10126 - DNA, 19 bp, Artificial Sequence
  Target B2M Sequence complement
cttgtctttcagcaaggac

SEQ ID NO: 10127 - DNA, 19 bp, Artificial Sequence
  Target B2M Sequence complement
ttgtctttcagcaaggact

SEQ ID NO: 10128 - DNA, 19 bp, Artificial Sequence
  Target B2M Sequence complement
tgtctttcagcaaggactg

SEQ ID NO: 10129 - DNA, 19 bp, Artificial Sequence
  Target B2M Sequence complement
gtctttcagcaaggactgg

SEQ ID NO: 10130 - DNA, 19 bp, Artificial Sequence
  Target B2M Sequence complement
tctttcagcaaggactggt

SEQ ID NO: 10131 - DNA, 19 bp, Artificial Sequence
  Target B2M Sequence complement
ctttcagcaaggactggtc

SEQ ID NO: 10132 - DNA, 19 bp, Artificial Sequence
  Target B2M Sequence complement
tttcagcaaggactggtct

SEQ ID NO: 10133 - DNA, 19 bp, Artificial Sequence
  Target B2M Sequence complement
ttcagcaaggactggtctt

SEQ ID NO: 10134 - DNA, 19 bp, Artificial Sequence
  Target B2M Sequence complement
tcagcaaggactggtcttt

SEQ ID NO: 10135 - DNA, 19 bp, Artificial Sequence
  Target B2M Sequence complement
cagcaaggactggtctttc

SEQ ID NO: 10136 - DNA, 19 bp, Artificial Sequence
  Target B2M Sequence complement
agcaaggactggtctttct

SEQ ID NO: 10137 - DNA, 19 bp, Artificial Sequence
  Target B2M Sequence complement
gcaaggactggtctttcta

SEQ ID NO: 10138 - DNA, 19 bp, Artificial Sequence
  Target B2M Sequence complement
caaggactggtctttctat

SEQ ID NO: 10139 - DNA, 19 bp, Artificial Sequence
  Target B2M Sequence complement
aaggactggtctttctatc

SEQ ID NO: 10140 - DNA, 19 bp, Artificial Sequence
  Target B2M Sequence complement
aggactggtctttctatct

SEQ ID NO: 10141 - DNA, 19 bp, Artificial Sequence
  Target B2M Sequence complement
ggactggtctttctatctc

SEQ ID NO: 10142 - DNA, 19 bp, Artificial Sequence
  Target B2M Sequence complement
gactggtctttctatctct

SEQ ID NO: 10143 - DNA, 19 bp, Artificial Sequence
  Target B2M Sequence complement
actggtctttctatctctt

SEQ ID NO: 10144 - DNA, 19 bp, Artificial Sequence
  Target B2M Sequence complement
ctggtctttctatctcttg

SEQ ID NO: 10145 - DNA, 19 bp, Artificial Sequence
  Target B2M Sequence complement
tggtctttctatctcttgt

SEQ ID NO: 10146 - DNA, 19 bp, Artificial Sequence
  Target B2M Sequence complement
ggtctttctatctcttgta

SEQ ID NO: 10147 - DNA, 19 bp, Artificial Sequence
  Target B2M Sequence complement
gtctttctatctcttgtac

SEQ ID NO: 10148 - DNA, 19 bp, Artificial Sequence
  Target B2M Sequence complement
tctttctatctcttgtact

SEQ ID NO: 10149 - DNA, 19 bp, Artificial Sequence
  Target B2M Sequence complement
ctttctatctcttgtacta

SEQ ID NO: 10150 - DNA, 19 bp, Artificial Sequence
  Target B2M Sequence complement
tttctatctcttgtactac

SEQ ID NO: 10151 - DNA, 19 bp, Artificial Sequence
  Target B2M Sequence complement
ttctatctcttgtactaca

SEQ ID NO: 10152 - DNA, 19 bp, Artificial Sequence
  Target B2M Sequence complement
tctatctcttgtactacac

SEQ ID NO: 10153 - DNA, 19 bp, Artificial Sequence
  Target B2M Sequence complement
ctatctcttgtactacact

SEQ ID NO: 10154 - DNA, 19 bp, Artificial Sequence
  Target B2M Sequence complement
tatctcttgtactacactg

SEQ ID NO: 10155 - DNA, 19 bp, Artificial Sequence
  Target B2M Sequence complement
atctcttgtactacactga

SEQ ID NO: 10156 - DNA, 19 bp, Artificial Sequence
  Target B2M Sequence complement
tctcttgtactacactgaa

SEQ ID NO: 10157 - DNA, 19 bp, Artificial Sequence
  Target B2M Sequence complement
ctcttgtactacactgaat

SEQ ID NO: 10158 - DNA, 19 bp, Artificial Sequence
  Target B2M Sequence complement
tcttgtactacactgaatt

SEQ ID NO: 10159 - DNA, 19 bp, Artificial Sequence
  Target B2M Sequence complement
cttgtactacactgaattc

SEQ ID NO: 10160 - DNA, 19 bp, Artificial Sequence
  Target B2M Sequence complement
ttgtactacactgaattca

SEQ ID NO: 10161 - DNA, 19 bp, Artificial Sequence
  Target B2M Sequence complement
tgtactacactgaattcac

SEQ ID NO: 10162 - DNA, 19 bp, Artificial Sequence
  Target B2M Sequence complement
gtactacactgaattcacc

SEQ ID NO: 10163 - DNA, 19 bp, Artificial Sequence
  Target B2M Sequence complement
tactacactgaattcaccc

SEQ ID NO: 10164 - DNA, 19 bp, Artificial Sequence
  Target B2M Sequence complement
aaagatgagtatgcctgcc

SEQ ID NO: 10165 - DNA, 19 bp, Artificial Sequence
  Target B2M Sequence complement
aagatgagtatgcctgccg

SEQ ID NO: 10166 - DNA, 19 bp, Artificial Sequence
  Target B2M Sequence complement
agatgagtatgcctgccgt

SEQ ID NO: 10167 - DNA, 19 bp, Artificial Sequence
  Target B2M Sequence complement
gatgagtatgcctgccgtg

SEQ ID NO: 10168 - DNA, 19 bp, Artificial Sequence
  Target B2M Sequence complement
atgagtatgcctgccgtgt

SEQ ID NO: 10169 - DNA, 19 bp, Artificial Sequence
  Target B2M Sequence complement
tgagtatgcctgccgtgtg

SEQ ID NO: 10170 - DNA, 19 bp, Artificial Sequence
  Target B2M Sequence complement
gagtatgcctgccgtgtga

SEQ ID NO: 10171 - DNA, 19 bp, Artificial Sequence
  Target B2M Sequence complement
agtatgcctgccgtgtgaa

SEQ ID NO: 10172 - DNA, 19 bp, Artificial Sequence
  Target B2M Sequence complement
gtatgcctgccgtgtgaac

SEQ ID NO: 10173 - DNA, 19 bp, Artificial Sequence
  Target B2M Sequence complement
tatgcctgccgtgtgaacc

SEQ ID NO: 10174 - DNA, 19 bp, Artificial Sequence
  Target B2M Sequence complement
atgcctgccgtgtgaacca

SEQ ID NO: 10175 - DNA, 19 bp, Artificial Sequence
  Target B2M Sequence complement
tgcctgccgtgtgaaccat

SEQ ID NO: 10176 - DNA, 19 bp, Artificial Sequence
  Target B2M Sequence complement
cctgccgtgtgaaccatgt

SEQ ID NO: 10177 - DNA, 19 bp, Artificial Sequence
  Target B2M Sequence complement
ctgccgtgtgaaccatgtg

SEQ ID NO: 10178 - DNA, 19 bp, Artificial Sequence
  Target B2M Sequence complement
tgccgtgtgaaccatgtga

SEQ ID NO: 10179 - DNA, 19 bp, Artificial Sequence
  Target B2M Sequence complement
gccgtgtgaaccatgtgac

SEQ ID NO: 10180 - DNA, 19 bp, Artificial Sequence
  Target B2M Sequence complement
ccgtgtgaaccatgtgact

SEQ ID NO: 10181 - DNA, 19 bp, Artificial Sequence
  Target B2M Sequence complement
cgtgtgaaccatgtgactt

SEQ ID NO: 10182 - DNA, 19 bp, Artificial Sequence
  Target B2M Sequence complement
gtgtgaaccatgtgacttt

SEQ ID NO: 10183 - DNA, 19 bp, Artificial Sequence
  Target B2M Sequence complement
tgtgaaccatgtgactttg

SEQ ID NO: 10184 - DNA, 19 bp, Artificial Sequence
  Target B2M Sequence complement
gtgaaccatgtgactttgt

SEQ ID NO: 10185 - DNA, 19 bp, Artificial Sequence
  Target B2M Sequence complement
tgaaccatgtgactttgtc

SEQ ID NO: 10186 - DNA, 19 bp, Artificial Sequence
  Target B2M Sequence complement
gaaccatgtgactttgtca

SEQ ID NO: 10187 - DNA, 19 bp, Artificial Sequence
  Target B2M Sequence complement
aaccatgtgactttgtcac

SEQ ID NO: 10188 - DNA, 19 bp, Artificial Sequence
  Target B2M Sequence complement
accatgtgactttgtcaca

SEQ ID NO: 10189 - DNA, 19 bp, Artificial Sequence
  Target B2M Sequence complement
ccatgtgactttgtcacag

SEQ ID NO: 10190 - DNA, 19 bp, Artificial Sequence
  Target B2M Sequence complement
catgtgactttgtcacagc

SEQ ID NO: 10191 - DNA, 19 bp, Artificial Sequence
  Target B2M Sequence complement
atgtgactttgtcacagcc

SEQ ID NO: 10192 - DNA, 19 bp, Artificial Sequence
  Target B2M Sequence complement
tgtgactttgtcacagccc

SEQ ID NO: 10193 - DNA, 19 bp, Artificial Sequence
  Target B2M Sequence complement
gtgactttgtcacagccca

SEQ ID NO: 10194 - DNA, 19 bp, Artificial Sequence
  Target B2M Sequence complement
tgactttgtcacagcccaa

SEQ ID NO: 10195 - DNA, 19 bp, Artificial Sequence
  Target B2M Sequence complement
gactttgtcacagcccaag

SEQ ID NO: 10196 - DNA, 19 bp, Artificial Sequence
  Target B2M Sequence complement
actttgtcacagcccaaga

SEQ ID NO: 10197 - DNA, 19 bp, Artificial Sequence
  Target B2M Sequence complement
ctttgtcacagcccaagat

SEQ ID NO: 10198 - DNA, 19 bp, Artificial Sequence
  Target B2M Sequence complement
tttgtcacagcccaagata

SEQ ID NO: 10199 - DNA, 19 bp, Artificial Sequence
  Target B2M Sequence complement
ttgtcacagcccaagatag

SEQ ID NO: 10200 - DNA, 19 bp, Artificial Sequence
  Target B2M Sequence complement
tgtcacagcccaagatagt

SEQ ID NO: 10201 - DNA, 19 bp, Artificial Sequence
  Target B2M Sequence complement
gtcacagcccaagatagtt

SEQ ID NO: 10202 - DNA, 19 bp, Artificial Sequence
  Target B2M Sequence complement
tcacagcccaagatagtta

SEQ ID NO: 10203 - DNA, 19 bp, Artificial Sequence
  Target B2M Sequence complement
cacagcccaagatagttaa

SEQ ID NO: 10204 - DNA, 19 bp, Artificial Sequence
  Target B2M Sequence complement
acagcccaagatagttaag

SEQ ID NO: 10205 - DNA, 19 bp, Artificial Sequence
  Target B2M Sequence complement
cagcccaagatagttaagt

SEQ ID NO: 10206 - DNA, 19 bp, Artificial Sequence
  Target B2M Sequence complement
agcccaagatagttaagtg

SEQ ID NO: 10207 - DNA, 19 bp, Artificial Sequence
  Target B2M Sequence complement
gcccaagatagttaagtgg

SEQ ID NO: 10208 - DNA, 19 bp, Artificial Sequence
  Target B2M Sequence complement
cccaagatagttaagtggg

SEQ ID NO: 10209 - DNA, 19 bp, Artificial Sequence
  Target B2M Sequence complement
ccaagatagttaagtggga

SEQ ID NO: 10210 - DNA, 19 bp, Artificial Sequence
  Target B2M Sequence complement
caagatagttaagtgggat

SEQ ID NO: 10211 - DNA, 19 bp, Artificial Sequence
  Target B2M Sequence complement
aagatagttaagtgggatc

SEQ ID NO: 10212 - DNA, 19 bp, Artificial Sequence
  Target B2M Sequence complement
agatagttaagtgggatcg

SEQ ID NO: 10213 - DNA, 19 bp, Artificial Sequence
  Target B2M Sequence complement
gatagttaagtgggatcga

SEQ ID NO: 10214 - DNA, 19 bp, Artificial Sequence
  Target B2M Sequence complement
atagttaagtgggatcgag

SEQ ID NO: 10215 - DNA, 19 bp, Artificial Sequence
  Target B2M Sequence complement
tagttaagtgggatcgaga

SEQ ID NO: 10216 - DNA, 19 bp, Artificial Sequence
  Target B2M Sequence complement
agttaagtgggatcgagac

SEQ ID NO: 10217 - DNA, 19 bp, Artificial Sequence
  Target B2M Sequence complement
gttaagtgggatcgagaca

SEQ ID NO: 10218 - DNA, 19 bp, Artificial Sequence
  Target B2M Sequence complement
ttaagtgggatcgagacat

SEQ ID NO: 10219 - DNA, 19 bp, Artificial Sequence
  Target B2M Sequence complement
taagtgggatcgagacatg

SEQ ID NO: 10220 - DNA, 19 bp, Artificial Sequence
  Target B2M Sequence complement
aagtgggatcgagacatgt

SEQ ID NO: 10221 - DNA, 19 bp, Artificial Sequence
  Target B2M Sequence complement
agtgggatcgagacatgta

SEQ ID NO: 10222 - DNA, 19 bp, Artificial Sequence
  Target B2M Sequence complement
gtgggatcgagacatgtaa

SEQ ID NO: 10223 - DNA, 19 bp, Artificial Sequence
  Target B2M Sequence complement
tgggatcgagacatgtaag

SEQ ID NO: 10224 - DNA, 19 bp, Artificial Sequence
  Target B2M Sequence complement
gggatcgagacatgtaagc

SEQ ID NO: 10225 - DNA, 19 bp, Artificial Sequence
  Target B2M Sequence complement
ggatcgagacatgtaagca

SEQ ID NO: 10226 - DNA, 19 bp, Artificial Sequence
  Target B2M Sequence complement
gatcgagacatgtaagcag

SEQ ID NO: 10227 - DNA, 19 bp, Artificial Sequence
  Target B2M Sequence complement
atcgagacatgtaagcagc

SEQ ID NO: 10228 - DNA, 19 bp, Artificial Sequence
  Target B2M Sequence complement
tcgagacatgtaagcagca

SEQ ID NO: 10229 - DNA, 19 bp, Artificial Sequence
  Target B2M Sequence complement
cgagacatgtaagcagcat

SEQ ID NO: 10230 - DNA, 19 bp, Artificial Sequence
  Target B2M Sequence complement
gagacatgtaagcagcatc

SEQ ID NO: 10231 - DNA, 19 bp, Artificial Sequence
  Target B2M Sequence complement
agacatgtaagcagcatca

SEQ ID NO: 10232 - DNA, 19 bp, Artificial Sequence
  Target B2M Sequence complement
gacatgtaagcagcatcat

SEQ ID NO: 10233 - DNA, 19 bp, Artificial Sequence
  Target B2M Sequence complement
acatgtaagcagcatcatg

SEQ ID NO: 10234 - DNA, 19 bp, Artificial Sequence
  Target B2M Sequence complement
catgtaagcagcatcatgg

SEQ ID NO: 10235 - DNA, 19 bp, Artificial Sequence
  Target B2M Sequence complement
atgtaagcagcatcatgga

SEQ ID NO: 10236 - DNA, 19 bp, Artificial Sequence
  Target B2M Sequence complement
tgtaagcagcatcatggag

SEQ ID NO: 10237 - DNA, 19 bp, Artificial Sequence
  Target B2M Sequence complement
gtaagcagcatcatggagg

SEQ ID NO: 10238 - DNA, 19 bp, Artificial Sequence
  Target B2M Sequence complement
taagcagcatcatggaggt

SEQ ID NO: 10239 - DNA, 19 bp, Artificial Sequence
  Target B2M Sequence complement
aagcagcatcatggaggtt

SEQ ID NO: 10240 - DNA, 19 bp, Artificial Sequence
  Target B2M Sequence complement
agcagcatcatggaggttt

SEQ ID NO: 10241 - DNA, 19 bp, Artificial Sequence
  Target B2M Sequence complement
gcagcatcatggaggtttg

SEQ ID NO: 10242 - DNA, 19 bp, Artificial Sequence
  Target B2M Sequence complement
cagcatcatggaggtttga

SEQ ID NO: 10243 - DNA, 19 bp, Artificial Sequence
  Target B2M Sequence complement
agcatcatggaggtttgaa

SEQ ID NO: 10244 - DNA, 19 bp, Artificial Sequence
  Target B2M Sequence complement
gcatcatggaggtttgaag

SEQ ID NO: 10245 - DNA, 19 bp, Artificial Sequence
  Target B2M Sequence complement
catcatggaggtttgaaga

SEQ ID NO: 10246 - DNA, 19 bp, Artificial Sequence
  Target B2M Sequence complement
atcatggaggtttgaagat

SEQ ID NO: 10247 - DNA, 19 bp, Artificial Sequence
  Target B2M Sequence complement
tcatggaggtttgaagatg

SEQ ID NO: 10248 - DNA, 19 bp, Artificial Sequence
  Target B2M Sequence complement
catggaggtttgaagatgc

SEQ ID NO: 10249 - DNA, 19 bp, Artificial Sequence
  Target B2M Sequence complement
atggaggtttgaagatgcc

SEQ ID NO: 10250 - DNA, 19 bp, Artificial Sequence
  Target B2M Sequence complement
tggaggtttgaagatgccg

SEQ ID NO: 10251 - DNA, 19 bp, Artificial Sequence
  Target B2M Sequence complement
ggaggtttgaagatgccgc

SEQ ID NO: 10252 - DNA, 19 bp, Artificial Sequence
  Target B2M Sequence complement
gaggtttgaagatgccgca

SEQ ID NO: 10253 - DNA, 19 bp, Artificial Sequence
  Target B2M Sequence complement
aggtttgaagatgccgcat

SEQ ID NO: 10254 - DNA, 19 bp, Artificial Sequence
  Target B2M Sequence complement
ggtttgaagatgccgcatt

SEQ ID NO: 10255 - DNA, 19 bp, Artificial Sequence
  Target B2M Sequence complement
gtttgaagatgccgcattt

SEQ ID NO: 10256 - DNA, 19 bp, Artificial Sequence
  Target B2M Sequence complement
tttgaagatgccgcatttg

SEQ ID NO: 10257 - DNA, 19 bp, Artificial Sequence
  Target B2M Sequence complement
ttgaagatgccgcatttgg

SEQ ID NO: 10258 - DNA, 19 bp, Artificial Sequence
  Target B2M Sequence complement
tgaagatgccgcatttgga

SEQ ID NO: 10259 - DNA, 19 bp, Artificial Sequence
  Target B2M Sequence complement
gaagatgccgcatttggat

SEQ ID NO: 10260 - DNA, 19 bp, Artificial Sequence
  Target B2M Sequence complement
aagatgccgcatttggatt

SEQ ID NO: 10261 - DNA, 19 bp, Artificial Sequence
  Target B2M Sequence complement
agatgccgcatttggattg

SEQ ID NO: 10262 - DNA, 19 bp, Artificial Sequence
  Target B2M Sequence complement
gatgccgcatttggattgg

SEQ ID NO: 10263 - DNA, 19 bp, Artificial Sequence
  Target B2M Sequence complement
atgccgcatttggattgga

SEQ ID NO: 10264 - DNA, 19 bp, Artificial Sequence
  Target B2M Sequence complement
tgccgcatttggattggat

SEQ ID NO: 10265 - DNA, 19 bp, Artificial Sequence
  Target B2M Sequence complement
gccgcatttggattggatg

SEQ ID NO: 10266 - DNA, 19 bp, Artificial Sequence
  Target B2M Sequence complement
ccgcatttggattggatga

SEQ ID NO: 10267 - DNA, 19 bp, Artificial Sequence
  Target B2M Sequence complement
cgcatttggattggatgaa

SEQ ID NO: 10268 - DNA, 19 bp, Artificial Sequence
  Target B2M Sequence complement
gcatttggattggatgaat

SEQ ID NO: 10269 - DNA, 19 bp, Artificial Sequence
  Target B2M Sequence complement
catttggattggatgaatt

SEQ ID NO: 10270 - DNA, 19 bp, Artificial Sequence
  Target B2M Sequence complement
atttggattggatgaattc

SEQ ID NO: 10271 - DNA, 19 bp, Artificial Sequence
  Target B2M Sequence complement
tttggattggatgaattcc

SEQ ID NO: 10272 - DNA, 19 bp, Artificial Sequence
  Target B2M Sequence complement
ttggattggatgaattcca

SEQ ID NO: 10273 - DNA, 19 bp, Artificial Sequence
  Target B2M Sequence complement
tggattggatgaattccaa

SEQ ID NO: 10274 - DNA, 19 bp, Artificial Sequence
  Target B2M Sequence complement
ggattggatgaattccaaa

SEQ ID NO: 10275 - DNA, 19 bp, Artificial Sequence
  Target B2M Sequence complement
gattggatgaattccaaat

SEQ ID NO: 10276 - DNA, 19 bp, Artificial Sequence
  Target B2M Sequence complement
attggatgaattccaaatt

SEQ ID NO: 10277 - DNA, 19 bp, Artificial Sequence
  Target B2M Sequence complement
ttggatgaattccaaattc

SEQ ID NO: 10278 - DNA, 19 bp, Artificial Sequence
  Target B2M Sequence complement
tggatgaattccaaattct

SEQ ID NO: 10279 - DNA, 19 bp, Artificial Sequence
  Target B2M Sequence complement
ggatgaattccaaattctg

SEQ ID NO: 10280 - DNA, 19 bp, Artificial Sequence
  Target B2M Sequence complement
gatgaattccaaattctgc

SEQ ID NO: 10281 - DNA, 19 bp, Artificial Sequence
  Target B2M Sequence complement
atgaattccaaattctgct

SEQ ID NO: 10282 - DNA, 19 bp, Artificial Sequence
  Target B2M Sequence complement
tgaattccaaattctgctt

SEQ ID NO: 10283 - DNA, 19 bp, Artificial Sequence
  Target B2M Sequence complement
gaattccaaattctgcttg

SEQ ID NO: 10284 - DNA, 19 bp, Artificial Sequence
  Target B2M Sequence complement
aattccaaattctgcttgc

SEQ ID NO: 10285 - DNA, 19 bp, Artificial Sequence
  Target B2M Sequence complement
attccaaattctgcttgct

SEQ ID NO: 10286 - DNA, 19 bp, Artificial Sequence
  Target B2M Sequence complement
ttccaaattctgcttgctt

SEQ ID NO: 10287 - DNA, 19 bp, Artificial Sequence
  Target B2M Sequence complement
tccaaattctgcttgcttg

SEQ ID NO: 10288 - DNA, 19 bp, Artificial Sequence
  Target B2M Sequence complement
ccaaattctgcttgcttgc

SEQ ID NO: 10289 - DNA, 19 bp, Artificial Sequence
  Target B2M Sequence complement
caaattctgcttgcttgct

SEQ ID NO: 10290 - DNA, 19 bp, Artificial Sequence
  Target B2M Sequence complement
aaattctgcttgcttgctt

SEQ ID NO: 10291 - DNA, 19 bp, Artificial Sequence
  Target B2M Sequence complement
aattctgcttgcttgcttt

SEQ ID NO: 10292 - DNA, 19 bp, Artificial Sequence
  Target B2M Sequence complement
tattgatatgcttatacac

SEQ ID NO: 10293 - DNA, 19 bp, Artificial Sequence
  Target B2M Sequence complement
attgatatgcttatacact

SEQ ID NO: 10294 - DNA, 19 bp, Artificial Sequence
  Target B2M Sequence complement
ttgatatgcttatacactt

SEQ ID NO: 10295 - DNA, 19 bp, Artificial Sequence
  Target B2M Sequence complement
tgatatgcttatacactta

SEQ ID NO: 10296 - DNA, 19 bp, Artificial Sequence
  Target B2M Sequence complement
gatatgcttatacacttac

SEQ ID NO: 10297 - DNA, 19 bp, Artificial Sequence
  Target B2M Sequence complement
atatgcttatacacttaca

SEQ ID NO: 10298 - DNA, 19 bp, Artificial Sequence
  Target B2M Sequence complement
tatgcttatacacttacac

SEQ ID NO: 10299 - DNA, 19 bp, Artificial Sequence
  Target B2M Sequence complement
atgcttatacacttacact

SEQ ID NO: 10300 - DNA, 19 bp, Artificial Sequence
  Target B2M Sequence complement
tgcttatacacttacactt

SEQ ID NO: 10301 - DNA, 19 bp, Artificial Sequence
  Target B2M Sequence complement
gcttatacacttacacttt

SEQ ID NO: 10302 - DNA, 19 bp, Artificial Sequence
  Target B2M Sequence complement
cttatacacttacacttta

SEQ ID NO: 10303 - DNA, 19 bp, Artificial Sequence
  Target B2M Sequence complement
tatacacttacactttatg

SEQ ID NO: 10304 - DNA, 19 bp, Artificial Sequence
  Target B2M Sequence complement
atacacttacactttatgc

SEQ ID NO: 10305 - DNA, 19 bp, Artificial Sequence
  Target B2M Sequence complement
tacacttacactttatgca

SEQ ID NO: 10306 - DNA, 19 bp, Artificial Sequence
  Target B2M Sequence complement
acacttacactttatgcac

SEQ ID NO: 10307 - DNA, 19 bp, Artificial Sequence
  Target B2M Sequence complement
cacttacactttatgcaca

SEQ ID NO: 10308 - DNA, 19 bp, Artificial Sequence
  Target B2M Sequence complement
acttacactttatgcacaa

SEQ ID NO: 10309 - DNA, 19 bp, Artificial Sequence
  Target B2M Sequence complement
cttacactttatgcacaaa

SEQ ID NO: 10310 - DNA, 19 bp, Artificial Sequence
  Target B2M Sequence complement
atgtagggttataataatg

SEQ ID NO: 10311 - DNA, 19 bp, Artificial Sequence
  Target B2M Sequence complement
tgtagggttataataatgt

SEQ ID NO: 10312 - DNA, 19 bp, Artificial Sequence
  Target B2M Sequence complement
gtagggttataataatgtt

SEQ ID NO: 10313 - DNA, 19 bp, Artificial Sequence
  Target B2M Sequence complement
gggttataataatgttaac

SEQ ID NO: 10314 - DNA, 19 bp, Artificial Sequence
  Target B2M Sequence complement
taataatgttaacatggac

SEQ ID NO: 10315 - DNA, 19 bp, Artificial Sequence
  Target B2M Sequence complement
aataatgttaacatggaca

SEQ ID NO: 10316 - DNA, 19 bp, Artificial Sequence
  Target B2M Sequence complement
ataatgttaacatggacat

SEQ ID NO: 10317 - DNA, 19 bp, Artificial Sequence
  Target B2M Sequence complement
taatgttaacatggacatg

SEQ ID NO: 10318 - DNA, 19 bp, Artificial Sequence
  Target B2M Sequence complement
aatgttaacatggacatga

SEQ ID NO: 10319 - DNA, 19 bp, Artificial Sequence
  Target B2M Sequence complement
atgttaacatggacatgat

SEQ ID NO: 10320 - DNA, 19 bp, Artificial Sequence
  Target B2M Sequence complement
tgttaacatggacatgatc

SEQ ID NO: 10321 - DNA, 19 bp, Artificial Sequence
  Target B2M Sequence complement
gttaacatggacatgatct

SEQ ID NO: 10322 - DNA, 19 bp, Artificial Sequence
  Target B2M Sequence complement
ttaacatggacatgatctt

SEQ ID NO: 10323 - DNA, 19 bp, Artificial Sequence
  Target B2M Sequence complement
taacatggacatgatcttc

SEQ ID NO: 10324 - DNA, 19 bp, Artificial Sequence
  Target B2M Sequence complement
aacatggacatgatcttct

SEQ ID NO: 10325 - DNA, 19 bp, Artificial Sequence
  Target B2M Sequence complement
acatggacatgatcttctt

SEQ ID NO: 10326 - DNA, 19 bp, Artificial Sequence
  Target B2M Sequence complement
catggacatgatcttcttt

SEQ ID NO: 10327 - DNA, 19 bp, Artificial Sequence
  Target B2M Sequence complement
atggacatgatcttcttta

SEQ ID NO: 10328 - DNA, 19 bp, Artificial Sequence
  Target B2M Sequence complement
tggacatgatcttctttat

SEQ ID NO: 10329 - DNA, 19 bp, Artificial Sequence
  Target B2M Sequence complement
ggacatgatcttctttata

SEQ ID NO: 10330 - DNA, 19 bp, Artificial Sequence
  Target B2M Sequence complement
gacatgatcttctttataa

SEQ ID NO: 10331 - DNA, 19 bp, Artificial Sequence
  Target B2M Sequence complement
tataattctactttgagtg

SEQ ID NO: 10332 - DNA, 19 bp, Artificial Sequence
  Target B2M Sequence complement
ataattctactttgagtgc

SEQ ID NO: 10333 - DNA, 19 bp, Artificial Sequence
  Target B2M Sequence complement
taattctactttgagtgct

SEQ ID NO: 10334 - DNA, 19 bp, Artificial Sequence
  Target B2M Sequence complement
aattctactttgagtgctg

SEQ ID NO: 10335 - DNA, 19 bp, Artificial Sequence
  Target B2M Sequence complement
attctactttgagtgctgt

SEQ ID NO: 10336 - DNA, 19 bp, Artificial Sequence
  Target B2M Sequence complement
ttctactttgagtgctgtc

SEQ ID NO: 10337 - DNA, 19 bp, Artificial Sequence
  Target B2M Sequence complement
tctactttgagtgctgtct

SEQ ID NO: 10338 - DNA, 19 bp, Artificial Sequence
  Target B2M Sequence complement
ctactttgagtgctgtctc

SEQ ID NO: 10339 - DNA, 19 bp, Artificial Sequence
  Target B2M Sequence complement
tactttgagtgctgtctcc

SEQ ID NO: 10340 - DNA, 19 bp, Artificial Sequence
  Target B2M Sequence complement
actttgagtgctgtctcca

SEQ ID NO: 10341 - DNA, 19 bp, Artificial Sequence
  Target B2M Sequence complement
ctttgagtgctgtctccat

SEQ ID NO: 10342 - DNA, 19 bp, Artificial Sequence
  Target B2M Sequence complement
tttgagtgctgtctccatg

SEQ ID NO: 10343 - DNA, 19 bp, Artificial Sequence
  Target B2M Sequence complement
ttgagtgctgtctccatgt

SEQ ID NO: 10344 - DNA, 19 bp, Artificial Sequence
  Target B2M Sequence complement
tgagtgctgtctccatgtt

SEQ ID NO: 10345 - DNA, 19 bp, Artificial Sequence
  Target B2M Sequence complement
gagtgctgtctccatgttt

SEQ ID NO: 10346 - DNA, 19 bp, Artificial Sequence
  Target B2M Sequence complement
agtgctgtctccatgtttg

SEQ ID NO: 10347 - DNA, 19 bp, Artificial Sequence
  Target B2M Sequence complement
gtgctgtctccatgtttga

SEQ ID NO: 10348 - DNA, 19 bp, Artificial Sequence
  Target B2M Sequence complement
tgctgtctccatgtttgat

SEQ ID NO: 10349 - DNA, 19 bp, Artificial Sequence
  Target B2M Sequence complement
gctgtctccatgtttgatg

SEQ ID NO: 10350 - DNA, 19 bp, Artificial Sequence
  Target B2M Sequence complement
ctgtctccatgtttgatgt

SEQ ID NO: 10351 - DNA, 19 bp, Artificial Sequence
  Target B2M Sequence complement
tgtctccatgtttgatgta

SEQ ID NO: 10352 - DNA, 19 bp, Artificial Sequence
  Target B2M Sequence complement
gtctccatgtttgatgtat

SEQ ID NO: 10353 - DNA, 19 bp, Artificial Sequence
  Target B2M Sequence complement
tctccatgtttgatgtatc

SEQ ID NO: 10354 - DNA, 19 bp, Artificial Sequence
  Target B2M Sequence complement
ctccatgtttgatgtatct

SEQ ID NO: 10355 - DNA, 19 bp, Artificial Sequence
  Target B2M Sequence complement
tccatgtttgatgtatctg

SEQ ID NO: 10356 - DNA, 19 bp, Artificial Sequence
  Target B2M Sequence complement
ccatgtttgatgtatctga

SEQ ID NO: 10357 - DNA, 19 bp, Artificial Sequence
  Target B2M Sequence complement
catgtttgatgtatctgag

SEQ ID NO: 10358 - DNA, 19 bp, Artificial Sequence
  Target B2M Sequence complement
atgtttgatgtatctgagc

SEQ ID NO: 10359 - DNA, 19 bp, Artificial Sequence
  Target B2M Sequence complement
tgtttgatgtatctgagca

SEQ ID NO: 10360 - DNA, 19 bp, Artificial Sequence
  Target B2M Sequence complement
gtttgatgtatctgagcag

SEQ ID NO: 10361 - DNA, 19 bp, Artificial Sequence
  Target B2M Sequence complement
tttgatgtatctgagcagg

SEQ ID NO: 10362 - DNA, 19 bp, Artificial Sequence
  Target B2M Sequence complement
ttgatgtatctgagcaggt

SEQ ID NO: 10363 - DNA, 19 bp, Artificial Sequence
  Target B2M Sequence complement
tgatgtatctgagcaggtt

SEQ ID NO: 10364 - DNA, 19 bp, Artificial Sequence
  Target B2M Sequence complement
gatgtatctgagcaggttg

SEQ ID NO: 10365 - DNA, 19 bp, Artificial Sequence
  Target B2M Sequence complement
atgtatctgagcaggttgc

SEQ ID NO: 10366 - DNA, 19 bp, Artificial Sequence
  Target B2M Sequence complement
tgtatctgagcaggttgct

SEQ ID NO: 10367 - DNA, 19 bp, Artificial Sequence
  Target B2M Sequence complement
gtatctgagcaggttgctc

SEQ ID NO: 10368 - DNA, 19 bp, Artificial Sequence
  Target B2M Sequence complement
tatctgagcaggttgctcc

SEQ ID NO: 10369 - DNA, 19 bp, Artificial Sequence
  Target B2M Sequence complement
atctgagcaggttgctcca

SEQ ID NO: 10370 - DNA, 19 bp, Artificial Sequence
  Target B2M Sequence complement
tctgagcaggttgctccac

SEQ ID NO: 10371 - DNA, 19 bp, Artificial Sequence
  Target B2M Sequence complement
ctgagcaggttgctccaca

SEQ ID NO: 10372 - DNA, 19 bp, Artificial Sequence
  Target B2M Sequence complement
tgagcaggttgctccacag

SEQ ID NO: 10373 - DNA, 19 bp, Artificial Sequence
  Target B2M Sequence complement
agcaggttgctccacaggt

SEQ ID NO: 10374 - DNA, 19 bp, Artificial Sequence
  Target B2M Sequence complement
gcaggttgctccacaggta

SEQ ID NO: 10375 - DNA, 19 bp, Artificial Sequence
  Target B2M Sequence complement
caggttgctccacaggtag

SEQ ID NO: 10376 - DNA, 19 bp, Artificial Sequence
  Target B2M Sequence complement
aggttgctccacaggtagc

SEQ ID NO: 10377 - DNA, 19 bp, Artificial Sequence
  Target B2M Sequence complement
ggttgctccacaggtagct

SEQ ID NO: 10378 - DNA, 19 bp, Artificial Sequence
  Target B2M Sequence complement
gttgctccacaggtagctc

SEQ ID NO: 10379 - DNA, 19 bp, Artificial Sequence
  Target B2M Sequence complement
ttgctccacaggtagctct

SEQ ID NO: 10380 - DNA, 19 bp, Artificial Sequence
  Target B2M Sequence complement
tgctccacaggtagctcta

SEQ ID NO: 10381 - DNA, 19 bp, Artificial Sequence
  Target B2M Sequence complement
gctccacaggtagctctag

SEQ ID NO: 10382 - DNA, 19 bp, Artificial Sequence
  Target B2M Sequence complement
ctccacaggtagctctagg

SEQ ID NO: 10383 - DNA, 19 bp, Artificial Sequence
  Target B2M Sequence complement
tccacaggtagctctagga

SEQ ID NO: 10384 - DNA, 19 bp, Artificial Sequence
  Target B2M Sequence complement
ccacaggtagctctaggag

SEQ ID NO: 10385 - DNA, 19 bp, Artificial Sequence
  Target B2M Sequence complement
cacaggtagctctaggagg

SEQ ID NO: 10386 - DNA, 19 bp, Artificial Sequence
  Target B2M Sequence complement
acaggtagctctaggaggg

SEQ ID NO: 10387 - DNA, 19 bp, Artificial Sequence
  Target B2M Sequence complement
aggtagctctaggagggct

SEQ ID NO: 10388 - DNA, 19 bp, Artificial Sequence
  Target B2M Sequence complement
tctaggagggctggcaact

SEQ ID NO: 10389 - DNA, 19 bp, Artificial Sequence
  Target B2M Sequence complement
ctaggagggctggcaactt

SEQ ID NO: 10390 - DNA, 19 bp, Artificial Sequence
  Target B2M Sequence complement
taggagggctggcaactta

SEQ ID NO: 10391 - DNA, 19 bp, Artificial Sequence
  Target B2M Sequence complement
aggagggctggcaacttag

SEQ ID NO: 10392 - DNA, 19 bp, Artificial Sequence
  Target B2M Sequence complement
ggagggctggcaacttaga

SEQ ID NO: 10393 - DNA, 19 bp, Artificial Sequence
  Target B2M Sequence complement
gagggctggcaacttagag

SEQ ID NO: 10394 - DNA, 19 bp, Artificial Sequence
  Target B2M Sequence complement
agggctggcaacttagagg

SEQ ID NO: 10395 - DNA, 19 bp, Artificial Sequence
  Target B2M Sequence complement
gggctggcaacttagaggt

SEQ ID NO: 10396 - DNA, 19 bp, Artificial Sequence
  Target B2M Sequence complement
ggctggcaacttagaggtg

SEQ ID NO: 10397 - DNA, 19 bp, Artificial Sequence
  Target B2M Sequence complement
gctggcaacttagaggtgg

SEQ ID NO: 10398 - DNA, 19 bp, Artificial Sequence
  Target B2M Sequence complement
ctggcaacttagaggtggg

SEQ ID NO: 10399 - DNA, 19 bp, Artificial Sequence
  Target B2M Sequence complement
gggagcagagaattctctt

SEQ ID NO: 10400 - DNA, 19 bp, Artificial Sequence
  Target B2M Sequence complement
ggagcagagaattctctta

SEQ ID NO: 10401 - DNA, 19 bp, Artificial Sequence
  Target B2M Sequence complement
gagcagagaattctcttat

SEQ ID NO: 10402 - DNA, 19 bp, Artificial Sequence
  Target B2M Sequence complement
agcagagaattctcttatc

SEQ ID NO: 10403 - DNA, 19 bp, Artificial Sequence
  Target B2M Sequence complement
gcagagaattctcttatcc

SEQ ID NO: 10404 - DNA, 19 bp, Artificial Sequence
  Target B2M Sequence complement
cagagaattctcttatcca

SEQ ID NO: 10405 - DNA, 19 bp, Artificial Sequence
  Target B2M Sequence complement
agagaattctcttatccaa

SEQ ID NO: 10406 - DNA, 19 bp, Artificial Sequence
  Target B2M Sequence complement
gagaattctcttatccaac

SEQ ID NO: 10407 - DNA, 19 bp, Artificial Sequence
  Target B2M Sequence complement
agaattctcttatccaaca

SEQ ID NO: 10408 - DNA, 19 bp, Artificial Sequence
  Target B2M Sequence complement
gaattctcttatccaacat

SEQ ID NO: 10409 - DNA, 19 bp, Artificial Sequence
  Target B2M Sequence complement
aattctcttatccaacatc

SEQ ID NO: 10410 - DNA, 19 bp, Artificial Sequence
  Target B2M Sequence complement
attctcttatccaacatca

SEQ ID NO: 10411 - DNA, 19 bp, Artificial Sequence
  Target B2M Sequence complement
ttctcttatccaacatcaa

SEQ ID NO: 10412 - DNA, 19 bp, Artificial Sequence
  Target B2M Sequence complement
tctcttatccaacatcaac

SEQ ID NO: 10413 - DNA, 19 bp, Artificial Sequence
  Target B2M Sequence complement
ctcttatccaacatcaaca

SEQ ID NO: 10414 - DNA, 19 bp, Artificial Sequence
  Target B2M Sequence complement
tcttatccaacatcaacat

SEQ ID NO: 10415 - DNA, 19 bp, Artificial Sequence
  Target B2M Sequence complement
cttatccaacatcaacatc

SEQ ID NO: 10416 - DNA, 19 bp, Artificial Sequence
  Target B2M Sequence complement
ttatccaacatcaacatct

SEQ ID NO: 10417 - DNA, 19 bp, Artificial Sequence
  Target B2M Sequence complement
tatccaacatcaacatctt

SEQ ID NO: 10418 - DNA, 19 bp, Artificial Sequence
  Target B2M Sequence complement
atccaacatcaacatcttg

SEQ ID NO: 10419 - DNA, 19 bp, Artificial Sequence
  Target B2M Sequence complement
tccaacatcaacatcttgg

SEQ ID NO: 10420 - DNA, 19 bp, Artificial Sequence
  Target B2M Sequence complement
ccaacatcaacatcttggt

SEQ ID NO: 10421 - DNA, 19 bp, Artificial Sequence
  Target B2M Sequence complement
caacatcaacatcttggtc

SEQ ID NO: 10422 - DNA, 19 bp, Artificial Sequence
  Target B2M Sequence complement
aacatcaacatcttggtca

SEQ ID NO: 10423 - DNA, 19 bp, Artificial Sequence
  Target B2M Sequence complement
acatcaacatcttggtcag

SEQ ID NO: 10424 - DNA, 19 bp, Artificial Sequence
  Target B2M Sequence complement
catcaacatcttggtcaga

SEQ ID NO: 10425 - DNA, 19 bp, Artificial Sequence
  Target B2M Sequence complement
atcaacatcttggtcagat

SEQ ID NO: 10426 - DNA, 19 bp, Artificial Sequence
  Target B2M Sequence complement
tcaacatcttggtcagatt

SEQ ID NO: 10427 - DNA, 19 bp, Artificial Sequence
  Target B2M Sequence complement
caacatcttggtcagattt

SEQ ID NO: 10428 - DNA, 19 bp, Artificial Sequence
  Target B2M Sequence complement
aacatcttggtcagatttg

SEQ ID NO: 10429 - DNA, 19 bp, Artificial Sequence
  Target B2M Sequence complement
acatcttggtcagatttga

SEQ ID NO: 10430 - DNA, 19 bp, Artificial Sequence
  Target B2M Sequence complement
catcttggtcagatttgaa

SEQ ID NO: 10431 - DNA, 19 bp, Artificial Sequence
  Target B2M Sequence complement
atcttggtcagatttgaac

SEQ ID NO: 10432 - DNA, 19 bp, Artificial Sequence
  Target B2M Sequence complement
tcttggtcagatttgaact

SEQ ID NO: 10433 - DNA, 19 bp, Artificial Sequence
  Target B2M Sequence complement
cttggtcagatttgaactc

SEQ ID NO: 10434 - DNA, 19 bp, Artificial Sequence
  Target B2M Sequence complement
ttggtcagatttgaactct

SEQ ID NO: 10435 - DNA, 19 bp, Artificial Sequence
  Target B2M Sequence complement
tggtcagatttgaactctt

SEQ ID NO: 10436 - DNA, 19 bp, Artificial Sequence
  Target B2M Sequence complement
ggtcagatttgaactcttc

SEQ ID NO: 10437 - DNA, 19 bp, Artificial Sequence
  Target B2M Sequence complement
gtcagatttgaactcttca

SEQ ID NO: 10438 - DNA, 19 bp, Artificial Sequence
  Target B2M Sequence complement
tcagatttgaactcttcaa

SEQ ID NO: 10439 - DNA, 19 bp, Artificial Sequence
  Target B2M Sequence complement
cagatttgaactcttcaat

SEQ ID NO: 10440 - DNA, 19 bp, Artificial Sequence
  Target B2M Sequence complement
agatttgaactcttcaatc

SEQ ID NO: 10441 - DNA, 19 bp, Artificial Sequence
  Target B2M Sequence complement
gatttgaactcttcaatct

SEQ ID NO: 10442 - DNA, 19 bp, Artificial Sequence
  Target B2M Sequence complement
atttgaactcttcaatctc

SEQ ID NO: 10443 - DNA, 19 bp, Artificial Sequence
  Target B2M Sequence complement
tttgaactcttcaatctct

SEQ ID NO: 10444 - DNA, 19 bp, Artificial Sequence
  Target B2M Sequence complement
ttgaactcttcaatctctt

SEQ ID NO: 10445 - DNA, 19 bp, Artificial Sequence
  Target B2M Sequence complement
tgaactcttcaatctcttg

SEQ ID NO: 10446 - DNA, 19 bp, Artificial Sequence
  Target B2M Sequence complement
gaactcttcaatctcttgc

SEQ ID NO: 10447 - DNA, 19 bp, Artificial Sequence
  Target B2M Sequence complement
aactcttcaatctcttgca

SEQ ID NO: 10448 - DNA, 19 bp, Artificial Sequence
  Target B2M Sequence complement
actcttcaatctcttgcac

SEQ ID NO: 10449 - DNA, 19 bp, Artificial Sequence
  Target B2M Sequence complement
ctcttcaatctcttgcact

SEQ ID NO: 10450 - DNA, 19 bp, Artificial Sequence
  Target B2M Sequence complement
tcttcaatctcttgcactc

SEQ ID NO: 10451 - DNA, 19 bp, Artificial Sequence
  Target B2M Sequence complement
cttcaatctcttgcactca

SEQ ID NO: 10452 - DNA, 19 bp, Artificial Sequence
  Target B2M Sequence complement
ttcaatctcttgcactcaa

SEQ ID NO: 10453 - DNA, 19 bp, Artificial Sequence
  Target B2M Sequence complement
tcaatctcttgcactcaaa

SEQ ID NO: 10454 - DNA, 19 bp, Artificial Sequence
  Target B2M Sequence complement
caatctcttgcactcaaag

SEQ ID NO: 10455 - DNA, 19 bp, Artificial Sequence
  Target B2M Sequence complement
aatctcttgcactcaaagc

SEQ ID NO: 10456 - DNA, 19 bp, Artificial Sequence
  Target B2M Sequence complement
atctcttgcactcaaagct

SEQ ID NO: 10457 - DNA, 19 bp, Artificial Sequence
  Target B2M Sequence complement
tctcttgcactcaaagctt

SEQ ID NO: 10458 - DNA, 19 bp, Artificial Sequence
  Target B2M Sequence complement
ctcttgcactcaaagcttg

SEQ ID NO: 10459 - DNA, 19 bp, Artificial Sequence
  Target B2M Sequence complement
tcttgcactcaaagcttgt

SEQ ID NO: 10460 - DNA, 19 bp, Artificial Sequence
  Target B2M Sequence complement
cttgcactcaaagcttgtt

SEQ ID NO: 10461 - DNA, 19 bp, Artificial Sequence
  Target B2M Sequence complement
ttgcactcaaagcttgtta

SEQ ID NO: 10462 - DNA, 19 bp, Artificial Sequence
  Target B2M Sequence complement
tgcactcaaagcttgttaa

SEQ ID NO: 10463 - DNA, 19 bp, Artificial Sequence
  Target B2M Sequence complement
gcactcaaagcttgttaag

SEQ ID NO: 10464 - DNA, 19 bp, Artificial Sequence
  Target B2M Sequence complement
cactcaaagcttgttaaga

SEQ ID NO: 10465 - DNA, 19 bp, Artificial Sequence
  Target B2M Sequence complement
actcaaagcttgttaagat

SEQ ID NO: 10466 - DNA, 19 bp, Artificial Sequence
  Target B2M Sequence complement
ctcaaagcttgttaagata

SEQ ID NO: 10467 - DNA, 19 bp, Artificial Sequence
  Target B2M Sequence complement
tcaaagcttgttaagatag

SEQ ID NO: 10468 - DNA, 19 bp, Artificial Sequence
  Target B2M Sequence complement
caaagcttgttaagatagt

SEQ ID NO: 10469 - DNA, 19 bp, Artificial Sequence
  Target B2M Sequence complement
aaagcttgttaagatagtt

SEQ ID NO: 10470 - DNA, 19 bp, Artificial Sequence
  Target B2M Sequence complement
aagcttgttaagatagtta

SEQ ID NO: 10471 - DNA, 19 bp, Artificial Sequence
  Target B2M Sequence complement
agcttgttaagatagttaa

SEQ ID NO: 10472 - DNA, 19 bp, Artificial Sequence
  Target B2M Sequence complement
gcttgttaagatagttaag

SEQ ID NO: 10473 - DNA, 19 bp, Artificial Sequence
  Target B2M Sequence complement
cttgttaagatagttaagc

SEQ ID NO: 10474 - DNA, 19 bp, Artificial Sequence
  Target B2M Sequence complement
ttgttaagatagttaagcg

SEQ ID NO: 10475 - DNA, 19 bp, Artificial Sequence
  Target B2M Sequence complement
tgttaagatagttaagcgt

SEQ ID NO: 10476 - DNA, 19 bp, Artificial Sequence
  Target B2M Sequence complement
gttaagatagttaagcgtg

SEQ ID NO: 10477 - DNA, 19 bp, Artificial Sequence
  Target B2M Sequence complement
ttaagatagttaagcgtgc

SEQ ID NO: 10478 - DNA, 19 bp, Artificial Sequence
  Target B2M Sequence complement
taagatagttaagcgtgca

SEQ ID NO: 10479 - DNA, 19 bp, Artificial Sequence
  Target B2M Sequence complement
aagatagttaagcgtgcat

SEQ ID NO: 10480 - DNA, 19 bp, Artificial Sequence
  Target B2M Sequence complement
agatagttaagcgtgcata

SEQ ID NO: 10481 - DNA, 19 bp, Artificial Sequence
  Target B2M Sequence complement
gatagttaagcgtgcataa

SEQ ID NO: 10482 - DNA, 19 bp, Artificial Sequence
  Target B2M Sequence complement
atagttaagcgtgcataag

SEQ ID NO: 10483 - DNA, 19 bp, Artificial Sequence
  Target B2M Sequence complement
tagttaagcgtgcataagt

SEQ ID NO: 10484 - DNA, 19 bp, Artificial Sequence
  Target B2M Sequence complement
agttaagcgtgcataagtt

SEQ ID NO: 10485 - DNA, 19 bp, Artificial Sequence
  Target B2M Sequence complement
gttaagcgtgcataagtta

SEQ ID NO: 10486 - DNA, 19 bp, Artificial Sequence
  Target B2M Sequence complement
ttaagcgtgcataagttaa

SEQ ID NO: 10487 - DNA, 19 bp, Artificial Sequence
  Target B2M Sequence complement
taagcgtgcataagttaac

SEQ ID NO: 10488 - DNA, 19 bp, Artificial Sequence
  Target B2M Sequence complement
aagcgtgcataagttaact

SEQ ID NO: 10489 - DNA, 19 bp, Artificial Sequence
  Target B2M Sequence complement
agcgtgcataagttaactt

SEQ ID NO: 10490 - DNA, 19 bp, Artificial Sequence
  Target B2M Sequence complement
gcgtgcataagttaacttc

SEQ ID NO: 10491 - DNA, 19 bp, Artificial Sequence
  Target B2M Sequence complement
cgtgcataagttaacttcc

SEQ ID NO: 10492 - DNA, 19 bp, Artificial Sequence
  Target B2M Sequence complement
gtgcataagttaacttcca

SEQ ID NO: 10493 - DNA, 19 bp, Artificial Sequence
  Target B2M Sequence complement
tgcataagttaacttccaa

SEQ ID NO: 10494 - DNA, 19 bp, Artificial Sequence
  Target B2M Sequence complement
gcataagttaacttccaat

SEQ ID NO: 10495 - DNA, 19 bp, Artificial Sequence
  Target B2M Sequence complement
cataagttaacttccaatt

SEQ ID NO: 10496 - DNA, 19 bp, Artificial Sequence
  Target B2M Sequence complement
aagttaacttccaatttac

SEQ ID NO: 10497 - DNA, 19 bp, Artificial Sequence
  Target B2M Sequence complement
agttaacttccaatttaca

SEQ ID NO: 10498 - DNA, 19 bp, Artificial Sequence
  Target B2M Sequence complement
gttaacttccaatttacat

SEQ ID NO: 10499 - DNA, 19 bp, Artificial Sequence
  Target B2M Sequence complement
taacttccaatttacatac

SEQ ID NO: 10500 - DNA, 19 bp, Artificial Sequence
  Target B2M Sequence complement
aacttccaatttacatact

SEQ ID NO: 10501 - DNA, 19 bp, Artificial Sequence
  Target B2M Sequence complement
acttccaatttacatactc

SEQ ID NO: 10502 - DNA, 19 bp, Artificial Sequence
  Target B2M Sequence complement
cttccaatttacatactct

SEQ ID NO: 10503 - DNA, 19 bp, Artificial Sequence
  Target B2M Sequence complement
ttccaatttacatactctg

SEQ ID NO: 10504 - DNA, 19 bp, Artificial Sequence
  Target B2M Sequence complement
tccaatttacatactctgc

SEQ ID NO: 10505 - DNA, 19 bp, Artificial Sequence
  Target B2M Sequence complement
ccaatttacatactctgct

SEQ ID NO: 10506 - DNA, 19 bp, Artificial Sequence
  Target B2M Sequence complement
caatttacatactctgctt

SEQ ID NO: 10507 - DNA, 19 bp, Artificial Sequence
  Target B2M Sequence complement
aatttacatactctgctta

SEQ ID NO: 10508 - DNA, 19 bp, Artificial Sequence
  Target B2M Sequence complement
atttacatactctgcttag

SEQ ID NO: 10509 - DNA, 19 bp, Artificial Sequence
  Target B2M Sequence complement
tttacatactctgcttaga

SEQ ID NO: 10510 - DNA, 19 bp, Artificial Sequence
  Target B2M Sequence complement
ttacatactctgcttagaa

SEQ ID NO: 10511 - DNA, 19 bp, Artificial Sequence
  Target B2M Sequence complement
tacatactctgcttagaat

SEQ ID NO: 10512 - DNA, 19 bp, Artificial Sequence
  Target B2M Sequence complement
acatactctgcttagaatt

SEQ ID NO: 10513 - DNA, 19 bp, Artificial Sequence
  Target B2M Sequence complement
catactctgcttagaattt

SEQ ID NO: 10514 - DNA, 19 bp, Artificial Sequence
  Target B2M Sequence complement
atactctgcttagaatttg

SEQ ID NO: 10515 - DNA, 19 bp, Artificial Sequence
  Target B2M Sequence complement
tactctgcttagaatttgg

SEQ ID NO: 10516 - DNA, 19 bp, Artificial Sequence
  Target B2M Sequence complement
actctgcttagaatttggg

SEQ ID NO: 10517 - DNA, 19 bp, Artificial Sequence
  Target B2M Sequence complement
tagaaatataattgacagg

SEQ ID NO: 10518 - DNA, 19 bp, Artificial Sequence
  Target B2M Sequence complement
agaaatataattgacagga

SEQ ID NO: 10519 - DNA, 19 bp, Artificial Sequence
  Target B2M Sequence complement
gaaatataattgacaggat

SEQ ID NO: 10520 - DNA, 19 bp, Artificial Sequence
  Target B2M Sequence complement
ataattgacaggattattg

SEQ ID NO: 10521 - DNA, 19 bp, Artificial Sequence
  Target B2M Sequence complement
taattgacaggattattgg

SEQ ID NO: 10522 - DNA, 19 bp, Artificial Sequence
  Target B2M Sequence complement
aattgacaggattattgga

SEQ ID NO: 10523 - DNA, 19 bp, Artificial Sequence
  Target B2M Sequence complement
attgacaggattattggaa

SEQ ID NO: 10524 - DNA, 19 bp, Artificial Sequence
  Target B2M Sequence complement
ttgacaggattattggaaa

SEQ ID NO: 10525 - DNA, 19 bp, Artificial Sequence
  Target B2M Sequence complement
tgacaggattattggaaat

SEQ ID NO: 10526 - DNA, 19 bp, Artificial Sequence
  Target B2M Sequence complement
gacaggattattggaaatt

SEQ ID NO: 10527 - DNA, 19 bp, Artificial Sequence
  Target B2M Sequence complement
acaggattattggaaattt

SEQ ID NO: 10528 - DNA, 19 bp, Artificial Sequence
  Target B2M Sequence complement
caggattattggaaatttg

SEQ ID NO: 10529 - DNA, 19 bp, Artificial Sequence
  Target B2M Sequence complement
aggattattggaaatttgt

SEQ ID NO: 10530 - DNA, 19 bp, Artificial Sequence
  Target B2M Sequence complement
ggattattggaaatttgtt

SEQ ID NO: 10531 - DNA, 19 bp, Artificial Sequence
  Target B2M Sequence complement
tacatttgataaagtaagg

SEQ ID NO: 10532 - DNA, 19 bp, Artificial Sequence
  Target B2M Sequence complement
acatttgataaagtaaggc

SEQ ID NO: 10533 - DNA, 19 bp, Artificial Sequence
  Target B2M Sequence complement
catttgataaagtaaggca

SEQ ID NO: 10534 - DNA, 19 bp, Artificial Sequence
  Target B2M Sequence complement
atttgataaagtaaggcat

SEQ ID NO: 10535 - DNA, 19 bp, Artificial Sequence
  Target B2M Sequence complement
tttgataaagtaaggcatg

SEQ ID NO: 10536 - DNA, 19 bp, Artificial Sequence
  Target B2M Sequence complement
ttgataaagtaaggcatgg

SEQ ID NO: 10537 - DNA, 19 bp, Artificial Sequence
  Target B2M Sequence complement
tgataaagtaaggcatggt

SEQ ID NO: 10538 - DNA, 19 bp, Artificial Sequence
  Target B2M Sequence complement
gataaagtaaggcatggtt

SEQ ID NO: 10539 - DNA, 19 bp, Artificial Sequence
  Target B2M Sequence complement
ataaagtaaggcatggttg

SEQ ID NO: 10540 - DNA, 19 bp, Artificial Sequence
  Target B2M Sequence complement
taaagtaaggcatggttgt

SEQ ID NO: 10541 - DNA, 19 bp, Artificial Sequence
  Target B2M Sequence complement
aaagtaaggcatggttgtg

SEQ ID NO: 10542 - DNA, 19 bp, Artificial Sequence
  Target B2M Sequence complement
aagtaaggcatggttgtgg

SEQ ID NO: 10543 - DNA, 19 bp, Artificial Sequence
  Target B2M Sequence complement
agtaaggcatggttgtggt

SEQ ID NO: 10544 - DNA, 19 bp, Artificial Sequence
  Target B2M Sequence complement
gtaaggcatggttgtggtt

SEQ ID NO: 10545 - DNA, 19 bp, Artificial Sequence
  Target B2M Sequence complement
taaggcatggttgtggtta

SEQ ID NO: 10546 - DNA, 19 bp, Artificial Sequence
  Target B2M Sequence complement
aaggcatggttgtggttaa

SEQ ID NO: 10547 - DNA, 19 bp, Artificial Sequence
  Target B2M Sequence complement
aggcatggttgtggttaat

SEQ ID NO: 10548 - DNA, 19 bp, Artificial Sequence
  Target B2M Sequence complement
ggcatggttgtggttaatc

SEQ ID NO: 10549 - DNA, 19 bp, Artificial Sequence
  Target B2M Sequence complement
gcatggttgtggttaatct

SEQ ID NO: 10550 - DNA, 19 bp, Artificial Sequence
  Target B2M Sequence complement
catggttgtggttaatctg

SEQ ID NO: 10551 - DNA, 19 bp, Artificial Sequence
  Target B2M Sequence complement
atggttgtggttaatctgg

SEQ ID NO: 10552 - DNA, 19 bp, Artificial Sequence
  Target B2M Sequence complement
tggttgtggttaatctggt

SEQ ID NO: 10553 - DNA, 19 bp, Artificial Sequence
  Target B2M Sequence complement
ggttgtggttaatctggtt

SEQ ID NO: 10554 - DNA, 19 bp, Artificial Sequence
  Target B2M Sequence complement
gttgtggttaatctggttt

SEQ ID NO: 10555 - DNA, 19 bp, Artificial Sequence
  Target B2M Sequence complement
ttgtggttaatctggttta

SEQ ID NO: 10556 - DNA, 19 bp, Artificial Sequence
  Target B2M Sequence complement
tgtggttaatctggtttat

SEQ ID NO: 10557 - DNA, 19 bp, Artificial Sequence
  Target B2M Sequence complement
gtggttaatctggtttatt

SEQ ID NO: 10558 - DNA, 19 bp, Artificial Sequence
  Target B2M Sequence complement
tggttaatctggtttattt

SEQ ID NO: 10559 - DNA, 19 bp, Artificial Sequence
  Target B2M Sequence complement
tttgttccacaagttaaat

SEQ ID NO: 10560 - DNA, 19 bp, Artificial Sequence
  Target B2M Sequence complement
ttgttccacaagttaaata

SEQ ID NO: 10561 - DNA, 19 bp, Artificial Sequence
  Target B2M Sequence complement
tgttccacaagttaaataa

SEQ ID NO: 10562 - DNA, 19 bp, Artificial Sequence
  Target B2M Sequence complement
gttccacaagttaaataaa

SEQ ID NO: 10563 - DNA, 19 bp, Artificial Sequence
  Target B2M Sequence complement
tccacaagttaaataaatc

SEQ ID NO: 10564 - DNA, 19 bp, Artificial Sequence
  Target B2M Sequence complement
ccacaagttaaataaatca

SEQ ID NO: 10565 - DNA, 20 bp, Artificial Sequence
  Target B2M Sequence complement
attcctgaagctgacagcat

SEQ ID NO: 10566 - DNA, 20 bp, Artificial Sequence
  Target B2M Sequence complement
ttcctgaagctgacagcatt

SEQ ID NO: 10567 - DNA, 20 bp, Artificial Sequence
  Target B2M Sequence complement
tcctgaagctgacagcattc

SEQ ID NO: 10568 - DNA, 20 bp, Artificial Sequence
  Target B2M Sequence complement
cctgaagctgacagcattcg

SEQ ID NO: 10569 - DNA, 20 bp, Artificial Sequence
  Target B2M Sequence complement
ctgaagctgacagcattcgg

SEQ ID NO: 10570 - DNA, 20 bp, Artificial Sequence
  Target B2M Sequence complement
tgaagctgacagcattcggg

SEQ ID NO: 10571 - DNA, 20 bp, Artificial Sequence
  Target B2M Sequence complement
ttagctgtgctcgcgctact

SEQ ID NO: 10572 - DNA, 20 bp, Artificial Sequence
  Target B2M Sequence complement
tgctcgcgctactctctctt

SEQ ID NO: 10573 - DNA, 20 bp, Artificial Sequence
  Target B2M Sequence complement
gctcgcgctactctctcttt

SEQ ID NO: 10574 - DNA, 20 bp, Artificial Sequence
  Target B2M Sequence complement
tcgcgctactctctctttct

SEQ ID NO: 10575 - DNA, 20 bp, Artificial Sequence
  Target B2M Sequence complement
cgcgctactctctctttctg

SEQ ID NO: 10576 - DNA, 20 bp, Artificial Sequence
  Target B2M Sequence complement
gcgctactctctctttctgg

SEQ ID NO: 10577 - DNA, 20 bp, Artificial Sequence
  Target B2M Sequence complement
cgctactctctctttctggc

SEQ ID NO: 10578 - DNA, 20 bp, Artificial Sequence
  Target B2M Sequence complement
gctactctctctttctggcc

SEQ ID NO: 10579 - DNA, 20 bp, Artificial Sequence
  Target B2M Sequence complement
ctactctctctttctggcct

SEQ ID NO: 10580 - DNA, 20 bp, Artificial Sequence
  Target B2M Sequence complement
tactctctctttctggcctg

SEQ ID NO: 10581 - DNA, 20 bp, Artificial Sequence
  Target B2M Sequence complement
ctctctctttctggcctgga

SEQ ID NO: 10582 - DNA, 20 bp, Artificial Sequence
  Target B2M Sequence complement
tctctctttctggcctggag

SEQ ID NO: 10583 - DNA, 20 bp, Artificial Sequence
  Target B2M Sequence complement
tctttctggcctggaggcta

SEQ ID NO: 10584 - DNA, 20 bp, Artificial Sequence
  Target B2M Sequence complement
ctttctggcctggaggctat

SEQ ID NO: 10585 - DNA, 20 bp, Artificial Sequence
  Target B2M Sequence complement
tttctggcctggaggctatc

SEQ ID NO: 10586 - DNA, 20 bp, Artificial Sequence
  Target B2M Sequence complement
tggaggctatccagcgtact

SEQ ID NO: 10587 - DNA, 20 bp, Artificial Sequence
  Target B2M Sequence complement
aggctatccagcgtactcca

SEQ ID NO: 10588 - DNA, 20 bp, Artificial Sequence
  Target B2M Sequence complement
ggctatccagcgtactccaa

SEQ ID NO: 10589 - DNA, 20 bp, Artificial Sequence
  Target B2M Sequence complement
gctatccagcgtactccaaa

SEQ ID NO: 10590 - DNA, 20 bp, Artificial Sequence
  Target B2M Sequence complement
ctatccagcgtactccaaag

SEQ ID NO: 10591 - DNA, 20 bp, Artificial Sequence
  Target B2M Sequence complement
tatccagcgtactccaaaga

SEQ ID NO: 10592 - DNA, 20 bp, Artificial Sequence
  Target B2M Sequence complement
atccagcgtactccaaagat

SEQ ID NO: 10593 - DNA, 20 bp, Artificial Sequence
  Target B2M Sequence complement
tccagcgtactccaaagatt

SEQ ID NO: 10594 - DNA, 20 bp, Artificial Sequence
  Target B2M Sequence complement
ccagcgtactccaaagattc

SEQ ID NO: 10595 - DNA, 20 bp, Artificial Sequence
  Target B2M Sequence complement
cagcgtactccaaagattca

SEQ ID NO: 10596 - DNA, 20 bp, Artificial Sequence
  Target B2M Sequence complement
agcgtactccaaagattcag

SEQ ID NO: 10597 - DNA, 20 bp, Artificial Sequence
  Target B2M Sequence complement
gcgtactccaaagattcagg

SEQ ID NO: 10598 - DNA, 20 bp, Artificial Sequence
  Target B2M Sequence complement
cgtactccaaagattcaggt

SEQ ID NO: 10599 - DNA, 20 bp, Artificial Sequence
  Target B2M Sequence complement
gtactccaaagattcaggtt

SEQ ID NO: 10600 - DNA, 20 bp, Artificial Sequence
  Target B2M Sequence complement
tactccaaagattcaggttt

SEQ ID NO: 10601 - DNA, 20 bp, Artificial Sequence
  Target B2M Sequence complement
actccaaagattcaggttta

SEQ ID NO: 10602 - DNA, 20 bp, Artificial Sequence
  Target B2M Sequence complement
ctccaaagattcaggtttac

SEQ ID NO: 10603 - DNA, 20 bp, Artificial Sequence
  Target B2M Sequence complement
tccaaagattcaggtttact

SEQ ID NO: 10604 - DNA, 20 bp, Artificial Sequence
  Target B2M Sequence complement
ccaaagattcaggtttactc

SEQ ID NO: 10605 - DNA, 20 bp, Artificial Sequence
  Target B2M Sequence complement
caaagattcaggtttactca

SEQ ID NO: 10606 - DNA, 20 bp, Artificial Sequence
  Target B2M Sequence complement
aaagattcaggtttactcac

SEQ ID NO: 10607 - DNA, 20 bp, Artificial Sequence
  Target B2M Sequence complement
aagattcaggtttactcacg

SEQ ID NO: 10608 - DNA, 20 bp, Artificial Sequence
  Target B2M Sequence complement
agattcaggtttactcacgt

SEQ ID NO: 10609 - DNA, 20 bp, Artificial Sequence
  Target B2M Sequence complement
gattcaggtttactcacgtc

SEQ ID NO: 10610 - DNA, 20 bp, Artificial Sequence
  Target B2M Sequence complement
attcaggtttactcacgtca

SEQ ID NO: 10611 - DNA, 20 bp, Artificial Sequence
  Target B2M Sequence complement
ttcaggtttactcacgtcat

SEQ ID NO: 10612 - DNA, 20 bp, Artificial Sequence
  Target B2M Sequence complement
tcaggtttactcacgtcatc

SEQ ID NO: 10613 - DNA, 20 bp, Artificial Sequence
  Target B2M Sequence complement
caggtttactcacgtcatcc

SEQ ID NO: 10614 - DNA, 20 bp, Artificial Sequence
  Target B2M Sequence complement
aggtttactcacgtcatcca

SEQ ID NO: 10615 - DNA, 20 bp, Artificial Sequence
  Target B2M Sequence complement
ggtttactcacgtcatccag

SEQ ID NO: 10616 - DNA, 20 bp, Artificial Sequence
  Target B2M Sequence complement
gtttactcacgtcatccagc

SEQ ID NO: 10617 - DNA, 20 bp, Artificial Sequence
  Target B2M Sequence complement
tttactcacgtcatccagca

SEQ ID NO: 10618 - DNA, 20 bp, Artificial Sequence
  Target B2M Sequence complement
ttactcacgtcatccagcag

SEQ ID NO: 10619 - DNA, 20 bp, Artificial Sequence
  Target B2M Sequence complement
tactcacgtcatccagcaga

SEQ ID NO: 10620 - DNA, 20 bp, Artificial Sequence
  Target B2M Sequence complement
actcacgtcatccagcagag

SEQ ID NO: 10621 - DNA, 20 bp, Artificial Sequence
  Target B2M Sequence complement
ctcacgtcatccagcagaga

SEQ ID NO: 10622 - DNA, 20 bp, Artificial Sequence
  Target B2M Sequence complement
tcacgtcatccagcagagaa

SEQ ID NO: 10623 - DNA, 20 bp, Artificial Sequence
  Target B2M Sequence complement
cacgtcatccagcagagaat

SEQ ID NO: 10624 - DNA, 20 bp, Artificial Sequence
  Target B2M Sequence complement
acgtcatccagcagagaatg

SEQ ID NO: 10625 - DNA, 20 bp, Artificial Sequence
  Target B2M Sequence complement
cgtcatccagcagagaatgg

SEQ ID NO: 10626 - DNA, 20 bp, Artificial Sequence
  Target B2M Sequence complement
gtcatccagcagagaatgga

SEQ ID NO: 10627 - DNA, 20 bp, Artificial Sequence
  Target B2M Sequence complement
tcatccagcagagaatggaa

SEQ ID NO: 10628 - DNA, 20 bp, Artificial Sequence
  Target B2M Sequence complement
catccagcagagaatggaaa

SEQ ID NO: 10629 - DNA, 20 bp, Artificial Sequence
  Target B2M Sequence complement
atccagcagagaatggaaag

SEQ ID NO: 10630 - DNA, 20 bp, Artificial Sequence
  Target B2M Sequence complement
tccagcagagaatggaaagt

SEQ ID NO: 10631 - DNA, 20 bp, Artificial Sequence
  Target B2M Sequence complement
ccagcagagaatggaaagtc

SEQ ID NO: 10632 - DNA, 20 bp, Artificial Sequence
  Target B2M Sequence complement
cagcagagaatggaaagtca

SEQ ID NO: 10633 - DNA, 20 bp, Artificial Sequence
  Target B2M Sequence complement
agcagagaatggaaagtcaa

SEQ ID NO: 10634 - DNA, 20 bp, Artificial Sequence
  Target B2M Sequence complement
gcagagaatggaaagtcaaa

SEQ ID NO: 10635 - DNA, 20 bp, Artificial Sequence
  Target B2M Sequence complement
cagagaatggaaagtcaaat

SEQ ID NO: 10636 - DNA, 20 bp, Artificial Sequence
  Target B2M Sequence complement
agagaatggaaagtcaaatt

SEQ ID NO: 10637 - DNA, 20 bp, Artificial Sequence
  Target B2M Sequence complement
gagaatggaaagtcaaattt

SEQ ID NO: 10638 - DNA, 20 bp, Artificial Sequence
  Target B2M Sequence complement
agaatggaaagtcaaatttc

SEQ ID NO: 10639 - DNA, 20 bp, Artificial Sequence
  Target B2M Sequence complement
gaatggaaagtcaaatttcc

SEQ ID NO: 10640 - DNA, 20 bp, Artificial Sequence
  Target B2M Sequence complement
aatggaaagtcaaatttcct

SEQ ID NO: 10641 - DNA, 20 bp, Artificial Sequence
  Target B2M Sequence complement
atggaaagtcaaatttcctg

SEQ ID NO: 10642 - DNA, 20 bp, Artificial Sequence
  Target B2M Sequence complement
tggaaagtcaaatttcctga

SEQ ID NO: 10643 - DNA, 20 bp, Artificial Sequence
  Target B2M Sequence complement
ggaaagtcaaatttcctgaa

SEQ ID NO: 10644 - DNA, 20 bp, Artificial Sequence
  Target B2M Sequence complement
gaaagtcaaatttcctgaat

SEQ ID NO: 10645 - DNA, 20 bp, Artificial Sequence
  Target B2M Sequence complement
aaagtcaaatttcctgaatt

SEQ ID NO: 10646 - DNA, 20 bp, Artificial Sequence
  Target B2M Sequence complement
aagtcaaatttcctgaattg

SEQ ID NO: 10647 - DNA, 20 bp, Artificial Sequence
  Target B2M Sequence complement
agtcaaatttcctgaattgc

SEQ ID NO: 10648 - DNA, 20 bp, Artificial Sequence
  Target B2M Sequence complement
gtcaaatttcctgaattgct

SEQ ID NO: 10649 - DNA, 20 bp, Artificial Sequence
  Target B2M Sequence complement
tcaaatttcctgaattgcta

SEQ ID NO: 10650 - DNA, 20 bp, Artificial Sequence
  Target B2M Sequence complement
caaatttcctgaattgctat

SEQ ID NO: 10651 - DNA, 20 bp, Artificial Sequence
  Target B2M Sequence complement
aaatttcctgaattgctatg

SEQ ID NO: 10652 - DNA, 20 bp, Artificial Sequence
  Target B2M Sequence complement
aatttcctgaattgctatgt

SEQ ID NO: 10653 - DNA, 20 bp, Artificial Sequence
  Target B2M Sequence complement
atttcctgaattgctatgtg

SEQ ID NO: 10654 - DNA, 20 bp, Artificial Sequence
  Target B2M Sequence complement
tttcctgaattgctatgtgt

SEQ ID NO: 10655 - DNA, 20 bp, Artificial Sequence
  Target B2M Sequence complement
ttcctgaattgctatgtgtc

SEQ ID NO: 10656 - DNA, 20 bp, Artificial Sequence
  Target B2M Sequence complement
tcctgaattgctatgtgtct

SEQ ID NO: 10657 - DNA, 20 bp, Artificial Sequence
  Target B2M Sequence complement
cctgaattgctatgtgtctg

SEQ ID NO: 10658 - DNA, 20 bp, Artificial Sequence
  Target B2M Sequence complement
ctgaattgctatgtgtctgg

SEQ ID NO: 10659 - DNA, 20 bp, Artificial Sequence
  Target B2M Sequence complement
tgaattgctatgtgtctggg

SEQ ID NO: 10660 - DNA, 20 bp, Artificial Sequence
  Target B2M Sequence complement
gaattgctatgtgtctgggt

SEQ ID NO: 10661 - DNA, 20 bp, Artificial Sequence
  Target B2M Sequence complement
aattgctatgtgtctgggtt

SEQ ID NO: 10662 - DNA, 20 bp, Artificial Sequence
  Target B2M Sequence complement
attgctatgtgtctgggttt

SEQ ID NO: 10663 - DNA, 20 bp, Artificial Sequence
  Target B2M Sequence complement
ttgctatgtgtctgggtttc

SEQ ID NO: 10664 - DNA, 20 bp, Artificial Sequence
  Target B2M Sequence complement
tgctatgtgtctgggtttca

SEQ ID NO: 10665 - DNA, 20 bp, Artificial Sequence
  Target B2M Sequence complement
gctatgtgtctgggtttcat

SEQ ID NO: 10666 - DNA, 20 bp, Artificial Sequence
  Target B2M Sequence complement
ctatgtgtctgggtttcatc

SEQ ID NO: 10667 - DNA, 20 bp, Artificial Sequence
  Target B2M Sequence complement
tatgtgtctgggtttcatcc

SEQ ID NO: 10668 - DNA, 20 bp, Artificial Sequence
  Target B2M Sequence complement
atgtgtctgggtttcatcca

SEQ ID NO: 10669 - DNA, 20 bp, Artificial Sequence
  Target B2M Sequence complement
tgtgtctgggtttcatccat

SEQ ID NO: 10670 - DNA, 20 bp, Artificial Sequence
  Target B2M Sequence complement
gtgtctgggtttcatccatc

SEQ ID NO: 10671 - DNA, 20 bp, Artificial Sequence
  Target B2M Sequence complement
tgtctgggtttcatccatcc

SEQ ID NO: 10672 - DNA, 20 bp, Artificial Sequence
  Target B2M Sequence complement
gtctgggtttcatccatccg

SEQ ID NO: 10673 - DNA, 20 bp, Artificial Sequence
  Target B2M Sequence complement
tctgggtttcatccatccga

SEQ ID NO: 10674 - DNA, 20 bp, Artificial Sequence
  Target B2M Sequence complement
ctgggtttcatccatccgac

SEQ ID NO: 10675 - DNA, 20 bp, Artificial Sequence
  Target B2M Sequence complement
tgggtttcatccatccgaca

SEQ ID NO: 10676 - DNA, 20 bp, Artificial Sequence
  Target B2M Sequence complement
gggtttcatccatccgacat

SEQ ID NO: 10677 - DNA, 20 bp, Artificial Sequence
  Target B2M Sequence complement
ggtttcatccatccgacatt

SEQ ID NO: 10678 - DNA, 20 bp, Artificial Sequence
  Target B2M Sequence complement
gtttcatccatccgacattg

SEQ ID NO: 10679 - DNA, 20 bp, Artificial Sequence
  Target B2M Sequence complement
tttcatccatccgacattga

SEQ ID NO: 10680 - DNA, 20 bp, Artificial Sequence
  Target B2M Sequence complement
ttcatccatccgacattgaa

SEQ ID NO: 10681 - DNA, 20 bp, Artificial Sequence
  Target B2M Sequence complement
tcatccatccgacattgaag

SEQ ID NO: 10682 - DNA, 20 bp, Artificial Sequence
  Target B2M Sequence complement
catccatccgacattgaagt

SEQ ID NO: 10683 - DNA, 20 bp, Artificial Sequence
  Target B2M Sequence complement
atccatccgacattgaagtt

SEQ ID NO: 10684 - DNA, 20 bp, Artificial Sequence
  Target B2M Sequence complement
tccatccgacattgaagttg

SEQ ID NO: 10685 - DNA, 20 bp, Artificial Sequence
  Target B2M Sequence complement
ccatccgacattgaagttga

SEQ ID NO: 10686 - DNA, 20 bp, Artificial Sequence
  Target B2M Sequence complement
catccgacattgaagttgac

SEQ ID NO: 10687 - DNA, 20 bp, Artificial Sequence
  Target B2M Sequence complement
atccgacattgaagttgact

SEQ ID NO: 10688 - DNA, 20 bp, Artificial Sequence
  Target B2M Sequence complement
tccgacattgaagttgactt

SEQ ID NO: 10689 - DNA, 20 bp, Artificial Sequence
  Target B2M Sequence complement
ccgacattgaagttgactta

SEQ ID NO: 10690 - DNA, 20 bp, Artificial Sequence
  Target B2M Sequence complement
cgacattgaagttgacttac

SEQ ID NO: 10691 - DNA, 20 bp, Artificial Sequence
  Target B2M Sequence complement
gacattgaagttgacttact

SEQ ID NO: 10692 - DNA, 20 bp, Artificial Sequence
  Target B2M Sequence complement
acattgaagttgacttactg

SEQ ID NO: 10693 - DNA, 20 bp, Artificial Sequence
  Target B2M Sequence complement
cattgaagttgacttactga

SEQ ID NO: 10694 - DNA, 20 bp, Artificial Sequence
  Target B2M Sequence complement
attgaagttgacttactgaa

SEQ ID NO: 10695 - DNA, 20 bp, Artificial Sequence
  Target B2M Sequence complement
ttgaagttgacttactgaag

SEQ ID NO: 10696 - DNA, 20 bp, Artificial Sequence
  Target B2M Sequence complement
tgaagttgacttactgaaga

SEQ ID NO: 10697 - DNA, 20 bp, Artificial Sequence
  Target B2M Sequence complement
aagttgacttactgaagaat

SEQ ID NO: 10698 - DNA, 20 bp, Artificial Sequence
  Target B2M Sequence complement
agttgacttactgaagaatg

SEQ ID NO: 10699 - DNA, 20 bp, Artificial Sequence
  Target B2M Sequence complement
gttgacttactgaagaatgg

SEQ ID NO: 10700 - DNA, 20 bp, Artificial Sequence
  Target B2M Sequence complement
ttgacttactgaagaatgga

SEQ ID NO: 10701 - DNA, 20 bp, Artificial Sequence
  Target B2M Sequence complement
tgacttactgaagaatggag

SEQ ID NO: 10702 - DNA, 20 bp, Artificial Sequence
  Target B2M Sequence complement
gacttactgaagaatggaga

SEQ ID NO: 10703 - DNA, 20 bp, Artificial Sequence
  Target B2M Sequence complement
acttactgaagaatggagag

SEQ ID NO: 10704 - DNA, 20 bp, Artificial Sequence
  Target B2M Sequence complement
cttactgaagaatggagaga

SEQ ID NO: 10705 - DNA, 20 bp, Artificial Sequence
  Target B2M Sequence complement
ttactgaagaatggagagag

SEQ ID NO: 10706 - DNA, 20 bp, Artificial Sequence
  Target B2M Sequence complement
tactgaagaatggagagaga

SEQ ID NO: 10707 - DNA, 20 bp, Artificial Sequence
  Target B2M Sequence complement
actgaagaatggagagagaa

SEQ ID NO: 10708 - DNA, 20 bp, Artificial Sequence
  Target B2M Sequence complement
ctgaagaatggagagagaat

SEQ ID NO: 10709 - DNA, 20 bp, Artificial Sequence
  Target B2M Sequence complement
tgaagaatggagagagaatt

SEQ ID NO: 10710 - DNA, 20 bp, Artificial Sequence
  Target B2M Sequence complement
gaagaatggagagagaattg

SEQ ID NO: 10711 - DNA, 20 bp, Artificial Sequence
  Target B2M Sequence complement
aagaatggagagagaattga

SEQ ID NO: 10712 - DNA, 20 bp, Artificial Sequence
  Target B2M Sequence complement
agaatggagagagaattgaa

SEQ ID NO: 10713 - DNA, 20 bp, Artificial Sequence
  Target B2M Sequence complement
gaatggagagagaattgaaa

SEQ ID NO: 10714 - DNA, 20 bp, Artificial Sequence
  Target B2M Sequence complement
aaagtggagcattcagactt

SEQ ID NO: 10715 - DNA, 20 bp, Artificial Sequence
  Target B2M Sequence complement
aagtggagcattcagacttg

SEQ ID NO: 10716 - DNA, 20 bp, Artificial Sequence
  Target B2M Sequence complement
agtggagcattcagacttgt

SEQ ID NO: 10717 - DNA, 20 bp, Artificial Sequence
  Target B2M Sequence complement
gtggagcattcagacttgtc

SEQ ID NO: 10718 - DNA, 20 bp, Artificial Sequence
  Target B2M Sequence complement
tggagcattcagacttgtct

SEQ ID NO: 10719 - DNA, 20 bp, Artificial Sequence
  Target B2M Sequence complement
ggagcattcagacttgtctt

SEQ ID NO: 10720 - DNA, 20 bp, Artificial Sequence
  Target B2M Sequence complement
gagcattcagacttgtcttt

SEQ ID NO: 10721 - DNA, 20 bp, Artificial Sequence
  Target B2M Sequence complement
agcattcagacttgtctttc

SEQ ID NO: 10722 - DNA, 20 bp, Artificial Sequence
  Target B2M Sequence complement
gcattcagacttgtctttca

SEQ ID NO: 10723 - DNA, 20 bp, Artificial Sequence
  Target B2M Sequence complement
cattcagacttgtctttcag

SEQ ID NO: 10724 - DNA, 20 bp, Artificial Sequence
  Target B2M Sequence complement
attcagacttgtctttcagc

SEQ ID NO: 10725 - DNA, 20 bp, Artificial Sequence
  Target B2M Sequence complement
ttcagacttgtctttcagca

SEQ ID NO: 10726 - DNA, 20 bp, Artificial Sequence
  Target B2M Sequence complement
tcagacttgtctttcagcaa

SEQ ID NO: 10727 - DNA, 20 bp, Artificial Sequence
  Target B2M Sequence complement
cagacttgtctttcagcaag

SEQ ID NO: 10728 - DNA, 20 bp, Artificial Sequence
  Target B2M Sequence complement
agacttgtctttcagcaagg

SEQ ID NO: 10729 - DNA, 20 bp, Artificial Sequence
  Target B2M Sequence complement
gacttgtctttcagcaagga

SEQ ID NO: 10730 - DNA, 20 bp, Artificial Sequence
  Target B2M Sequence complement
cttgtctttcagcaaggact

SEQ ID NO: 10731 - DNA, 20 bp, Artificial Sequence
  Target B2M Sequence complement
ttgtctttcagcaaggactg

SEQ ID NO: 10732 - DNA, 20 bp, Artificial Sequence
  Target B2M Sequence complement
tgtctttcagcaaggactgg

SEQ ID NO: 10733 - DNA, 20 bp, Artificial Sequence
  Target B2M Sequence complement
gtctttcagcaaggactggt

SEQ ID NO: 10734 - DNA, 20 bp, Artificial Sequence
  Target B2M Sequence complement
tctttcagcaaggactggtc

SEQ ID NO: 10735 - DNA, 20 bp, Artificial Sequence
  Target B2M Sequence complement
ctttcagcaaggactggtct

SEQ ID NO: 10736 - DNA, 20 bp, Artificial Sequence
  Target B2M Sequence complement
tttcagcaaggactggtctt

SEQ ID NO: 10737 - DNA, 20 bp, Artificial Sequence
  Target B2M Sequence complement
ttcagcaaggactggtcttt

SEQ ID NO: 10738 - DNA, 20 bp, Artificial Sequence
  Target B2M Sequence complement
tcagcaaggactggtctttc

SEQ ID NO: 10739 - DNA, 20 bp, Artificial Sequence
  Target B2M Sequence complement
cagcaaggactggtctttct

SEQ ID NO: 10740 - DNA, 20 bp, Artificial Sequence
  Target B2M Sequence complement
agcaaggactggtctttcta

SEQ ID NO: 10741 - DNA, 20 bp, Artificial Sequence
  Target B2M Sequence complement
gcaaggactggtctttctat

SEQ ID NO: 10742 - DNA, 20 bp, Artificial Sequence
  Target B2M Sequence complement
caaggactggtctttctatc

SEQ ID NO: 10743 - DNA, 20 bp, Artificial Sequence
  Target B2M Sequence complement
aaggactggtctttctatct

SEQ ID NO: 10744 - DNA, 20 bp, Artificial Sequence
  Target B2M Sequence complement
aggactggtctttctatctc

SEQ ID NO: 10745 - DNA, 20 bp, Artificial Sequence
  Target B2M Sequence complement
ggactggtctttctatctct

SEQ ID NO: 10746 - DNA, 20 bp, Artificial Sequence
  Target B2M Sequence complement
gactggtctttctatctctt

SEQ ID NO: 10747 - DNA, 20 bp, Artificial Sequence
  Target B2M Sequence complement
actggtctttctatctcttg

SEQ ID NO: 10748 - DNA, 20 bp, Artificial Sequence
  Target B2M Sequence complement
ctggtctttctatctcttgt

SEQ ID NO: 10749 - DNA, 20 bp, Artificial Sequence
  Target B2M Sequence complement
tggtctttctatctcttgta

SEQ ID NO: 10750 - DNA, 20 bp, Artificial Sequence
  Target B2M Sequence complement
ggtctttctatctcttgtac

SEQ ID NO: 10751 - DNA, 20 bp, Artificial Sequence
  Target B2M Sequence complement
gtctttctatctcttgtact

SEQ ID NO: 10752 - DNA, 20 bp, Artificial Sequence
  Target B2M Sequence complement
tctttctatctcttgtacta

SEQ ID NO: 10753 - DNA, 20 bp, Artificial Sequence
  Target B2M Sequence complement
ctttctatctcttgtactac

SEQ ID NO: 10754 - DNA, 20 bp, Artificial Sequence
  Target B2M Sequence complement
tttctatctcttgtactaca

SEQ ID NO: 10755 - DNA, 20 bp, Artificial Sequence
  Target B2M Sequence complement
ttctatctcttgtactacac

SEQ ID NO: 10756 - DNA, 20 bp, Artificial Sequence
  Target B2M Sequence complement
tctatctcttgtactacact

SEQ ID NO: 10757 - DNA, 20 bp, Artificial Sequence
  Target B2M Sequence complement
ctatctcttgtactacactg

SEQ ID NO: 10758 - DNA, 20 bp, Artificial Sequence
  Target B2M Sequence complement
tatctcttgtactacactga

SEQ ID NO: 10759 - DNA, 20 bp, Artificial Sequence
  Target B2M Sequence complement
atctcttgtactacactgaa

SEQ ID NO: 10760 - DNA, 20 bp, Artificial Sequence
  Target B2M Sequence complement
tctcttgtactacactgaat

SEQ ID NO: 10761 - DNA, 20 bp, Artificial Sequence
  Target B2M Sequence complement
ctcttgtactacactgaatt

SEQ ID NO: 10762 - DNA, 20 bp, Artificial Sequence
  Target B2M Sequence complement
tcttgtactacactgaattc

SEQ ID NO: 10763 - DNA, 20 bp, Artificial Sequence
  Target B2M Sequence complement
cttgtactacactgaattca

SEQ ID NO: 10764 - DNA, 20 bp, Artificial Sequence
  Target B2M Sequence complement
ttgtactacactgaattcac

SEQ ID NO: 10765 - DNA, 20 bp, Artificial Sequence
  Target B2M Sequence complement
tgtactacactgaattcacc

SEQ ID NO: 10766 - DNA, 20 bp, Artificial Sequence
  Target B2M Sequence complement
gtactacactgaattcaccc

SEQ ID NO: 10767 - DNA, 20 bp, Artificial Sequence
  Target B2M Sequence complement
aaagatgagtatgcctgccg

SEQ ID NO: 10768 - DNA, 20 bp, Artificial Sequence
  Target B2M Sequence complement
aagatgagtatgcctgccgt

SEQ ID NO: 10769 - DNA, 20 bp, Artificial Sequence
  Target B2M Sequence complement
agatgagtatgcctgccgtg

SEQ ID NO: 10770 - DNA, 20 bp, Artificial Sequence
  Target B2M Sequence complement
gatgagtatgcctgccgtgt

SEQ ID NO: 10771 - DNA, 20 bp, Artificial Sequence
  Target B2M Sequence complement
atgagtatgcctgccgtgtg

SEQ ID NO: 10772 - DNA, 20 bp, Artificial Sequence
  Target B2M Sequence complement
tgagtatgcctgccgtgtga

SEQ ID NO: 10773 - DNA, 20 bp, Artificial Sequence
  Target B2M Sequence complement
gagtatgcctgccgtgtgaa

SEQ ID NO: 10774 - DNA, 20 bp, Artificial Sequence
  Target B2M Sequence complement
agtatgcctgccgtgtgaac

SEQ ID NO: 10775 - DNA, 20 bp, Artificial Sequence
  Target B2M Sequence complement
tatgcctgccgtgtgaacca

SEQ ID NO: 10776 - DNA, 20 bp, Artificial Sequence
  Target B2M Sequence complement
atgcctgccgtgtgaaccat

SEQ ID NO: 10777 - DNA, 20 bp, Artificial Sequence
  Target B2M Sequence complement
ctgccgtgtgaaccatgtga

SEQ ID NO: 10778 - DNA, 20 bp, Artificial Sequence
  Target B2M Sequence complement
tgccgtgtgaaccatgtgac

SEQ ID NO: 10779 - DNA, 20 bp, Artificial Sequence
  Target B2M Sequence complement
gccgtgtgaaccatgtgact

SEQ ID NO: 10780 - DNA, 20 bp, Artificial Sequence
  Target B2M Sequence complement
ccgtgtgaaccatgtgactt

SEQ ID NO: 10781 - DNA, 20 bp, Artificial Sequence
  Target B2M Sequence complement
cgtgtgaaccatgtgacttt

SEQ ID NO: 10782 - DNA, 20 bp, Artificial Sequence
  Target B2M Sequence complement
gtgtgaaccatgtgactttg

SEQ ID NO: 10783 - DNA, 20 bp, Artificial Sequence
  Target B2M Sequence complement
tgtgaaccatgtgactttgt

SEQ ID NO: 10784 - DNA, 20 bp, Artificial Sequence
  Target B2M Sequence complement
gtgaaccatgtgactttgtc

SEQ ID NO: 10785 - DNA, 20 bp, Artificial Sequence
  Target B2M Sequence complement
tgaaccatgtgactttgtca

SEQ ID NO: 10786 - DNA, 20 bp, Artificial Sequence
  Target B2M Sequence complement
gaaccatgtgactttgtcac

SEQ ID NO: 10787 - DNA, 20 bp, Artificial Sequence
  Target B2M Sequence complement
aaccatgtgactttgtcaca

SEQ ID NO: 10788 - DNA, 20 bp, Artificial Sequence
  Target B2M Sequence complement
accatgtgactttgtcacag

SEQ ID NO: 10789 - DNA, 20 bp, Artificial Sequence
  Target B2M Sequence complement
ccatgtgactttgtcacagc

SEQ ID NO: 10790 - DNA, 20 bp, Artificial Sequence
  Target B2M Sequence complement
catgtgactttgtcacagcc

SEQ ID NO: 10791 - DNA, 20 bp, Artificial Sequence
  Target B2M Sequence complement
atgtgactttgtcacagccc

SEQ ID NO: 10792 - DNA, 20 bp, Artificial Sequence
  Target B2M Sequence complement
tgtgactttgtcacagccca

SEQ ID NO: 10793 - DNA, 20 bp, Artificial Sequence
  Target B2M Sequence complement
gtgactttgtcacagcccaa

SEQ ID NO: 10794 - DNA, 20 bp, Artificial Sequence
  Target B2M Sequence complement
tgactttgtcacagcccaag

SEQ ID NO: 10795 - DNA, 20 bp, Artificial Sequence
  Target B2M Sequence complement
gactttgtcacagcccaaga

SEQ ID NO: 10796 - DNA, 20 bp, Artificial Sequence
  Target B2M Sequence complement
actttgtcacagcccaagat

SEQ ID NO: 10797 - DNA, 20 bp, Artificial Sequence
  Target B2M Sequence complement
ctttgtcacagcccaagata

SEQ ID NO: 10798 - DNA, 20 bp, Artificial Sequence
  Target B2M Sequence complement
tttgtcacagcccaagatag

SEQ ID NO: 10799 - DNA, 20 bp, Artificial Sequence
  Target B2M Sequence complement
ttgtcacagcccaagatagt

SEQ ID NO: 10800 - DNA, 20 bp, Artificial Sequence
  Target B2M Sequence complement
tgtcacagcccaagatagtt

SEQ ID NO: 10801 - DNA, 20 bp, Artificial Sequence
  Target B2M Sequence complement
gtcacagcccaagatagtta

SEQ ID NO: 10802 - DNA, 20 bp, Artificial Sequence
  Target B2M Sequence complement
tcacagcccaagatagttaa

SEQ ID NO: 10803 - DNA, 20 bp, Artificial Sequence
  Target B2M Sequence complement
cagcccaagatagttaagtg

SEQ ID NO: 10804 - DNA, 20 bp, Artificial Sequence
  Target B2M Sequence complement
agcccaagatagttaagtgg

SEQ ID NO: 10805 - DNA, 20 bp, Artificial Sequence
  Target B2M Sequence complement
gcccaagatagttaagtggg

SEQ ID NO: 10806 - DNA, 20 bp, Artificial Sequence
  Target B2M Sequence complement
cccaagatagttaagtggga

SEQ ID NO: 10807 - DNA, 20 bp, Artificial Sequence
  Target B2M Sequence complement
ccaagatagttaagtgggat

SEQ ID NO: 10808 - DNA, 20 bp, Artificial Sequence
  Target B2M Sequence complement
caagatagttaagtgggatc

SEQ ID NO: 10809 - DNA, 20 bp, Artificial Sequence
  Target B2M Sequence complement
aagatagttaagtgggatcg

SEQ ID NO: 10810 - DNA, 20 bp, Artificial Sequence
  Target B2M Sequence complement
agatagttaagtgggatcga

SEQ ID NO: 10811 - DNA, 20 bp, Artificial Sequence
  Target B2M Sequence complement
gatagttaagtgggatcgag

SEQ ID NO: 10812 - DNA, 20 bp, Artificial Sequence
  Target B2M Sequence complement
atagttaagtgggatcgaga

SEQ ID NO: 10813 - DNA, 20 bp, Artificial Sequence
  Target B2M Sequence complement
tagttaagtgggatcgagac

SEQ ID NO: 10814 - DNA, 20 bp, Artificial Sequence
  Target B2M Sequence complement
agttaagtgggatcgagaca

SEQ ID NO: 10815 - DNA, 20 bp, Artificial Sequence
  Target B2M Sequence complement
gttaagtgggatcgagacat

SEQ ID NO: 10816 - DNA, 20 bp, Artificial Sequence
  Target B2M Sequence complement
ttaagtgggatcgagacatg

SEQ ID NO: 10817 - DNA, 20 bp, Artificial Sequence
  Target B2M Sequence complement
taagtgggatcgagacatgt

SEQ ID NO: 10818 - DNA, 20 bp, Artificial Sequence
  Target B2M Sequence complement
aagtgggatcgagacatgta

SEQ ID NO: 10819 - DNA, 20 bp, Artificial Sequence
  Target B2M Sequence complement
agtgggatcgagacatgtaa

SEQ ID NO: 10820 - DNA, 20 bp, Artificial Sequence
  Target B2M Sequence complement
gtgggatcgagacatgtaag

SEQ ID NO: 10821 - DNA, 20 bp, Artificial Sequence
  Target B2M Sequence complement
tgggatcgagacatgtaagc

SEQ ID NO: 10822 - DNA, 20 bp, Artificial Sequence
  Target B2M Sequence complement
gggatcgagacatgtaagca

SEQ ID NO: 10823 - DNA, 20 bp, Artificial Sequence
  Target B2M Sequence complement
ggatcgagacatgtaagcag

SEQ ID NO: 10824 - DNA, 20 bp, Artificial Sequence
  Target B2M Sequence complement
gatcgagacatgtaagcagc

SEQ ID NO: 10825 - DNA, 20 bp, Artificial Sequence
  Target B2M Sequence complement
atcgagacatgtaagcagca

SEQ ID NO: 10826 - DNA, 20 bp, Artificial Sequence
  Target B2M Sequence complement
tcgagacatgtaagcagcat

SEQ ID NO: 10827 - DNA, 20 bp, Artificial Sequence
  Target B2M Sequence complement
cgagacatgtaagcagcatc

SEQ ID NO: 10828 - DNA, 20 bp, Artificial Sequence
  Target B2M Sequence complement
agacatgtaagcagcatcat

SEQ ID NO: 10829 - DNA, 20 bp, Artificial Sequence
  Target B2M Sequence complement
gacatgtaagcagcatcatg

SEQ ID NO: 10830 - DNA, 20 bp, Artificial Sequence
  Target B2M Sequence complement
catgtaagcagcatcatgga

SEQ ID NO: 10831 - DNA, 20 bp, Artificial Sequence
  Target B2M Sequence complement
atgtaagcagcatcatggag

SEQ ID NO: 10832 - DNA, 20 bp, Artificial Sequence
  Target B2M Sequence complement
tgtaagcagcatcatggagg

SEQ ID NO: 10833 - DNA, 20 bp, Artificial Sequence
  Target B2M Sequence complement
gtaagcagcatcatggaggt

SEQ ID NO: 10834 - DNA, 20 bp, Artificial Sequence
  Target B2M Sequence complement
taagcagcatcatggaggtt

SEQ ID NO: 10835 - DNA, 20 bp, Artificial Sequence
  Target B2M Sequence complement
aagcagcatcatggaggttt

SEQ ID NO: 10836 - DNA, 20 bp, Artificial Sequence
  Target B2M Sequence complement
agcagcatcatggaggtttg

SEQ ID NO: 10837 - DNA, 20 bp, Artificial Sequence
  Target B2M Sequence complement
gcagcatcatggaggtttga

SEQ ID NO: 10838 - DNA, 20 bp, Artificial Sequence
  Target B2M Sequence complement
cagcatcatggaggtttgaa

SEQ ID NO: 10839 - DNA, 20 bp, Artificial Sequence
  Target B2M Sequence complement
agcatcatggaggtttgaag

SEQ ID NO: 10840 - DNA, 20 bp, Artificial Sequence
  Target B2M Sequence complement
gcatcatggaggtttgaaga

SEQ ID NO: 10841 - DNA, 20 bp, Artificial Sequence
  Target B2M Sequence complement
catcatggaggtttgaagat

SEQ ID NO: 10842 - DNA, 20 bp, Artificial Sequence
  Target B2M Sequence complement
atcatggaggtttgaagatg

SEQ ID NO: 10843 - DNA, 20 bp, Artificial Sequence
  Target B2M Sequence complement
tcatggaggtttgaagatgc

SEQ ID NO: 10844 - DNA, 20 bp, Artificial Sequence
  Target B2M Sequence complement
catggaggtttgaagatgcc

SEQ ID NO: 10845 - DNA, 20 bp, Artificial Sequence
  Target B2M Sequence complement
atggaggtttgaagatgccg

SEQ ID NO: 10846 - DNA, 20 bp, Artificial Sequence
  Target B2M Sequence complement
tggaggtttgaagatgccgc

SEQ ID NO: 10847 - DNA, 20 bp, Artificial Sequence
  Target B2M Sequence complement
ggaggtttgaagatgccgca

SEQ ID NO: 10848 - DNA, 20 bp, Artificial Sequence
  Target B2M Sequence complement
gaggtttgaagatgccgcat

SEQ ID NO: 10849 - DNA, 20 bp, Artificial Sequence
  Target B2M Sequence complement
aggtttgaagatgccgcatt

SEQ ID NO: 10850 - DNA, 20 bp, Artificial Sequence
  Target B2M Sequence complement
ggtttgaagatgccgcattt

SEQ ID NO: 10851 - DNA, 20 bp, Artificial Sequence
  Target B2M Sequence complement
gtttgaagatgccgcatttg

SEQ ID NO: 10852 - DNA, 20 bp, Artificial Sequence
  Target B2M Sequence complement
tttgaagatgccgcatttgg

SEQ ID NO: 10853 - DNA, 20 bp, Artificial Sequence
  Target B2M Sequence complement
ttgaagatgccgcatttgga

SEQ ID NO: 10854 - DNA, 20 bp, Artificial Sequence
  Target B2M Sequence complement
tgaagatgccgcatttggat

SEQ ID NO: 10855 - DNA, 20 bp, Artificial Sequence
  Target B2M Sequence complement
gaagatgccgcatttggatt

SEQ ID NO: 10856 - DNA, 20 bp, Artificial Sequence
  Target B2M Sequence complement
aagatgccgcatttggattg

SEQ ID NO: 10857 - DNA, 20 bp, Artificial Sequence
  Target B2M Sequence complement
agatgccgcatttggattgg

SEQ ID NO: 10858 - DNA, 20 bp, Artificial Sequence
  Target B2M Sequence complement
gatgccgcatttggattgga

SEQ ID NO: 10859 - DNA, 20 bp, Artificial Sequence
  Target B2M Sequence complement
atgccgcatttggattggat

SEQ ID NO: 10860 - DNA, 20 bp, Artificial Sequence
  Target B2M Sequence complement
tgccgcatttggattggatg

SEQ ID NO: 10861 - DNA, 20 bp, Artificial Sequence
  Target B2M Sequence complement
gccgcatttggattggatga

SEQ ID NO: 10862 - DNA, 20 bp, Artificial Sequence
  Target B2M Sequence complement
ccgcatttggattggatgaa

SEQ ID NO: 10863 - DNA, 20 bp, Artificial Sequence
  Target B2M Sequence complement
cgcatttggattggatgaat

SEQ ID NO: 10864 - DNA, 20 bp, Artificial Sequence
  Target B2M Sequence complement
gcatttggattggatgaatt

SEQ ID NO: 10865 - DNA, 20 bp, Artificial Sequence
  Target B2M Sequence complement
catttggattggatgaattc

SEQ ID NO: 10866 - DNA, 20 bp, Artificial Sequence
  Target B2M Sequence complement
atttggattggatgaattcc

SEQ ID NO: 10867 - DNA, 20 bp, Artificial Sequence
  Target B2M Sequence complement
tttggattggatgaattcca

SEQ ID NO: 10868 - DNA, 20 bp, Artificial Sequence
  Target B2M Sequence complement
ttggattggatgaattccaa

SEQ ID NO: 10869 - DNA, 20 bp, Artificial Sequence
  Target B2M Sequence complement
tggattggatgaattccaaa

SEQ ID NO: 10870 - DNA, 20 bp, Artificial Sequence
  Target B2M Sequence complement
ggattggatgaattccaaat

SEQ ID NO: 10871 - DNA, 20 bp, Artificial Sequence
  Target B2M Sequence complement
gattggatgaattccaaatt

SEQ ID NO: 10872 - DNA, 20 bp, Artificial Sequence
  Target B2M Sequence complement
attggatgaattccaaattc

SEQ ID NO: 10873 - DNA, 20 bp, Artificial Sequence
  Target B2M Sequence complement
ttggatgaattccaaattct

SEQ ID NO: 10874 - DNA, 20 bp, Artificial Sequence
  Target B2M Sequence complement
tggatgaattccaaattctg

SEQ ID NO: 10875 - DNA, 20 bp, Artificial Sequence
  Target B2M Sequence complement
ggatgaattccaaattctgc

SEQ ID NO: 10876 - DNA, 20 bp, Artificial Sequence
  Target B2M Sequence complement
gatgaattccaaattctgct

SEQ ID NO: 10877 - DNA, 20 bp, Artificial Sequence
  Target B2M Sequence complement
atgaattccaaattctgctt

SEQ ID NO: 10878 - DNA, 20 bp, Artificial Sequence
  Target B2M Sequence complement
tgaattccaaattctgcttg

SEQ ID NO: 10879 - DNA, 20 bp, Artificial Sequence
  Target B2M Sequence complement
gaattccaaattctgcttgc

SEQ ID NO: 10880 - DNA, 20 bp, Artificial Sequence
  Target B2M Sequence complement
aattccaaattctgcttgct

SEQ ID NO: 10881 - DNA, 20 bp, Artificial Sequence
  Target B2M Sequence complement
attccaaattctgcttgctt

SEQ ID NO: 10882 - DNA, 20 bp, Artificial Sequence
  Target B2M Sequence complement
ttccaaattctgcttgcttg

SEQ ID NO: 10883 - DNA, 20 bp, Artificial Sequence
  Target B2M Sequence complement
tccaaattctgcttgcttgc

SEQ ID NO: 10884 - DNA, 20 bp, Artificial Sequence
  Target B2M Sequence complement
ccaaattctgcttgcttgct

SEQ ID NO: 10885 - DNA, 20 bp, Artificial Sequence
  Target B2M Sequence complement
caaattctgcttgcttgctt

SEQ ID NO: 10886 - DNA, 20 bp, Artificial Sequence
  Target B2M Sequence complement
aaattctgcttgcttgcttt

SEQ ID NO: 10887 - DNA, 20 bp, Artificial Sequence
  Target B2M Sequence complement
atattgatatgcttatacac

SEQ ID NO: 10888 - DNA, 20 bp, Artificial Sequence
  Target B2M Sequence complement
tattgatatgcttatacact

SEQ ID NO: 10889 - DNA, 20 bp, Artificial Sequence
  Target B2M Sequence complement
attgatatgcttatacactt

SEQ ID NO: 10890 - DNA, 20 bp, Artificial Sequence
  Target B2M Sequence complement
ttgatatgcttatacactta

SEQ ID NO: 10891 - DNA, 20 bp, Artificial Sequence
  Target B2M Sequence complement
tgatatgcttatacacttac

SEQ ID NO: 10892 - DNA, 20 bp, Artificial Sequence
  Target B2M Sequence complement
gatatgcttatacacttaca

SEQ ID NO: 10893 - DNA, 20 bp, Artificial Sequence
  Target B2M Sequence complement
atatgcttatacacttacac

SEQ ID NO: 10894 - DNA, 20 bp, Artificial Sequence
  Target B2M Sequence complement
tatgcttatacacttacact

SEQ ID NO: 10895 - DNA, 20 bp, Artificial Sequence
  Target B2M Sequence complement
atgcttatacacttacactt

SEQ ID NO: 10896 - DNA, 20 bp, Artificial Sequence
  Target B2M Sequence complement
tgcttatacacttacacttt

SEQ ID NO: 10897 - DNA, 20 bp, Artificial Sequence
  Target B2M Sequence complement
gcttatacacttacacttta

SEQ ID NO: 10898 - DNA, 20 bp, Artificial Sequence
  Target B2M Sequence complement
cttatacacttacactttat

SEQ ID NO: 10899 - DNA, 20 bp, Artificial Sequence
  Target B2M Sequence complement
ttatacacttacactttatg

SEQ ID NO: 10900 - DNA, 20 bp, Artificial Sequence
  Target B2M Sequence complement
tatacacttacactttatgc

SEQ ID NO: 10901 - DNA, 20 bp, Artificial Sequence
  Target B2M Sequence complement
atacacttacactttatgca

SEQ ID NO: 10902 - DNA, 20 bp, Artificial Sequence
  Target B2M Sequence complement
tacacttacactttatgcac

SEQ ID NO: 10903 - DNA, 20 bp, Artificial Sequence
  Target B2M Sequence complement
acacttacactttatgcaca

SEQ ID NO: 10904 - DNA, 20 bp, Artificial Sequence
  Target B2M Sequence complement
cacttacactttatgcacaa

SEQ ID NO: 10905 - DNA, 20 bp, Artificial Sequence
  Target B2M Sequence complement
acttacactttatgcacaaa

SEQ ID NO: 10906 - DNA, 20 bp, Artificial Sequence
  Target B2M Sequence complement
aatgtagggttataataatg

SEQ ID NO: 10907 - DNA, 20 bp, Artificial Sequence
  Target B2M Sequence complement
atgtagggttataataatgt

SEQ ID NO: 10908 - DNA, 20 bp, Artificial Sequence
  Target B2M Sequence complement
tgtagggttataataatgtt

SEQ ID NO: 10909 - DNA, 20 bp, Artificial Sequence
  Target B2M Sequence complement
gtagggttataataatgtta

SEQ ID NO: 10910 - DNA, 20 bp, Artificial Sequence
  Target B2M Sequence complement
agggttataataatgttaac

SEQ ID NO: 10911 - DNA, 20 bp, Artificial Sequence
  Target B2M Sequence complement
gggttataataatgttaaca

SEQ ID NO: 10912 - DNA, 20 bp, Artificial Sequence
  Target B2M Sequence complement
ataataatgttaacatggac

SEQ ID NO: 10913 - DNA, 20 bp, Artificial Sequence
  Target B2M Sequence complement
taataatgttaacatggaca

SEQ ID NO: 10914 - DNA, 20 bp, Artificial Sequence
  Target B2M Sequence complement
aataatgttaacatggacat

SEQ ID NO: 10915 - DNA, 20 bp, Artificial Sequence
  Target B2M Sequence complement
ataatgttaacatggacatg

SEQ ID NO: 10916 - DNA, 20 bp, Artificial Sequence
  Target B2M Sequence complement
taatgttaacatggacatga

SEQ ID NO: 10917 - DNA, 20 bp, Artificial Sequence
  Target B2M Sequence complement
aatgttaacatggacatgat

SEQ ID NO: 10918 - DNA, 20 bp, Artificial Sequence
  Target B2M Sequence complement
atgttaacatggacatgatc

SEQ ID NO: 10919 - DNA, 20 bp, Artificial Sequence
  Target B2M Sequence complement
tgttaacatggacatgatct

SEQ ID NO: 10920 - DNA, 20 bp, Artificial Sequence
  Target B2M Sequence complement
gttaacatggacatgatctt

SEQ ID NO: 10921 - DNA, 20 bp, Artificial Sequence
  Target B2M Sequence complement
ttaacatggacatgatcttc

SEQ ID NO: 10922 - DNA, 20 bp, Artificial Sequence
  Target B2M Sequence complement
taacatggacatgatcttct

SEQ ID NO: 10923 - DNA, 20 bp, Artificial Sequence
  Target B2M Sequence complement
aacatggacatgatcttctt

SEQ ID NO: 10924 - DNA, 20 bp, Artificial Sequence
  Target B2M Sequence complement
acatggacatgatcttcttt

SEQ ID NO: 10925 - DNA, 20 bp, Artificial Sequence
  Target B2M Sequence complement
catggacatgatcttcttta

SEQ ID NO: 10926 - DNA, 20 bp, Artificial Sequence
  Target B2M Sequence complement
atggacatgatcttctttat

SEQ ID NO: 10927 - DNA, 20 bp, Artificial Sequence
  Target B2M Sequence complement
tggacatgatcttctttata

SEQ ID NO: 10928 - DNA, 20 bp, Artificial Sequence
  Target B2M Sequence complement
ggacatgatcttctttataa

SEQ ID NO: 10929 - DNA, 20 bp, Artificial Sequence
  Target B2M Sequence complement
gacatgatcttctttataat

SEQ ID NO: 10930 - DNA, 20 bp, Artificial Sequence
  Target B2M Sequence complement
catgatcttctttataattc

SEQ ID NO: 10931 - DNA, 20 bp, Artificial Sequence
  Target B2M Sequence complement
gatcttctttataattctac

SEQ ID NO: 10932 - DNA, 20 bp, Artificial Sequence
  Target B2M Sequence complement
ctttataattctactttgag

SEQ ID NO: 10933 - DNA, 20 bp, Artificial Sequence
  Target B2M Sequence complement
ttataattctactttgagtg

SEQ ID NO: 10934 - DNA, 20 bp, Artificial Sequence
  Target B2M Sequence complement
tataattctactttgagtgc

SEQ ID NO: 10935 - DNA, 20 bp, Artificial Sequence
  Target B2M Sequence complement
ataattctactttgagtgct

SEQ ID NO: 10936 - DNA, 20 bp, Artificial Sequence
  Target B2M Sequence complement
taattctactttgagtgctg

SEQ ID NO: 10937 - DNA, 20 bp, Artificial Sequence
  Target B2M Sequence complement
aattctactttgagtgctgt

SEQ ID NO: 10938 - DNA, 20 bp, Artificial Sequence
  Target B2M Sequence complement
attctactttgagtgctgtc

SEQ ID NO: 10939 - DNA, 20 bp, Artificial Sequence
  Target B2M Sequence complement
ttctactttgagtgctgtct

SEQ ID NO: 10940 - DNA, 20 bp, Artificial Sequence
  Target B2M Sequence complement
tctactttgagtgctgtctc

SEQ ID NO: 10941 - DNA, 20 bp, Artificial Sequence
  Target B2M Sequence complement
ctactttgagtgctgtctcc

SEQ ID NO: 10942 - DNA, 20 bp, Artificial Sequence
  Target B2M Sequence complement
tactttgagtgctgtctcca

SEQ ID NO: 10943 - DNA, 20 bp, Artificial Sequence
  Target B2M Sequence complement
actttgagtgctgtctccat

SEQ ID NO: 10944 - DNA, 20 bp, Artificial Sequence
  Target B2M Sequence complement
ctttgagtgctgtctccatg

SEQ ID NO: 10945 - DNA, 20 bp, Artificial Sequence
  Target B2M Sequence complement
tttgagtgctgtctccatgt

SEQ ID NO: 10946 - DNA, 20 bp, Artificial Sequence
  Target B2M Sequence complement
ttgagtgctgtctccatgtt

SEQ ID NO: 10947 - DNA, 20 bp, Artificial Sequence
  Target B2M Sequence complement
tgagtgctgtctccatgttt

SEQ ID NO: 10948 - DNA, 20 bp, Artificial Sequence
  Target B2M Sequence complement
gagtgctgtctccatgtttg

SEQ ID NO: 10949 - DNA, 20 bp, Artificial Sequence
  Target B2M Sequence complement
agtgctgtctccatgtttga

SEQ ID NO: 10950 - DNA, 20 bp, Artificial Sequence
  Target B2M Sequence complement
gtgctgtctccatgtttgat

SEQ ID NO: 10951 - DNA, 20 bp, Artificial Sequence
  Target B2M Sequence complement
tgctgtctccatgtttgatg

SEQ ID NO: 10952 - DNA, 20 bp, Artificial Sequence
  Target B2M Sequence complement
gctgtctccatgtttgatgt

SEQ ID NO: 10953 - DNA, 20 bp, Artificial Sequence
  Target B2M Sequence complement
ctgtctccatgtttgatgta

SEQ ID NO: 10954 - DNA, 20 bp, Artificial Sequence
  Target B2M Sequence complement
tgtctccatgtttgatgtat

SEQ ID NO: 10955 - DNA, 20 bp, Artificial Sequence
  Target B2M Sequence complement
gtctccatgtttgatgtatc

SEQ ID NO: 10956 - DNA, 20 bp, Artificial Sequence
  Target B2M Sequence complement
tctccatgtttgatgtatct

SEQ ID NO: 10957 - DNA, 20 bp, Artificial Sequence
  Target B2M Sequence complement
ctccatgtttgatgtatctg

SEQ ID NO: 10958 - DNA, 20 bp, Artificial Sequence
  Target B2M Sequence complement
tccatgtttgatgtatctga

SEQ ID NO: 10959 - DNA, 20 bp, Artificial Sequence
  Target B2M Sequence complement
ccatgtttgatgtatctgag

SEQ ID NO: 10960 - DNA, 20 bp, Artificial Sequence
  Target B2M Sequence complement
catgtttgatgtatctgagc

SEQ ID NO: 10961 - DNA, 20 bp, Artificial Sequence
  Target B2M Sequence complement
atgtttgatgtatctgagca

SEQ ID NO: 10962 - DNA, 20 bp, Artificial Sequence
  Target B2M Sequence complement
tgtttgatgtatctgagcag

SEQ ID NO: 10963 - DNA, 20 bp, Artificial Sequence
  Target B2M Sequence complement
gtttgatgtatctgagcagg

SEQ ID NO: 10964 - DNA, 20 bp, Artificial Sequence
  Target B2M Sequence complement
tttgatgtatctgagcaggt

SEQ ID NO: 10965 - DNA, 20 bp, Artificial Sequence
  Target B2M Sequence complement
ttgatgtatctgagcaggtt

SEQ ID NO: 10966 - DNA, 20 bp, Artificial Sequence
  Target B2M Sequence complement
tgatgtatctgagcaggttg

SEQ ID NO: 10967 - DNA, 20 bp, Artificial Sequence
  Target B2M Sequence complement
gatgtatctgagcaggttgc

SEQ ID NO: 10968 - DNA, 20 bp, Artificial Sequence
  Target B2M Sequence complement
atgtatctgagcaggttgct

SEQ ID NO: 10969 - DNA, 20 bp, Artificial Sequence
  Target B2M Sequence complement
tgtatctgagcaggttgctc

SEQ ID NO: 10970 - DNA, 20 bp, Artificial Sequence
  Target B2M Sequence complement
gtatctgagcaggttgctcc

SEQ ID NO: 10971 - DNA, 20 bp, Artificial Sequence
  Target B2M Sequence complement
tatctgagcaggttgctcca

SEQ ID NO: 10972 - DNA, 20 bp, Artificial Sequence
  Target B2M Sequence complement
atctgagcaggttgctccac

SEQ ID NO: 10973 - DNA, 20 bp, Artificial Sequence
  Target B2M Sequence complement
tctgagcaggttgctccaca

SEQ ID NO: 10974 - DNA, 20 bp, Artificial Sequence
  Target B2M Sequence complement
agcaggttgctccacaggta

SEQ ID NO: 10975 - DNA, 20 bp, Artificial Sequence
  Target B2M Sequence complement
aggttgctccacaggtagct

SEQ ID NO: 10976 - DNA, 20 bp, Artificial Sequence
  Target B2M Sequence complement
gttgctccacaggtagctct

SEQ ID NO: 10977 - DNA, 20 bp, Artificial Sequence
  Target B2M Sequence complement
ttgctccacaggtagctcta

SEQ ID NO: 10978 - DNA, 20 bp, Artificial Sequence
  Target B2M Sequence complement
tgctccacaggtagctctag

SEQ ID NO: 10979 - DNA, 20 bp, Artificial Sequence
  Target B2M Sequence complement
ctccacaggtagctctagga

SEQ ID NO: 10980 - DNA, 20 bp, Artificial Sequence
  Target B2M Sequence complement
tccacaggtagctctaggag

SEQ ID NO: 10981 - DNA, 20 bp, Artificial Sequence
  Target B2M Sequence complement
tctaggagggctggcaactt

SEQ ID NO: 10982 - DNA, 20 bp, Artificial Sequence
  Target B2M Sequence complement
ctaggagggctggcaactta

SEQ ID NO: 10983 - DNA, 20 bp, Artificial Sequence
  Target B2M Sequence complement
taggagggctggcaacttag

SEQ ID NO: 10984 - DNA, 20 bp, Artificial Sequence
  Target B2M Sequence complement
aggagggctggcaacttaga

SEQ ID NO: 10985 - DNA, 20 bp, Artificial Sequence
  Target B2M Sequence complement
agggctggcaacttagaggt

SEQ ID NO: 10986 - DNA, 20 bp, Artificial Sequence
  Target B2M Sequence complement
gggagcagagaattctctta

SEQ ID NO: 10987 - DNA, 20 bp, Artificial Sequence
  Target B2M Sequence complement
ggagcagagaattctcttat

SEQ ID NO: 10988 - DNA, 20 bp, Artificial Sequence
  Target B2M Sequence complement
gagcagagaattctcttatc

SEQ ID NO: 10989 - DNA, 20 bp, Artificial Sequence
  Target B2M Sequence complement
agcagagaattctcttatcc

SEQ ID NO: 10990 - DNA, 20 bp, Artificial Sequence
  Target B2M Sequence complement
gcagagaattctcttatcca

SEQ ID NO: 10991 - DNA, 20 bp, Artificial Sequence
  Target B2M Sequence complement
cagagaattctcttatccaa

SEQ ID NO: 10992 - DNA, 20 bp, Artificial Sequence
  Target B2M Sequence complement
agagaattctcttatccaac

SEQ ID NO: 10993 - DNA, 20 bp, Artificial Sequence
  Target B2M Sequence complement
gagaattctcttatccaaca

SEQ ID NO: 10994 - DNA, 20 bp, Artificial Sequence
  Target B2M Sequence complement
agaattctcttatccaacat

SEQ ID NO: 10995 - DNA, 20 bp, Artificial Sequence
  Target B2M Sequence complement
gaattctcttatccaacatc

SEQ ID NO: 10996 - DNA, 20 bp, Artificial Sequence
  Target B2M Sequence complement
aattctcttatccaacatca

SEQ ID NO: 10997 - DNA, 20 bp, Artificial Sequence
  Target B2M Sequence complement
attctcttatccaacatcaa

SEQ ID NO: 10998 - DNA, 20 bp, Artificial Sequence
  Target B2M Sequence complement
ttctcttatccaacatcaac

SEQ ID NO: 10999 - DNA, 20 bp, Artificial Sequence
  Target B2M Sequence complement
tctcttatccaacatcaaca

SEQ ID NO: 11000 - DNA, 20 bp, Artificial Sequence
  Target B2M Sequence complement
ctcttatccaacatcaacat

SEQ ID NO: 11001 - DNA, 20 bp, Artificial Sequence
  Target B2M Sequence complement
tcttatccaacatcaacatc

SEQ ID NO: 11002 - DNA, 20 bp, Artificial Sequence
  Target B2M Sequence complement
cttatccaacatcaacatct

SEQ ID NO: 11003 - DNA, 20 bp, Artificial Sequence
  Target B2M Sequence complement
ttatccaacatcaacatctt

SEQ ID NO: 11004 - DNA, 20 bp, Artificial Sequence
  Target B2M Sequence complement
tatccaacatcaacatcttg

SEQ ID NO: 11005 - DNA, 20 bp, Artificial Sequence
  Target B2M Sequence complement
atccaacatcaacatcttgg

SEQ ID NO: 11006 - DNA, 20 bp, Artificial Sequence
  Target B2M Sequence complement
tccaacatcaacatcttggt

SEQ ID NO: 11007 - DNA, 20 bp, Artificial Sequence
  Target B2M Sequence complement
ccaacatcaacatcttggtc

SEQ ID NO: 11008 - DNA, 20 bp, Artificial Sequence
  Target B2M Sequence complement
caacatcaacatcttggtca

SEQ ID NO: 11009 - DNA, 20 bp, Artificial Sequence
  Target B2M Sequence complement
aacatcaacatcttggtcag

SEQ ID NO: 11010 - DNA, 20 bp, Artificial Sequence
  Target B2M Sequence complement
acatcaacatcttggtcaga

SEQ ID NO: 11011 - DNA, 20 bp, Artificial Sequence
  Target B2M Sequence complement
catcaacatcttggtcagat

SEQ ID NO: 11012 - DNA, 20 bp, Artificial Sequence
  Target B2M Sequence complement
atcaacatcttggtcagatt

SEQ ID NO: 11013 - DNA, 20 bp, Artificial Sequence
  Target B2M Sequence complement
tcaacatcttggtcagattt

SEQ ID NO: 11014 - DNA, 20 bp, Artificial Sequence
  Target B2M Sequence complement
caacatcttggtcagatttg

SEQ ID NO: 11015 - DNA, 20 bp, Artificial Sequence
  Target B2M Sequence complement
aacatcttggtcagatttga

SEQ ID NO: 11016 - DNA, 20 bp, Artificial Sequence
  Target B2M Sequence complement
acatcttggtcagatttgaa

SEQ ID NO: 11017 - DNA, 20 bp, Artificial Sequence
  Target B2M Sequence complement
catcttggtcagatttgaac

SEQ ID NO: 11018 - DNA, 20 bp, Artificial Sequence
  Target B2M Sequence complement
atcttggtcagatttgaact

SEQ ID NO: 11019 - DNA, 20 bp, Artificial Sequence
  Target B2M Sequence complement
tcttggtcagatttgaactc

SEQ ID NO: 11020 - DNA, 20 bp, Artificial Sequence
  Target B2M Sequence complement
cttggtcagatttgaactct

SEQ ID NO: 11021 - DNA, 20 bp, Artificial Sequence
  Target B2M Sequence complement
ttggtcagatttgaactctt

SEQ ID NO: 11022 - DNA, 20 bp, Artificial Sequence
  Target B2M Sequence complement
tggtcagatttgaactcttc

SEQ ID NO: 11023 - DNA, 20 bp, Artificial Sequence
  Target B2M Sequence complement
ggtcagatttgaactcttca

SEQ ID NO: 11024 - DNA, 20 bp, Artificial Sequence
  Target B2M Sequence complement
gtcagatttgaactcttcaa

SEQ ID NO: 11025 - DNA, 20 bp, Artificial Sequence
  Target B2M Sequence complement
tcagatttgaactcttcaat

SEQ ID NO: 11026 - DNA, 20 bp, Artificial Sequence
  Target B2M Sequence complement
cagatttgaactcttcaatc

SEQ ID NO: 11027 - DNA, 20 bp, Artificial Sequence
  Target B2M Sequence complement
agatttgaactcttcaatct

SEQ ID NO: 11028 - DNA, 20 bp, Artificial Sequence
  Target B2M Sequence complement
gatttgaactcttcaatctc

SEQ ID NO: 11029 - DNA, 20 bp, Artificial Sequence
  Target B2M Sequence complement
atttgaactcttcaatctct

SEQ ID NO: 11030 - DNA, 20 bp, Artificial Sequence
  Target B2M Sequence complement
tttgaactcttcaatctctt

SEQ ID NO: 11031 - DNA, 20 bp, Artificial Sequence
  Target B2M Sequence complement
ttgaactcttcaatctcttg

SEQ ID NO: 11032 - DNA, 20 bp, Artificial Sequence
  Target B2M Sequence complement
tgaactcttcaatctcttgc

SEQ ID NO: 11033 - DNA, 20 bp, Artificial Sequence
  Target B2M Sequence complement
gaactcttcaatctcttgca

SEQ ID NO: 11034 - DNA, 20 bp, Artificial Sequence
  Target B2M Sequence complement
aactcttcaatctcttgcac

SEQ ID NO: 11035 - DNA, 20 bp, Artificial Sequence
  Target B2M Sequence complement
actcttcaatctcttgcact

SEQ ID NO: 11036 - DNA, 20 bp, Artificial Sequence
  Target B2M Sequence complement
ctcttcaatctcttgcactc

SEQ ID NO: 11037 - DNA, 20 bp, Artificial Sequence
  Target B2M Sequence complement
tcttcaatctcttgcactca

SEQ ID NO: 11038 - DNA, 20 bp, Artificial Sequence
  Target B2M Sequence complement
cttcaatctcttgcactcaa

SEQ ID NO: 11039 - DNA, 20 bp, Artificial Sequence
  Target B2M Sequence complement
ttcaatctcttgcactcaaa

SEQ ID NO: 11040 - DNA, 20 bp, Artificial Sequence
  Target B2M Sequence complement
tcaatctcttgcactcaaag

SEQ ID NO: 11041 - DNA, 20 bp, Artificial Sequence
  Target B2M Sequence complement
caatctcttgcactcaaagc

SEQ ID NO: 11042 - DNA, 20 bp, Artificial Sequence
  Target B2M Sequence complement
aatctcttgcactcaaagct

SEQ ID NO: 11043 - DNA, 20 bp, Artificial Sequence
  Target B2M Sequence complement
atctcttgcactcaaagctt

SEQ ID NO: 11044 - DNA, 20 bp, Artificial Sequence
  Target B2M Sequence complement
tctcttgcactcaaagcttg

SEQ ID NO: 11045 - DNA, 20 bp, Artificial Sequence
  Target B2M Sequence complement
ctcttgcactcaaagcttgt

SEQ ID NO: 11046 - DNA, 20 bp, Artificial Sequence
  Target B2M Sequence complement
tcttgcactcaaagcttgtt

SEQ ID NO: 11047 - DNA, 20 bp, Artificial Sequence
  Target B2M Sequence complement
cttgcactcaaagcttgtta

SEQ ID NO: 11048 - DNA, 20 bp, Artificial Sequence
  Target B2M Sequence complement
ttgcactcaaagcttgttaa

SEQ ID NO: 11049 - DNA, 20 bp, Artificial Sequence
  Target B2M Sequence complement
tgcactcaaagcttgttaag

SEQ ID NO: 11050 - DNA, 20 bp, Artificial Sequence
  Target B2M Sequence complement
gcactcaaagcttgttaaga

SEQ ID NO: 11051 - DNA, 20 bp, Artificial Sequence
  Target B2M Sequence complement
cactcaaagcttgttaagat

SEQ ID NO: 11052 - DNA, 20 bp, Artificial Sequence
  Target B2M Sequence complement
actcaaagcttgttaagata

SEQ ID NO: 11053 - DNA, 20 bp, Artificial Sequence
  Target B2M Sequence complement
ctcaaagcttgttaagatag

SEQ ID NO: 11054 - DNA, 20 bp, Artificial Sequence
  Target B2M Sequence complement
tcaaagcttgttaagatagt

SEQ ID NO: 11055 - DNA, 20 bp, Artificial Sequence
  Target B2M Sequence complement
caaagcttgttaagatagtt

SEQ ID NO: 11056 - DNA, 20 bp, Artificial Sequence
  Target B2M Sequence complement
aaagcttgttaagatagtta

SEQ ID NO: 11057 - DNA, 20 bp, Artificial Sequence
  Target B2M Sequence complement
aagcttgttaagatagttaa

SEQ ID NO: 11058 - DNA, 20 bp, Artificial Sequence
  Target B2M Sequence complement
agcttgttaagatagttaag

SEQ ID NO: 11059 - DNA, 20 bp, Artificial Sequence
  Target B2M Sequence complement
gcttgttaagatagttaagc

SEQ ID NO: 11060 - DNA, 20 bp, Artificial Sequence
  Target B2M Sequence complement
cttgttaagatagttaagcg

SEQ ID NO: 11061 - DNA, 20 bp, Artificial Sequence
  Target B2M Sequence complement
ttgttaagatagttaagcgt

SEQ ID NO: 11062 - DNA, 20 bp, Artificial Sequence
  Target B2M Sequence complement
tgttaagatagttaagcgtg

SEQ ID NO: 11063 - DNA, 20 bp, Artificial Sequence
  Target B2M Sequence complement
gttaagatagttaagcgtgc

SEQ ID NO: 11064 - DNA, 20 bp, Artificial Sequence
  Target B2M Sequence complement
ttaagatagttaagcgtgca

SEQ ID NO: 11065 - DNA, 20 bp, Artificial Sequence
  Target B2M Sequence complement
taagatagttaagcgtgcat

SEQ ID NO: 11066 - DNA, 20 bp, Artificial Sequence
  Target B2M Sequence complement
aagatagttaagcgtgcata

SEQ ID NO: 11067 - DNA, 20 bp, Artificial Sequence
  Target B2M Sequence complement
agatagttaagcgtgcataa

SEQ ID NO: 11068 - DNA, 20 bp, Artificial Sequence
  Target B2M Sequence complement
gatagttaagcgtgcataag

SEQ ID NO: 11069 - DNA, 20 bp, Artificial Sequence
  Target B2M Sequence complement
atagttaagcgtgcataagt

SEQ ID NO: 11070 - DNA, 20 bp, Artificial Sequence
  Target B2M Sequence complement
tagttaagcgtgcataagtt

SEQ ID NO: 11071 - DNA, 20 bp, Artificial Sequence
  Target B2M Sequence complement
agttaagcgtgcataagtta

SEQ ID NO: 11072 - DNA, 20 bp, Artificial Sequence
  Target B2M Sequence complement
gttaagcgtgcataagttaa

SEQ ID NO: 11073 - DNA, 20 bp, Artificial Sequence
  Target B2M Sequence complement
ttaagcgtgcataagttaac

SEQ ID NO: 11074 - DNA, 20 bp, Artificial Sequence
  Target B2M Sequence complement
taagcgtgcataagttaact

SEQ ID NO: 11075 - DNA, 20 bp, Artificial Sequence
  Target B2M Sequence complement
aagcgtgcataagttaactt

SEQ ID NO: 11076 - DNA, 20 bp, Artificial Sequence
  Target B2M Sequence complement
agcgtgcataagttaacttc

SEQ ID NO: 11077 - DNA, 20 bp, Artificial Sequence
  Target B2M Sequence complement
gcgtgcataagttaacttcc

SEQ ID NO: 11078 - DNA, 20 bp, Artificial Sequence
  Target B2M Sequence complement
cgtgcataagttaacttcca

SEQ ID NO: 11079 - DNA, 20 bp, Artificial Sequence
  Target B2M Sequence complement
gtgcataagttaacttccaa

SEQ ID NO: 11080 - DNA, 20 bp, Artificial Sequence
  Target B2M Sequence complement
tgcataagttaacttccaat

SEQ ID NO: 11081 - DNA, 20 bp, Artificial Sequence
  Target B2M Sequence complement
gcataagttaacttccaatt

SEQ ID NO: 11082 - DNA, 20 bp, Artificial Sequence
  Target B2M Sequence complement
cataagttaacttccaattt

SEQ ID NO: 11083 - DNA, 20 bp, Artificial Sequence
  Target B2M Sequence complement
taagttaacttccaatttac

SEQ ID NO: 11084 - DNA, 20 bp, Artificial Sequence
  Target B2M Sequence complement
aagttaacttccaatttaca

SEQ ID NO: 11085 - DNA, 20 bp, Artificial Sequence
  Target B2M Sequence complement
agttaacttccaatttacat

SEQ ID NO: 11086 - DNA, 20 bp, Artificial Sequence
  Target B2M Sequence complement
gttaacttccaatttacata

SEQ ID NO: 11087 - DNA, 20 bp, Artificial Sequence
  Target B2M Sequence complement
ttaacttccaatttacatac

SEQ ID NO: 11088 - DNA, 20 bp, Artificial Sequence
  Target B2M Sequence complement
taacttccaatttacatact

SEQ ID NO: 11089 - DNA, 20 bp, Artificial Sequence
  Target B2M Sequence complement
aacttccaatttacatactc

SEQ ID NO: 11090 - DNA, 20 bp, Artificial Sequence
  Target B2M Sequence complement
acttccaatttacatactct

SEQ ID NO: 11091 - DNA, 20 bp, Artificial Sequence
  Target B2M Sequence complement
cttccaatttacatactctg

SEQ ID NO: 11092 - DNA, 20 bp, Artificial Sequence
  Target B2M Sequence complement
ttccaatttacatactctgc

SEQ ID NO: 11093 - DNA, 20 bp, Artificial Sequence
  Target B2M Sequence complement
tccaatttacatactctgct

SEQ ID NO: 11094 - DNA, 20 bp, Artificial Sequence
  Target B2M Sequence complement
ccaatttacatactctgctt

SEQ ID NO: 11095 - DNA, 20 bp, Artificial Sequence
  Target B2M Sequence complement
caatttacatactctgctta

SEQ ID NO: 11096 - DNA, 20 bp, Artificial Sequence
  Target B2M Sequence complement
aatttacatactctgcttag

SEQ ID NO: 11097 - DNA, 20 bp, Artificial Sequence
  Target B2M Sequence complement
atttacatactctgcttaga

SEQ ID NO: 11098 - DNA, 20 bp, Artificial Sequence
  Target B2M Sequence complement
tttacatactctgcttagaa

SEQ ID NO: 11099 - DNA, 20 bp, Artificial Sequence
  Target B2M Sequence complement
ttacatactctgcttagaat

SEQ ID NO: 11100 - DNA, 20 bp, Artificial Sequence
  Target B2M Sequence complement
tacatactctgcttagaatt

SEQ ID NO: 11101 - DNA, 20 bp, Artificial Sequence
  Target B2M Sequence complement
acatactctgcttagaattt

SEQ ID NO: 11102 - DNA, 20 bp, Artificial Sequence
  Target B2M Sequence complement
catactctgcttagaatttg

SEQ ID NO: 11103 - DNA, 20 bp, Artificial Sequence
  Target B2M Sequence complement
atactctgcttagaatttgg

SEQ ID NO: 11104 - DNA, 20 bp, Artificial Sequence
  Target B2M Sequence complement
tactctgcttagaatttggg

SEQ ID NO: 11105 - DNA, 20 bp, Artificial Sequence
  Target B2M Sequence complement
ttagaaatataattgacagg

SEQ ID NO: 11106 - DNA, 20 bp, Artificial Sequence
  Target B2M Sequence complement
tagaaatataattgacagga

SEQ ID NO: 11107 - DNA, 20 bp, Artificial Sequence
  Target B2M Sequence complement
agaaatataattgacaggat

SEQ ID NO: 11108 - DNA, 20 bp, Artificial Sequence
  Target B2M Sequence complement
gaaatataattgacaggatt

SEQ ID NO: 11109 - DNA, 20 bp, Artificial Sequence
  Target B2M Sequence complement
tataattgacaggattattg

SEQ ID NO: 11110 - DNA, 20 bp, Artificial Sequence
  Target B2M Sequence complement
ataattgacaggattattgg

SEQ ID NO: 11111 - DNA, 20 bp, Artificial Sequence
  Target B2M Sequence complement
taattgacaggattattgga

SEQ ID NO: 11112 - DNA, 20 bp, Artificial Sequence
  Target B2M Sequence complement
aattgacaggattattggaa

SEQ ID NO: 11113 - DNA, 20 bp, Artificial Sequence
  Target B2M Sequence complement
attgacaggattattggaaa

SEQ ID NO: 11114 - DNA, 20 bp, Artificial Sequence
  Target B2M Sequence complement
ttgacaggattattggaaat

SEQ ID NO: 11115 - DNA, 20 bp, Artificial Sequence
  Target B2M Sequence complement
tgacaggattattggaaatt

SEQ ID NO: 11116 - DNA, 20 bp, Artificial Sequence
  Target B2M Sequence complement
gacaggattattggaaattt

SEQ ID NO: 11117 - DNA, 20 bp, Artificial Sequence
  Target B2M Sequence complement
acaggattattggaaatttg

SEQ ID NO: 11118 - DNA, 20 bp, Artificial Sequence
  Target B2M Sequence complement
caggattattggaaatttgt

SEQ ID NO: 11119 - DNA, 20 bp, Artificial Sequence
  Target B2M Sequence complement
aggattattggaaatttgtt

SEQ ID NO: 11120 - DNA, 20 bp, Artificial Sequence
  Target B2M Sequence complement
ggattattggaaatttgtta

SEQ ID NO: 11121 - DNA, 20 bp, Artificial Sequence
  Target B2M Sequence complement
atacatttgataaagtaagg

SEQ ID NO: 11122 - DNA, 20 bp, Artificial Sequence
  Target B2M Sequence complement
tacatttgataaagtaaggc

SEQ ID NO: 11123 - DNA, 20 bp, Artificial Sequence
  Target B2M Sequence complement
acatttgataaagtaaggca

SEQ ID NO: 11124 - DNA, 20 bp, Artificial Sequence
  Target B2M Sequence complement
catttgataaagtaaggcat

SEQ ID NO: 11125 - DNA, 20 bp, Artificial Sequence
  Target B2M Sequence complement
atttgataaagtaaggcatg

SEQ ID NO: 11126 - DNA, 20 bp, Artificial Sequence
  Target B2M Sequence complement
tttgataaagtaaggcatgg

SEQ ID NO: 11127 - DNA, 20 bp, Artificial Sequence
  Target B2M Sequence complement
ttgataaagtaaggcatggt

SEQ ID NO: 11128 - DNA, 20 bp, Artificial Sequence
  Target B2M Sequence complement
tgataaagtaaggcatggtt

SEQ ID NO: 11129 - DNA, 20 bp, Artificial Sequence
  Target B2M Sequence complement
gataaagtaaggcatggttg

SEQ ID NO: 11130 - DNA, 20 bp, Artificial Sequence
  Target B2M Sequence complement
ataaagtaaggcatggttgt

SEQ ID NO: 11131 - DNA, 20 bp, Artificial Sequence
  Target B2M Sequence complement
taaagtaaggcatggttgtg

SEQ ID NO: 11132 - DNA, 20 bp, Artificial Sequence
  Target B2M Sequence complement
aaagtaaggcatggttgtgg

SEQ ID NO: 11133 - DNA, 20 bp, Artificial Sequence
  Target B2M Sequence complement
aagtaaggcatggttgtggt

SEQ ID NO: 11134 - DNA, 20 bp, Artificial Sequence
  Target B2M Sequence complement
agtaaggcatggttgtggtt

SEQ ID NO: 11135 - DNA, 20 bp, Artificial Sequence
  Target B2M Sequence complement
gtaaggcatggttgtggtta

SEQ ID NO: 11136 - DNA, 20 bp, Artificial Sequence
  Target B2M Sequence complement
taaggcatggttgtggttaa

SEQ ID NO: 11137 - DNA, 20 bp, Artificial Sequence
  Target B2M Sequence complement
aaggcatggttgtggttaat

SEQ ID NO: 11138 - DNA, 20 bp, Artificial Sequence
  Target B2M Sequence complement
aggcatggttgtggttaatc

SEQ ID NO: 11139 - DNA, 20 bp, Artificial Sequence
  Target B2M Sequence complement
ggcatggttgtggttaatct

SEQ ID NO: 11140 - DNA, 20 bp, Artificial Sequence
  Target B2M Sequence complement
gcatggttgtggttaatctg

SEQ ID NO: 11141 - DNA, 20 bp, Artificial Sequence
  Target B2M Sequence complement
catggttgtggttaatctgg

SEQ ID NO: 11142 - DNA, 20 bp, Artificial Sequence
  Target B2M Sequence complement
atggttgtggttaatctggt

SEQ ID NO: 11143 - DNA, 20 bp, Artificial Sequence
  Target B2M Sequence complement
tggttgtggttaatctggtt

SEQ ID NO: 11144 - DNA, 20 bp, Artificial Sequence
  Target B2M Sequence complement
ggttgtggttaatctggttt

SEQ ID NO: 11145 - DNA, 20 bp, Artificial Sequence
  Target B2M Sequence complement
gttgtggttaatctggttta

SEQ ID NO: 11146 - DNA, 20 bp, Artificial Sequence
  Target B2M Sequence complement
ttgtggttaatctggtttat

SEQ ID NO: 11147 - DNA, 20 bp, Artificial Sequence
  Target B2M Sequence complement
tgtggttaatctggtttatt

SEQ ID NO: 11148 - DNA, 20 bp, Artificial Sequence
  Target B2M Sequence complement
gtggttaatctggtttattt

SEQ ID NO: 11149 - DNA, 20 bp, Artificial Sequence
  Target B2M Sequence complement
tttgttccacaagttaaata

SEQ ID NO: 11150 - DNA, 20 bp, Artificial Sequence
  Target B2M Sequence complement
ttgttccacaagttaaataa

SEQ ID NO: 11151 - DNA, 20 bp, Artificial Sequence
  Target B2M Sequence complement
tgttccacaagttaaataaa

SEQ ID NO: 11152 - DNA, 20 bp, Artificial Sequence
  Target B2M Sequence complement
gttccacaagttaaataaat

SEQ ID NO: 11153 - DNA, 20 bp, Artificial Sequence
  Target B2M Sequence complement
ttccacaagttaaataaatc

SEQ ID NO: 11154 - DNA, 20 bp, Artificial Sequence
  Target B2M Sequence complement
tccacaagttaaataaatca

SEQ ID NO: 11155 - DNA, 20 bp, Artificial Sequence
  Target B2M Sequence complement
ccacaagttaaataaatcat

SEQ ID NO: 11156 - DNA, 22 bp, Artificial Sequence
  Target B2M Sequence complement
attcctgaagctgacagcattc

SEQ ID NO: 11157 - DNA, 22 bp, Artificial Sequence
  Target B2M Sequence complement
ttcctgaagctgacagcattcg

SEQ ID NO: 11158 - DNA, 22 bp, Artificial Sequence
  Target B2M Sequence complement
tcctgaagctgacagcattcgg

SEQ ID NO: 11159 - DNA, 22 bp, Artificial Sequence
  Target B2M Sequence complement
cctgaagctgacagcattcggg

SEQ ID NO: 11160 - DNA, 22 bp, Artificial Sequence
  Target B2M Sequence complement
ctgaagctgacagcattcgggc

SEQ ID NO: 11161 - DNA, 22 bp, Artificial Sequence
  Target B2M Sequence complement
tgaagctgacagcattcgggcc

SEQ ID NO: 11162 - DNA, 22 bp, Artificial Sequence
  Target B2M Sequence complement
agatgtctcgctccgtggcctt

SEQ ID NO: 11163 - DNA, 22 bp, Artificial Sequence
  Target B2M Sequence complement
gatgtctcgctccgtggcctta

SEQ ID NO: 11164 - DNA, 22 bp, Artificial Sequence
  Target B2M Sequence complement
atgtctcgctccgtggccttag

SEQ ID NO: 11165 - DNA, 22 bp, Artificial Sequence
  Target B2M Sequence complement
ccttagctgtgctcgcgctact

SEQ ID NO: 11166 - DNA, 22 bp, Artificial Sequence
  Target B2M Sequence complement
cttagctgtgctcgcgctactc

SEQ ID NO: 11167 - DNA, 22 bp, Artificial Sequence
  Target B2M Sequence complement
ttagctgtgctcgcgctactct

SEQ ID NO: 11168 - DNA, 22 bp, Artificial Sequence
  Target B2M Sequence complement
tagctgtgctcgcgctactctc

SEQ ID NO: 11169 - DNA, 22 bp, Artificial Sequence
  Target B2M Sequence complement
agctgtgctcgcgctactctct

SEQ ID NO: 11170 - DNA, 22 bp, Artificial Sequence
  Target B2M Sequence complement
ctgtgctcgcgctactctctct

SEQ ID NO: 11171 - DNA, 22 bp, Artificial Sequence
  Target B2M Sequence complement
tgtgctcgcgctactctctctt

SEQ ID NO: 11172 - DNA, 22 bp, Artificial Sequence
  Target B2M Sequence complement
gtgctcgcgctactctctcttt

SEQ ID NO: 11173 - DNA, 22 bp, Artificial Sequence
  Target B2M Sequence complement
tgctcgcgctactctctctttc

SEQ ID NO: 11174 - DNA, 22 bp, Artificial Sequence
  Target B2M Sequence complement
gctcgcgctactctctctttct

SEQ ID NO: 11175 - DNA, 22 bp, Artificial Sequence
  Target B2M Sequence complement
ctcgcgctactctctctttctg

SEQ ID NO: 11176 - DNA, 22 bp, Artificial Sequence
  Target B2M Sequence complement
tcgcgctactctctctttctgg

SEQ ID NO: 11177 - DNA, 22 bp, Artificial Sequence
  Target B2M Sequence complement
cgcgctactctctctttctggc

SEQ ID NO: 11178 - DNA, 22 bp, Artificial Sequence
  Target B2M Sequence complement
gcgctactctctctttctggcc

SEQ ID NO: 11179 - DNA, 22 bp, Artificial Sequence
  Target B2M Sequence complement
cgctactctctctttctggcct

SEQ ID NO: 11180 - DNA, 22 bp, Artificial Sequence
  Target B2M Sequence complement
gctactctctctttctggcctg

SEQ ID NO: 11181 - DNA, 22 bp, Artificial Sequence
  Target B2M Sequence complement
ctactctctctttctggcctgg

SEQ ID NO: 11182 - DNA, 22 bp, Artificial Sequence
  Target B2M Sequence complement
tactctctctttctggcctgga

SEQ ID NO: 11183 - DNA, 22 bp, Artificial Sequence
  Target B2M Sequence complement
actctctctttctggcctggag

SEQ ID NO: 11184 - DNA, 22 bp, Artificial Sequence
  Target B2M Sequence complement
ctctctctttctggcctggagg

SEQ ID NO: 11185 - DNA, 22 bp, Artificial Sequence
  Target B2M Sequence complement
tctctctttctggcctggaggc

SEQ ID NO: 11186 - DNA, 22 bp, Artificial Sequence
  Target B2M Sequence complement
ctctctttctggcctggaggct

SEQ ID NO: 11187 - DNA, 22 bp, Artificial Sequence
  Target B2M Sequence complement
tctctttctggcctggaggcta

SEQ ID NO: 11188 - DNA, 22 bp, Artificial Sequence
  Target B2M Sequence complement
ctctttctggcctggaggctat

SEQ ID NO: 11189 - DNA, 22 bp, Artificial Sequence
  Target B2M Sequence complement
tctttctggcctggaggctatc

SEQ ID NO: 11190 - DNA, 22 bp, Artificial Sequence
  Target B2M Sequence complement
ctttctggcctggaggctatcc

SEQ ID NO: 11191 - DNA, 22 bp, Artificial Sequence
  Target B2M Sequence complement
tttctggcctggaggctatcca

SEQ ID NO: 11192 - DNA, 22 bp, Artificial Sequence
  Target B2M Sequence complement
ttctggcctggaggctatccag

SEQ ID NO: 11193 - DNA, 22 bp, Artificial Sequence
  Target B2M Sequence complement
cctggaggctatccagcgtact

SEQ ID NO: 11194 - DNA, 22 bp, Artificial Sequence
  Target B2M Sequence complement
ctggaggctatccagcgtactc

SEQ ID NO: 11195 - DNA, 22 bp, Artificial Sequence
  Target B2M Sequence complement
tggaggctatccagcgtactcc

SEQ ID NO: 11196 - DNA, 22 bp, Artificial Sequence
  Target B2M Sequence complement
ggaggctatccagcgtactcca

SEQ ID NO: 11197 - DNA, 22 bp, Artificial Sequence
  Target B2M Sequence complement
gaggctatccagcgtactccaa

SEQ ID NO: 11198 - DNA, 22 bp, Artificial Sequence
  Target B2M Sequence complement
aggctatccagcgtactccaaa

SEQ ID NO: 11199 - DNA, 22 bp, Artificial Sequence
  Target B2M Sequence complement
ggctatccagcgtactccaaag

SEQ ID NO: 11200 - DNA, 22 bp, Artificial Sequence
  Target B2M Sequence complement
gctatccagcgtactccaaaga

SEQ ID NO: 11201 - DNA, 22 bp, Artificial Sequence
  Target B2M Sequence complement
ctatccagcgtactccaaagat

SEQ ID NO: 11202 - DNA, 22 bp, Artificial Sequence
  Target B2M Sequence complement
tatccagcgtactccaaagatt

SEQ ID NO: 11203 - DNA, 22 bp, Artificial Sequence
  Target B2M Sequence complement
atccagcgtactccaaagattc

SEQ ID NO: 11204 - DNA, 22 bp, Artificial Sequence
  Target B2M Sequence complement
tccagcgtactccaaagattca

SEQ ID NO: 11205 - DNA, 22 bp, Artificial Sequence
  Target B2M Sequence complement
ccagcgtactccaaagattcag

SEQ ID NO: 11206 - DNA, 22 bp, Artificial Sequence
  Target B2M Sequence complement
cagcgtactccaaagattcagg

SEQ ID NO: 11207 - DNA, 22 bp, Artificial Sequence
  Target B2M Sequence complement
agcgtactccaaagattcaggt

SEQ ID NO: 11208 - DNA, 22 bp, Artificial Sequence
  Target B2M Sequence complement
gcgtactccaaagattcaggtt

SEQ ID NO: 11209 - DNA, 22 bp, Artificial Sequence
  Target B2M Sequence complement
cgtactccaaagattcaggttt

SEQ ID NO: 11210 - DNA, 22 bp, Artificial Sequence
  Target B2M Sequence complement
gtactccaaagattcaggttta

SEQ ID NO: 11211 - DNA, 22 bp, Artificial Sequence
  Target B2M Sequence complement
tactccaaagattcaggtttac

SEQ ID NO: 11212 - DNA, 22 bp, Artificial Sequence
  Target B2M Sequence complement
actccaaagattcaggtttact

SEQ ID NO: 11213 - DNA, 22 bp, Artificial Sequence
  Target B2M Sequence complement
ctccaaagattcaggtttactc

SEQ ID NO: 11214 - DNA, 22 bp, Artificial Sequence
  Target B2M Sequence complement
tccaaagattcaggtttactca

SEQ ID NO: 11215 - DNA, 22 bp, Artificial Sequence
  Target B2M Sequence complement
ccaaagattcaggtttactcac

SEQ ID NO: 11216 - DNA, 22 bp, Artificial Sequence
  Target B2M Sequence complement
caaagattcaggtttactcacg

SEQ ID NO: 11217 - DNA, 22 bp, Artificial Sequence
  Target B2M Sequence complement
aaagattcaggtttactcacgt

SEQ ID NO: 11218 - DNA, 22 bp, Artificial Sequence
  Target B2M Sequence complement
aagattcaggtttactcacgtc

SEQ ID NO: 11219 - DNA, 22 bp, Artificial Sequence
  Target B2M Sequence complement
agattcaggtttactcacgtca

SEQ ID NO: 11220 - DNA, 22 bp, Artificial Sequence
  Target B2M Sequence complement
gattcaggtttactcacgtcat

SEQ ID NO: 11221 - DNA, 22 bp, Artificial Sequence
  Target B2M Sequence complement
attcaggtttactcacgtcatc

SEQ ID NO: 11222 - DNA, 22 bp, Artificial Sequence
  Target B2M Sequence complement
ttcaggtttactcacgtcatcc

SEQ ID NO: 11223 - DNA, 22 bp, Artificial Sequence
  Target B2M Sequence complement
tcaggtttactcacgtcatcca

SEQ ID NO: 11224 - DNA, 22 bp, Artificial Sequence
  Target B2M Sequence complement
caggtttactcacgtcatccag

SEQ ID NO: 11225 - DNA, 22 bp, Artificial Sequence
  Target B2M Sequence complement
aggtttactcacgtcatccagc

SEQ ID NO: 11226 - DNA, 22 bp, Artificial Sequence
  Target B2M Sequence complement
ggtttactcacgtcatccagca

SEQ ID NO: 11227 - DNA, 22 bp, Artificial Sequence
  Target B2M Sequence complement
gtttactcacgtcatccagcag

SEQ ID NO: 11228 - DNA, 22 bp, Artificial Sequence
  Target B2M Sequence complement
tttactcacgtcatccagcaga

SEQ ID NO: 11229 - DNA, 22 bp, Artificial Sequence
  Target B2M Sequence complement
ttactcacgtcatccagcagag

SEQ ID NO: 11230 - DNA, 22 bp, Artificial Sequence
  Target B2M Sequence complement
tactcacgtcatccagcagaga

SEQ ID NO: 11231 - DNA, 22 bp, Artificial Sequence
  Target B2M Sequence complement
actcacgtcatccagcagagaa

SEQ ID NO: 11232 - DNA, 22 bp, Artificial Sequence
  Target B2M Sequence complement
ctcacgtcatccagcagagaat

SEQ ID NO: 11233 - DNA, 22 bp, Artificial Sequence
  Target B2M Sequence complement
tcacgtcatccagcagagaatg

SEQ ID NO: 11234 - DNA, 22 bp, Artificial Sequence
  Target B2M Sequence complement
cacgtcatccagcagagaatgg

SEQ ID NO: 11235 - DNA, 22 bp, Artificial Sequence
  Target B2M Sequence complement
acgtcatccagcagagaatgga

SEQ ID NO: 11236 - DNA, 22 bp, Artificial Sequence
  Target B2M Sequence complement
cgtcatccagcagagaatggaa

SEQ ID NO: 11237 - DNA, 22 bp, Artificial Sequence
  Target B2M Sequence complement
gtcatccagcagagaatggaaa

SEQ ID NO: 11238 - DNA, 22 bp, Artificial Sequence
  Target B2M Sequence complement
tcatccagcagagaatggaaag

SEQ ID NO: 11239 - DNA, 22 bp, Artificial Sequence
  Target B2M Sequence complement
catccagcagagaatggaaagt

SEQ ID NO: 11240 - DNA, 22 bp, Artificial Sequence
  Target B2M Sequence complement
atccagcagagaatggaaagtc

SEQ ID NO: 11241 - DNA, 22 bp, Artificial Sequence
  Target B2M Sequence complement
tccagcagagaatggaaagtca

SEQ ID NO: 11242 - DNA, 22 bp, Artificial Sequence
  Target B2M Sequence complement
ccagcagagaatggaaagtcaa

SEQ ID NO: 11243 - DNA, 22 bp, Artificial Sequence
  Target B2M Sequence complement
cagcagagaatggaaagtcaaa

SEQ ID NO: 11244 - DNA, 22 bp, Artificial Sequence
  Target B2M Sequence complement
agcagagaatggaaagtcaaat

SEQ ID NO: 11245 - DNA, 22 bp, Artificial Sequence
  Target B2M Sequence complement
gcagagaatggaaagtcaaatt

SEQ ID NO: 11246 - DNA, 22 bp, Artificial Sequence
  Target B2M Sequence complement
cagagaatggaaagtcaaattt

SEQ ID NO: 11247 - DNA, 22 bp, Artificial Sequence
  Target B2M Sequence complement
agagaatggaaagtcaaatttc

SEQ ID NO: 11248 - DNA, 22 bp, Artificial Sequence
  Target B2M Sequence complement
gagaatggaaagtcaaatttcc

SEQ ID NO: 11249 - DNA, 22 bp, Artificial Sequence
  Target B2M Sequence complement
agaatggaaagtcaaatttcct

SEQ ID NO: 11250 - DNA, 22 bp, Artificial Sequence
  Target B2M Sequence complement
gaatggaaagtcaaatttcctg

SEQ ID NO: 11251 - DNA, 22 bp, Artificial Sequence
  Target B2M Sequence complement
aatggaaagtcaaatttcctga

SEQ ID NO: 11252 - DNA, 22 bp, Artificial Sequence
  Target B2M Sequence complement
atggaaagtcaaatttcctgaa

SEQ ID NO: 11253 - DNA, 22 bp, Artificial Sequence
  Target B2M Sequence complement
tggaaagtcaaatttcctgaat

SEQ ID NO: 11254 - DNA, 22 bp, Artificial Sequence
  Target B2M Sequence complement
ggaaagtcaaatttcctgaatt

SEQ ID NO: 11255 - DNA, 22 bp, Artificial Sequence
  Target B2M Sequence complement
gaaagtcaaatttcctgaattg

SEQ ID NO: 11256 - DNA, 22 bp, Artificial Sequence
  Target B2M Sequence complement
aaagtcaaatttcctgaattgc

SEQ ID NO: 11257 - DNA, 22 bp, Artificial Sequence
  Target B2M Sequence complement
aagtcaaatttcctgaattgct

SEQ ID NO: 11258 - DNA, 22 bp, Artificial Sequence
  Target B2M Sequence complement
agtcaaatttcctgaattgcta

SEQ ID NO: 11259 - DNA, 22 bp, Artificial Sequence
  Target B2M Sequence complement
gtcaaatttcctgaattgctat

SEQ ID NO: 11260 - DNA, 22 bp, Artificial Sequence
  Target B2M Sequence complement
tcaaatttcctgaattgctatg

SEQ ID NO: 11261 - DNA, 22 bp, Artificial Sequence
  Target B2M Sequence complement
caaatttcctgaattgctatgt

SEQ ID NO: 11262 - DNA, 22 bp, Artificial Sequence
  Target B2M Sequence complement
aaatttcctgaattgctatgtg

SEQ ID NO: 11263 - DNA, 22 bp, Artificial Sequence
  Target B2M Sequence complement
aatttcctgaattgctatgtgt

SEQ ID NO: 11264 - DNA, 22 bp, Artificial Sequence
  Target B2M Sequence complement
atttcctgaattgctatgtgtc

SEQ ID NO: 11265 - DNA, 22 bp, Artificial Sequence
  Target B2M Sequence complement
tttcctgaattgctatgtgtct

SEQ ID NO: 11266 - DNA, 22 bp, Artificial Sequence
  Target B2M Sequence complement
ttcctgaattgctatgtgtctg

SEQ ID NO: 11267 - DNA, 22 bp, Artificial Sequence
  Target B2M Sequence complement
tcctgaattgctatgtgtctgg

SEQ ID NO: 11268 - DNA, 22 bp, Artificial Sequence
  Target B2M Sequence complement
cctgaattgctatgtgtctggg

SEQ ID NO: 11269 - DNA, 22 bp, Artificial Sequence
  Target B2M Sequence complement
ctgaattgctatgtgtctgggt

SEQ ID NO: 11270 - DNA, 22 bp, Artificial Sequence
  Target B2M Sequence complement
tgaattgctatgtgtctgggtt

SEQ ID NO: 11271 - DNA, 22 bp, Artificial Sequence
  Target B2M Sequence complement
gaattgctatgtgtctgggttt

SEQ ID NO: 11272 - DNA, 22 bp, Artificial Sequence
  Target B2M Sequence complement
aattgctatgtgtctgggtttc

SEQ ID NO: 11273 - DNA, 22 bp, Artificial Sequence
  Target B2M Sequence complement
attgctatgtgtctgggtttca

SEQ ID NO: 11274 - DNA, 22 bp, Artificial Sequence
  Target B2M Sequence complement
ttgctatgtgtctgggtttcat

SEQ ID NO: 11275 - DNA, 22 bp, Artificial Sequence
  Target B2M Sequence complement
tgctatgtgtctgggtttcatc

SEQ ID NO: 11276 - DNA, 22 bp, Artificial Sequence
  Target B2M Sequence complement
gctatgtgtctgggtttcatcc

SEQ ID NO: 11277 - DNA, 22 bp, Artificial Sequence
  Target B2M Sequence complement
ctatgtgtctgggtttcatcca

SEQ ID NO: 11278 - DNA, 22 bp, Artificial Sequence
  Target B2M Sequence complement
tatgtgtctgggtttcatccat

SEQ ID NO: 11279 - DNA, 22 bp, Artificial Sequence
  Target B2M Sequence complement
atgtgtctgggtttcatccatc

SEQ ID NO: 11280 - DNA, 22 bp, Artificial Sequence
  Target B2M Sequence complement
tgtgtctgggtttcatccatcc

SEQ ID NO: 11281 - DNA, 22 bp, Artificial Sequence
  Target B2M Sequence complement
gtgtctgggtttcatccatccg

SEQ ID NO: 11282 - DNA, 22 bp, Artificial Sequence
  Target B2M Sequence complement
tgtctgggtttcatccatccga

SEQ ID NO: 11283 - DNA, 22 bp, Artificial Sequence
  Target B2M Sequence complement
gtctgggtttcatccatccgac

SEQ ID NO: 11284 - DNA, 22 bp, Artificial Sequence
  Target B2M Sequence complement
tctgggtttcatccatccgaca

SEQ ID NO: 11285 - DNA, 22 bp, Artificial Sequence
  Target B2M Sequence complement
ctgggtttcatccatccgacat

SEQ ID NO: 11286 - DNA, 22 bp, Artificial Sequence
  Target B2M Sequence complement
tgggtttcatccatccgacatt

SEQ ID NO: 11287 - DNA, 22 bp, Artificial Sequence
  Target B2M Sequence complement
gggtttcatccatccgacattg

SEQ ID NO: 11288 - DNA, 22 bp, Artificial Sequence
  Target B2M Sequence complement
ggtttcatccatccgacattga

SEQ ID NO: 11289 - DNA, 22 bp, Artificial Sequence
  Target B2M Sequence complement
gtttcatccatccgacattgaa

SEQ ID NO: 11290 - DNA, 22 bp, Artificial Sequence
  Target B2M Sequence complement
tttcatccatccgacattgaag

SEQ ID NO: 11291 - DNA, 22 bp, Artificial Sequence
  Target B2M Sequence complement
ttcatccatccgacattgaagt

SEQ ID NO: 11292 - DNA, 22 bp, Artificial Sequence
  Target B2M Sequence complement
tcatccatccgacattgaagtt

SEQ ID NO: 11293 - DNA, 22 bp, Artificial Sequence
  Target B2M Sequence complement
catccatccgacattgaagttg

SEQ ID NO: 11294 - DNA, 22 bp, Artificial Sequence
  Target B2M Sequence complement
atccatccgacattgaagttga

SEQ ID NO: 11295 - DNA, 22 bp, Artificial Sequence
  Target B2M Sequence complement
tccatccgacattgaagttgac

SEQ ID NO: 11296 - DNA, 22 bp, Artificial Sequence
  Target B2M Sequence complement
ccatccgacattgaagttgact

SEQ ID NO: 11297 - DNA, 22 bp, Artificial Sequence
  Target B2M Sequence complement
catccgacattgaagttgactt

SEQ ID NO: 11298 - DNA, 22 bp, Artificial Sequence
  Target B2M Sequence complement
atccgacattgaagttgactta

SEQ ID NO: 11299 - DNA, 22 bp, Artificial Sequence
  Target B2M Sequence complement
tccgacattgaagttgacttac

SEQ ID NO: 11300 - DNA, 22 bp, Artificial Sequence
  Target B2M Sequence complement
ccgacattgaagttgacttact

SEQ ID NO: 11301 - DNA, 22 bp, Artificial Sequence
  Target B2M Sequence complement
cgacattgaagttgacttactg

SEQ ID NO: 11302 - DNA, 22 bp, Artificial Sequence
  Target B2M Sequence complement
gacattgaagttgacttactga

SEQ ID NO: 11303 - DNA, 22 bp, Artificial Sequence
  Target B2M Sequence complement
acattgaagttgacttactgaa

SEQ ID NO: 11304 - DNA, 22 bp, Artificial Sequence
  Target B2M Sequence complement
cattgaagttgacttactgaag

SEQ ID NO: 11305 - DNA, 22 bp, Artificial Sequence
  Target B2M Sequence complement
attgaagttgacttactgaaga

SEQ ID NO: 11306 - DNA, 22 bp, Artificial Sequence
  Target B2M Sequence complement
ttgaagttgacttactgaagaa

SEQ ID NO: 11307 - DNA, 22 bp, Artificial Sequence
  Target B2M Sequence complement
tgaagttgacttactgaagaat

SEQ ID NO: 11308 - DNA, 22 bp, Artificial Sequence
  Target B2M Sequence complement
gaagttgacttactgaagaatg

SEQ ID NO: 11309 - DNA, 22 bp, Artificial Sequence
  Target B2M Sequence complement
aagttgacttactgaagaatgg

SEQ ID NO: 11310 - DNA, 22 bp, Artificial Sequence
  Target B2M Sequence complement
agttgacttactgaagaatgga

SEQ ID NO: 11311 - DNA, 22 bp, Artificial Sequence
  Target B2M Sequence complement
gttgacttactgaagaatggag

SEQ ID NO: 11312 - DNA, 22 bp, Artificial Sequence
  Target B2M Sequence complement
ttgacttactgaagaatggaga

SEQ ID NO: 11313 - DNA, 22 bp, Artificial Sequence
  Target B2M Sequence complement
tgacttactgaagaatggagag

SEQ ID NO: 11314 - DNA, 22 bp, Artificial Sequence
  Target B2M Sequence complement
gacttactgaagaatggagaga

SEQ ID NO: 11315 - DNA, 22 bp, Artificial Sequence
  Target B2M Sequence complement
acttactgaagaatggagagag

SEQ ID NO: 11316 - DNA, 22 bp, Artificial Sequence
  Target B2M Sequence complement
cttactgaagaatggagagaga

SEQ ID NO: 11317 - DNA, 22 bp, Artificial Sequence
  Target B2M Sequence complement
ttactgaagaatggagagagaa

SEQ ID NO: 11318 - DNA, 22 bp, Artificial Sequence
  Target B2M Sequence complement
tactgaagaatggagagagaat

SEQ ID NO: 11319 - DNA, 22 bp, Artificial Sequence
  Target B2M Sequence complement
actgaagaatggagagagaatt

SEQ ID NO: 11320 - DNA, 22 bp, Artificial Sequence
  Target B2M Sequence complement
ctgaagaatggagagagaattg

SEQ ID NO: 11321 - DNA, 22 bp, Artificial Sequence
  Target B2M Sequence complement
tgaagaatggagagagaattga

SEQ ID NO: 11322 - DNA, 22 bp, Artificial Sequence
  Target B2M Sequence complement
gaagaatggagagagaattgaa

SEQ ID NO: 11323 - DNA, 22 bp, Artificial Sequence
  Target B2M Sequence complement
aagaatggagagagaattgaaa

SEQ ID NO: 11324 - DNA, 22 bp, Artificial Sequence
  Target B2M Sequence complement
aaagtggagcattcagacttgt

SEQ ID NO: 11325 - DNA, 22 bp, Artificial Sequence
  Target B2M Sequence complement
aagtggagcattcagacttgtc

SEQ ID NO: 11326 - DNA, 22 bp, Artificial Sequence
  Target B2M Sequence complement
agtggagcattcagacttgtct

SEQ ID NO: 11327 - DNA, 22 bp, Artificial Sequence
  Target B2M Sequence complement
gtggagcattcagacttgtctt

SEQ ID NO: 11328 - DNA, 22 bp, Artificial Sequence
  Target B2M Sequence complement
tggagcattcagacttgtcttt

SEQ ID NO: 11329 - DNA, 22 bp, Artificial Sequence
  Target B2M Sequence complement
ggagcattcagacttgtctttc

SEQ ID NO: 11330 - DNA, 22 bp, Artificial Sequence
  Target B2M Sequence complement
gagcattcagacttgtctttca

SEQ ID NO: 11331 - DNA, 22 bp, Artificial Sequence
  Target B2M Sequence complement
agcattcagacttgtctttcag

SEQ ID NO: 11332 - DNA, 22 bp, Artificial Sequence
  Target B2M Sequence complement
gcattcagacttgtctttcagc

SEQ ID NO: 11333 - DNA, 22 bp, Artificial Sequence
  Target B2M Sequence complement
cattcagacttgtctttcagca

SEQ ID NO: 11334 - DNA, 22 bp, Artificial Sequence
  Target B2M Sequence complement
attcagacttgtctttcagcaa

SEQ ID NO: 11335 - DNA, 22 bp, Artificial Sequence
  Target B2M Sequence complement
ttcagacttgtctttcagcaag

SEQ ID NO: 11336 - DNA, 22 bp, Artificial Sequence
  Target B2M Sequence complement
tcagacttgtctttcagcaagg

SEQ ID NO: 11337 - DNA, 22 bp, Artificial Sequence
  Target B2M Sequence complement
cagacttgtctttcagcaagga

SEQ ID NO: 11338 - DNA, 22 bp, Artificial Sequence
  Target B2M Sequence complement
agacttgtctttcagcaaggac

SEQ ID NO: 11339 - DNA, 22 bp, Artificial Sequence
  Target B2M Sequence complement
gacttgtctttcagcaaggact

SEQ ID NO: 11340 - DNA, 22 bp, Artificial Sequence
  Target B2M Sequence complement
acttgtctttcagcaaggactg

SEQ ID NO: 11341 - DNA, 22 bp, Artificial Sequence
  Target B2M Sequence complement
cttgtctttcagcaaggactgg

SEQ ID NO: 11342 - DNA, 22 bp, Artificial Sequence
  Target B2M Sequence complement
ttgtctttcagcaaggactggt

SEQ ID NO: 11343 - DNA, 22 bp, Artificial Sequence
  Target B2M Sequence complement
tgtctttcagcaaggactggtc

SEQ ID NO: 11344 - DNA, 22 bp, Artificial Sequence
  Target B2M Sequence complement
gtctttcagcaaggactggtct

SEQ ID NO: 11345 - DNA, 22 bp, Artificial Sequence
  Target B2M Sequence complement
tctttcagcaaggactggtctt

SEQ ID NO: 11346 - DNA, 22 bp, Artificial Sequence
  Target B2M Sequence complement
ctttcagcaaggactggtcttt

SEQ ID NO: 11347 - DNA, 22 bp, Artificial Sequence
  Target B2M Sequence complement
tttcagcaaggactggtctttc

SEQ ID NO: 11348 - DNA, 22 bp, Artificial Sequence
  Target B2M Sequence complement
ttcagcaaggactggtctttct

SEQ ID NO: 11349 - DNA, 22 bp, Artificial Sequence
  Target B2M Sequence complement
tcagcaaggactggtctttcta

SEQ ID NO: 11350 - DNA, 22 bp, Artificial Sequence
  Target B2M Sequence complement
cagcaaggactggtctttctat

SEQ ID NO: 11351 - DNA, 22 bp, Artificial Sequence
  Target B2M Sequence complement
agcaaggactggtctttctatc

SEQ ID NO: 11352 - DNA, 22 bp, Artificial Sequence
  Target B2M Sequence complement
gcaaggactggtctttctatct

SEQ ID NO: 11353 - DNA, 22 bp, Artificial Sequence
  Target B2M Sequence complement
caaggactggtctttctatctc

SEQ ID NO: 11354 - DNA, 22 bp, Artificial Sequence
  Target B2M Sequence complement
aaggactggtctttctatctct

SEQ ID NO: 11355 - DNA, 22 bp, Artificial Sequence
  Target B2M Sequence complement
aggactggtctttctatctctt

SEQ ID NO: 11356 - DNA, 22 bp, Artificial Sequence
  Target B2M Sequence complement
ggactggtctttctatctcttg

SEQ ID NO: 11357 - DNA, 22 bp, Artificial Sequence
  Target B2M Sequence complement
gactggtctttctatctcttgt

SEQ ID NO: 11358 - DNA, 22 bp, Artificial Sequence
  Target B2M Sequence complement
actggtctttctatctcttgta

SEQ ID NO: 11359 - DNA, 22 bp, Artificial Sequence
  Target B2M Sequence complement
ctggtctttctatctcttgtac

SEQ ID NO: 11360 - DNA, 22 bp, Artificial Sequence
  Target B2M Sequence complement
tggtctttctatctcttgtact

SEQ ID NO: 11361 - DNA, 22 bp, Artificial Sequence
  Target B2M Sequence complement
ggtctttctatctcttgtacta

SEQ ID NO: 11362 - DNA, 22 bp, Artificial Sequence
  Target B2M Sequence complement
gtctttctatctcttgtactac

SEQ ID NO: 11363 - DNA, 22 bp, Artificial Sequence
  Target B2M Sequence complement
tctttctatctcttgtactaca

SEQ ID NO: 11364 - DNA, 22 bp, Artificial Sequence
  Target B2M Sequence complement
ctttctatctcttgtactacac

SEQ ID NO: 11365 - DNA, 22 bp, Artificial Sequence
  Target B2M Sequence complement
tttctatctcttgtactacact

SEQ ID NO: 11366 - DNA, 22 bp, Artificial Sequence
  Target B2M Sequence complement
ttctatctcttgtactacactg

SEQ ID NO: 11367 - DNA, 22 bp, Artificial Sequence
  Target B2M Sequence complement
tctatctcttgtactacactga

SEQ ID NO: 11368 - DNA, 22 bp, Artificial Sequence
  Target B2M Sequence complement
ctatctcttgtactacactgaa

SEQ ID NO: 11369 - DNA, 22 bp, Artificial Sequence
  Target B2M Sequence complement
tatctcttgtactacactgaat

SEQ ID NO: 11370 - DNA, 22 bp, Artificial Sequence
  Target B2M Sequence complement
atctcttgtactacactgaatt

SEQ ID NO: 11371 - DNA, 22 bp, Artificial Sequence
  Target B2M Sequence complement
tctcttgtactacactgaattc

SEQ ID NO: 11372 - DNA, 22 bp, Artificial Sequence
  Target B2M Sequence complement
ctcttgtactacactgaattca

SEQ ID NO: 11373 - DNA, 22 bp, Artificial Sequence
  Target B2M Sequence complement
tcttgtactacactgaattcac

SEQ ID NO: 11374 - DNA, 22 bp, Artificial Sequence
  Target B2M Sequence complement
cttgtactacactgaattcacc

SEQ ID NO: 11375 - DNA, 22 bp, Artificial Sequence
  Target B2M Sequence complement
ttgtactacactgaattcaccc

SEQ ID NO: 11376 - DNA, 22 bp, Artificial Sequence
  Target B2M Sequence complement
aaagatgagtatgcctgccgtg

SEQ ID NO: 11377 - DNA, 22 bp, Artificial Sequence
  Target B2M Sequence complement
aagatgagtatgcctgccgtgt

SEQ ID NO: 11378 - DNA, 22 bp, Artificial Sequence
  Target B2M Sequence complement
agatgagtatgcctgccgtgtg

SEQ ID NO: 11379 - DNA, 22 bp, Artificial Sequence
  Target B2M Sequence complement
gatgagtatgcctgccgtgtga

SEQ ID NO: 11380 - DNA, 22 bp, Artificial Sequence
  Target B2M Sequence complement
atgagtatgcctgccgtgtgaa

SEQ ID NO: 11381 - DNA, 22 bp, Artificial Sequence
  Target B2M Sequence complement
tgagtatgcctgccgtgtgaac

SEQ ID NO: 11382 - DNA, 22 bp, Artificial Sequence
  Target B2M Sequence complement
gagtatgcctgccgtgtgaacc

SEQ ID NO: 11383 - DNA, 22 bp, Artificial Sequence
  Target B2M Sequence complement
agtatgcctgccgtgtgaacca

SEQ ID NO: 11384 - DNA, 22 bp, Artificial Sequence
  Target B2M Sequence complement
gtatgcctgccgtgtgaaccat

SEQ ID NO: 11385 - DNA, 22 bp, Artificial Sequence
  Target B2M Sequence complement
tatgcctgccgtgtgaaccatg

SEQ ID NO: 11386 - DNA, 22 bp, Artificial Sequence
  Target B2M Sequence complement
atgcctgccgtgtgaaccatgt

SEQ ID NO: 11387 - DNA, 22 bp, Artificial Sequence
  Target B2M Sequence complement
tgcctgccgtgtgaaccatgtg

SEQ ID NO: 11388 - DNA, 22 bp, Artificial Sequence
  Target B2M Sequence complement
gcctgccgtgtgaaccatgtga

SEQ ID NO: 11389 - DNA, 22 bp, Artificial Sequence
  Target B2M Sequence complement
cctgccgtgtgaaccatgtgac

SEQ ID NO: 11390 - DNA, 22 bp, Artificial Sequence
  Target B2M Sequence complement
ctgccgtgtgaaccatgtgact

SEQ ID NO: 11391 - DNA, 22 bp, Artificial Sequence
  Target B2M Sequence complement
tgccgtgtgaaccatgtgactt

SEQ ID NO: 11392 - DNA, 22 bp, Artificial Sequence
  Target B2M Sequence complement
gccgtgtgaaccatgtgacttt

SEQ ID NO: 11393 - DNA, 22 bp, Artificial Sequence
  Target B2M Sequence complement
ccgtgtgaaccatgtgactttg

SEQ ID NO: 11394 - DNA, 22 bp, Artificial Sequence
  Target B2M Sequence complement
cgtgtgaaccatgtgactttgt

SEQ ID NO: 11395 - DNA, 22 bp, Artificial Sequence
  Target B2M Sequence complement
gtgtgaaccatgtgactttgtc

SEQ ID NO: 11396 - DNA, 22 bp, Artificial Sequence
  Target B2M Sequence complement
tgtgaaccatgtgactttgtca

SEQ ID NO: 11397 - DNA, 22 bp, Artificial Sequence
  Target B2M Sequence complement
gtgaaccatgtgactttgtcac

SEQ ID NO: 11398 - DNA, 22 bp, Artificial Sequence
  Target B2M Sequence complement
tgaaccatgtgactttgtcaca

SEQ ID NO: 11399 - DNA, 22 bp, Artificial Sequence
  Target B2M Sequence complement
gaaccatgtgactttgtcacag

SEQ ID NO: 11400 - DNA, 22 bp, Artificial Sequence
  Target B2M Sequence complement
aaccatgtgactttgtcacagc

SEQ ID NO: 11401 - DNA, 22 bp, Artificial Sequence
  Target B2M Sequence complement
accatgtgactttgtcacagcc

SEQ ID NO: 11402 - DNA, 22 bp, Artificial Sequence
  Target B2M Sequence complement
ccatgtgactttgtcacagccc

SEQ ID NO: 11403 - DNA, 22 bp, Artificial Sequence
  Target B2M Sequence complement
catgtgactttgtcacagccca

SEQ ID NO: 11404 - DNA, 22 bp, Artificial Sequence
  Target B2M Sequence complement
atgtgactttgtcacagcccaa

SEQ ID NO: 11405 - DNA, 22 bp, Artificial Sequence
  Target B2M Sequence complement
tgtgactttgtcacagcccaag

SEQ ID NO: 11406 - DNA, 22 bp, Artificial Sequence
  Target B2M Sequence complement
gtgactttgtcacagcccaaga

SEQ ID NO: 11407 - DNA, 22 bp, Artificial Sequence
  Target B2M Sequence complement
tgactttgtcacagcccaagat

SEQ ID NO: 11408 - DNA, 22 bp, Artificial Sequence
  Target B2M Sequence complement
gactttgtcacagcccaagata

SEQ ID NO: 11409 - DNA, 22 bp, Artificial Sequence
  Target B2M Sequence complement
actttgtcacagcccaagatag

SEQ ID NO: 11410 - DNA, 22 bp, Artificial Sequence
  Target B2M Sequence complement
ctttgtcacagcccaagatagt

SEQ ID NO: 11411 - DNA, 22 bp, Artificial Sequence
  Target B2M Sequence complement
tttgtcacagcccaagatagtt

SEQ ID NO: 11412 - DNA, 22 bp, Artificial Sequence
  Target B2M Sequence complement
ttgtcacagcccaagatagtta

SEQ ID NO: 11413 - DNA, 22 bp, Artificial Sequence
  Target B2M Sequence complement
tgtcacagcccaagatagttaa

SEQ ID NO: 11414 - DNA, 22 bp, Artificial Sequence
  Target B2M Sequence complement
gtcacagcccaagatagttaag

SEQ ID NO: 11415 - DNA, 22 bp, Artificial Sequence
  Target B2M Sequence complement
tcacagcccaagatagttaagt

SEQ ID NO: 11416 - DNA, 22 bp, Artificial Sequence
  Target B2M Sequence complement
cacagcccaagatagttaagtg

SEQ ID NO: 11417 - DNA, 22 bp, Artificial Sequence
  Target B2M Sequence complement
acagcccaagatagttaagtgg

SEQ ID NO: 11418 - DNA, 22 bp, Artificial Sequence
  Target B2M Sequence complement
cagcccaagatagttaagtggg

SEQ ID NO: 11419 - DNA, 22 bp, Artificial Sequence
  Target B2M Sequence complement
agcccaagatagttaagtggga

SEQ ID NO: 11420 - DNA, 22 bp, Artificial Sequence
  Target B2M Sequence complement
gcccaagatagttaagtgggat

SEQ ID NO: 11421 - DNA, 22 bp, Artificial Sequence
  Target B2M Sequence complement
cccaagatagttaagtgggatc

SEQ ID NO: 11422 - DNA, 22 bp, Artificial Sequence
  Target B2M Sequence complement
ccaagatagttaagtgggatcg

SEQ ID NO: 11423 - DNA, 22 bp, Artificial Sequence
  Target B2M Sequence complement
caagatagttaagtgggatcga

SEQ ID NO: 11424 - DNA, 22 bp, Artificial Sequence
  Target B2M Sequence complement
aagatagttaagtgggatcgag

SEQ ID NO: 11425 - DNA, 22 bp, Artificial Sequence
  Target B2M Sequence complement
agatagttaagtgggatcgaga

SEQ ID NO: 11426 - DNA, 22 bp, Artificial Sequence
  Target B2M Sequence complement
gatagttaagtgggatcgagac

SEQ ID NO: 11427 - DNA, 22 bp, Artificial Sequence
  Target B2M Sequence complement
atagttaagtgggatcgagaca

SEQ ID NO: 11428 - DNA, 22 bp, Artificial Sequence
  Target B2M Sequence complement
tagttaagtgggatcgagacat

SEQ ID NO: 11429 - DNA, 22 bp, Artificial Sequence
  Target B2M Sequence complement
agttaagtgggatcgagacatg

SEQ ID NO: 11430 - DNA, 22 bp, Artificial Sequence
  Target B2M Sequence complement
gttaagtgggatcgagacatgt

SEQ ID NO: 11431 - DNA, 22 bp, Artificial Sequence
  Target B2M Sequence complement
ttaagtgggatcgagacatgta

SEQ ID NO: 11432 - DNA, 22 bp, Artificial Sequence
  Target B2M Sequence complement
taagtgggatcgagacatgtaa

SEQ ID NO: 11433 - DNA, 22 bp, Artificial Sequence
  Target B2M Sequence complement
aagtgggatcgagacatgtaag

SEQ ID NO: 11434 - DNA, 22 bp, Artificial Sequence
  Target B2M Sequence complement
agtgggatcgagacatgtaagc

SEQ ID NO: 11435 - DNA, 22 bp, Artificial Sequence
  Target B2M Sequence complement
gtgggatcgagacatgtaagca

SEQ ID NO: 11436 - DNA, 22 bp, Artificial Sequence
  Target B2M Sequence complement
tgggatcgagacatgtaagcag

SEQ ID NO: 11437 - DNA, 22 bp, Artificial Sequence
  Target B2M Sequence complement
gggatcgagacatgtaagcagc

SEQ ID NO: 11438 - DNA, 22 bp, Artificial Sequence
  Target B2M Sequence complement
ggatcgagacatgtaagcagca

SEQ ID NO: 11439 - DNA, 22 bp, Artificial Sequence
  Target B2M Sequence complement
gatcgagacatgtaagcagcat

SEQ ID NO: 11440 - DNA, 22 bp, Artificial Sequence
  Target B2M Sequence complement
atcgagacatgtaagcagcatc

SEQ ID NO: 11441 - DNA, 22 bp, Artificial Sequence
  Target B2M Sequence complement
tcgagacatgtaagcagcatca

SEQ ID NO: 11442 - DNA, 22 bp, Artificial Sequence
  Target B2M Sequence complement
cgagacatgtaagcagcatcat

SEQ ID NO: 11443 - DNA, 22 bp, Artificial Sequence
  Target B2M Sequence complement
gagacatgtaagcagcatcatg

SEQ ID NO: 11444 - DNA, 22 bp, Artificial Sequence
  Target B2M Sequence complement
agacatgtaagcagcatcatgg

SEQ ID NO: 11445 - DNA, 22 bp, Artificial Sequence
  Target B2M Sequence complement
gacatgtaagcagcatcatgga

SEQ ID NO: 11446 - DNA, 22 bp, Artificial Sequence
  Target B2M Sequence complement
acatgtaagcagcatcatggag

SEQ ID NO: 11447 - DNA, 22 bp, Artificial Sequence
  Target B2M Sequence complement
catgtaagcagcatcatggagg

SEQ ID NO: 11448 - DNA, 22 bp, Artificial Sequence
  Target B2M Sequence complement
atgtaagcagcatcatggaggt

SEQ ID NO: 11449 - DNA, 22 bp, Artificial Sequence
  Target B2M Sequence complement
tgtaagcagcatcatggaggtt

SEQ ID NO: 11450 - DNA, 22 bp, Artificial Sequence
  Target B2M Sequence complement
gtaagcagcatcatggaggttt

SEQ ID NO: 11451 - DNA, 22 bp, Artificial Sequence
  Target B2M Sequence complement
taagcagcatcatggaggtttg

SEQ ID NO: 11452 - DNA, 22 bp, Artificial Sequence
  Target B2M Sequence complement
aagcagcatcatggaggtttga

SEQ ID NO: 11453 - DNA, 22 bp, Artificial Sequence
  Target B2M Sequence complement
agcagcatcatggaggtttgaa

SEQ ID NO: 11454 - DNA, 22 bp, Artificial Sequence
  Target B2M Sequence complement
gcagcatcatggaggtttgaag

SEQ ID NO: 11455 - DNA, 22 bp, Artificial Sequence
  Target B2M Sequence complement
cagcatcatggaggtttgaaga

SEQ ID NO: 11456 - DNA, 22 bp, Artificial Sequence
  Target B2M Sequence complement
agcatcatggaggtttgaagat

SEQ ID NO: 11457 - DNA, 22 bp, Artificial Sequence
  Target B2M Sequence complement
gcatcatggaggtttgaagatg

SEQ ID NO: 11458 - DNA, 22 bp, Artificial Sequence
  Target B2M Sequence complement
catcatggaggtttgaagatgc

SEQ ID NO: 11459 - DNA, 22 bp, Artificial Sequence
  Target B2M Sequence complement
atcatggaggtttgaagatgcc

SEQ ID NO: 11460 - DNA, 22 bp, Artificial Sequence
  Target B2M Sequence complement
tcatggaggtttgaagatgccg

SEQ ID NO: 11461 - DNA, 22 bp, Artificial Sequence
  Target B2M Sequence complement
catggaggtttgaagatgccgc

SEQ ID NO: 11462 - DNA, 22 bp, Artificial Sequence
  Target B2M Sequence complement
atggaggtttgaagatgccgca

SEQ ID NO: 11463 - DNA, 22 bp, Artificial Sequence
  Target B2M Sequence complement
tggaggtttgaagatgccgcat

SEQ ID NO: 11464 - DNA, 22 bp, Artificial Sequence
  Target B2M Sequence complement
ggaggtttgaagatgccgcatt

SEQ ID NO: 11465 - DNA, 22 bp, Artificial Sequence
  Target B2M Sequence complement
gaggtttgaagatgccgcattt

SEQ ID NO: 11466 - DNA, 22 bp, Artificial Sequence
  Target B2M Sequence complement
aggtttgaagatgccgcatttg

SEQ ID NO: 11467 - DNA, 22 bp, Artificial Sequence
  Target B2M Sequence complement
ggtttgaagatgccgcatttgg

SEQ ID NO: 11468 - DNA, 22 bp, Artificial Sequence
  Target B2M Sequence complement
gtttgaagatgccgcatttgga

SEQ ID NO: 11469 - DNA, 22 bp, Artificial Sequence
  Target B2M Sequence complement
tttgaagatgccgcatttggat

SEQ ID NO: 11470 - DNA, 22 bp, Artificial Sequence
  Target B2M Sequence complement
ttgaagatgccgcatttggatt

SEQ ID NO: 11471 - DNA, 22 bp, Artificial Sequence
  Target B2M Sequence complement
tgaagatgccgcatttggattg

SEQ ID NO: 11472 - DNA, 22 bp, Artificial Sequence
  Target B2M Sequence complement
gaagatgccgcatttggattgg

SEQ ID NO: 11473 - DNA, 22 bp, Artificial Sequence
  Target B2M Sequence complement
aagatgccgcatttggattgga

SEQ ID NO: 11474 - DNA, 22 bp, Artificial Sequence
  Target B2M Sequence complement
agatgccgcatttggattggat

SEQ ID NO: 11475 - DNA, 22 bp, Artificial Sequence
  Target B2M Sequence complement
gatgccgcatttggattggatg

SEQ ID NO: 11476 - DNA, 22 bp, Artificial Sequence
  Target B2M Sequence complement
atgccgcatttggattggatga

SEQ ID NO: 11477 - DNA, 22 bp, Artificial Sequence
  Target B2M Sequence complement
tgccgcatttggattggatgaa

SEQ ID NO: 11478 - DNA, 22 bp, Artificial Sequence
  Target B2M Sequence complement
gccgcatttggattggatgaat

SEQ ID NO: 11479 - DNA, 22 bp, Artificial Sequence
  Target B2M Sequence complement
ccgcatttggattggatgaatt

SEQ ID NO: 11480 - DNA, 22 bp, Artificial Sequence
  Target B2M Sequence complement
cgcatttggattggatgaattc

SEQ ID NO: 11481 - DNA, 22 bp, Artificial Sequence
  Target B2M Sequence complement
gcatttggattggatgaattcc

SEQ ID NO: 11482 - DNA, 22 bp, Artificial Sequence
  Target B2M Sequence complement
catttggattggatgaattcca

SEQ ID NO: 11483 - DNA, 22 bp, Artificial Sequence
  Target B2M Sequence complement
atttggattggatgaattccaa

SEQ ID NO: 11484 - DNA, 22 bp, Artificial Sequence
  Target B2M Sequence complement
tttggattggatgaattccaaa

SEQ ID NO: 11485 - DNA, 22 bp, Artificial Sequence
  Target B2M Sequence complement
ttggattggatgaattccaaat

SEQ ID NO: 11486 - DNA, 22 bp, Artificial Sequence
  Target B2M Sequence complement
tggattggatgaattccaaatt

SEQ ID NO: 11487 - DNA, 22 bp, Artificial Sequence
  Target B2M Sequence complement
ggattggatgaattccaaattc

SEQ ID NO: 11488 - DNA, 22 bp, Artificial Sequence
  Target B2M Sequence complement
gattggatgaattccaaattct

SEQ ID NO: 11489 - DNA, 22 bp, Artificial Sequence
  Target B2M Sequence complement
attggatgaattccaaattctg

SEQ ID NO: 11490 - DNA, 22 bp, Artificial Sequence
  Target B2M Sequence complement
ttggatgaattccaaattctgc

SEQ ID NO: 11491 - DNA, 22 bp, Artificial Sequence
  Target B2M Sequence complement
tggatgaattccaaattctgct

SEQ ID NO: 11492 - DNA, 22 bp, Artificial Sequence
  Target B2M Sequence complement
ggatgaattccaaattctgctt

SEQ ID NO: 11493 - DNA, 22 bp, Artificial Sequence
  Target B2M Sequence complement
gatgaattccaaattctgcttg

SEQ ID NO: 11494 - DNA, 22 bp, Artificial Sequence
  Target B2M Sequence complement
atgaattccaaattctgcttgc

SEQ ID NO: 11495 - DNA, 22 bp, Artificial Sequence
  Target B2M Sequence complement
tgaattccaaattctgcttgct

SEQ ID NO: 11496 - DNA, 22 bp, Artificial Sequence
  Target B2M Sequence complement
gaattccaaattctgcttgctt

SEQ ID NO: 11497 - DNA, 22 bp, Artificial Sequence
  Target B2M Sequence complement
aattccaaattctgcttgcttg

SEQ ID NO: 11498 - DNA, 22 bp, Artificial Sequence
  Target B2M Sequence complement
attccaaattctgcttgcttgc

SEQ ID NO: 11499 - DNA, 22 bp, Artificial Sequence
  Target B2M Sequence complement
ttccaaattctgcttgcttgct

SEQ ID NO: 11500 - DNA, 22 bp, Artificial Sequence
  Target B2M Sequence complement
tccaaattctgcttgcttgctt

SEQ ID NO: 11501 - DNA, 22 bp, Artificial Sequence
  Target B2M Sequence complement
ccaaattctgcttgcttgcttt

SEQ ID NO: 11502 - DNA, 22 bp, Artificial Sequence
  Target B2M Sequence complement
attgatatgcttatacacttac

SEQ ID NO: 11503 - DNA, 22 bp, Artificial Sequence
  Target B2M Sequence complement
ttgatatgcttatacacttaca

SEQ ID NO: 11504 - DNA, 22 bp, Artificial Sequence
  Target B2M Sequence complement
tgatatgcttatacacttacac

SEQ ID NO: 11505 - DNA, 22 bp, Artificial Sequence
  Target B2M Sequence complement
gatatgcttatacacttacact

SEQ ID NO: 11506 - DNA, 22 bp, Artificial Sequence
  Target B2M Sequence complement
atatgcttatacacttacactt

SEQ ID NO: 11507 - DNA, 22 bp, Artificial Sequence
  Target B2M Sequence complement
tatgcttatacacttacacttt

SEQ ID NO: 11508 - DNA, 22 bp, Artificial Sequence
  Target B2M Sequence complement
atgcttatacacttacacttta

SEQ ID NO: 11509 - DNA, 22 bp, Artificial Sequence
  Target B2M Sequence complement
tgcttatacacttacactttat

SEQ ID NO: 11510 - DNA, 22 bp, Artificial Sequence
  Target B2M Sequence complement
gcttatacacttacactttatg

SEQ ID NO: 11511 - DNA, 22 bp, Artificial Sequence
  Target B2M Sequence complement
cttatacacttacactttatgc

SEQ ID NO: 11512 - DNA, 22 bp, Artificial Sequence
  Target B2M Sequence complement
ttatacacttacactttatgca

SEQ ID NO: 11513 - DNA, 22 bp, Artificial Sequence
  Target B2M Sequence complement
tatacacttacactttatgcac

SEQ ID NO: 11514 - DNA, 22 bp, Artificial Sequence
  Target B2M Sequence complement
atacacttacactttatgcaca

SEQ ID NO: 11515 - DNA, 22 bp, Artificial Sequence
  Target B2M Sequence complement
tacacttacactttatgcacaa

SEQ ID NO: 11516 - DNA, 22 bp, Artificial Sequence
  Target B2M Sequence complement
acacttacactttatgcacaaa

SEQ ID NO: 11517 - DNA, 22 bp, Artificial Sequence
  Target B2M Sequence complement
gtagggttataataatgttaac

SEQ ID NO: 11518 - DNA, 22 bp, Artificial Sequence
  Target B2M Sequence complement
gggttataataatgttaacatg

SEQ ID NO: 11519 - DNA, 22 bp, Artificial Sequence
  Target B2M Sequence complement
ggttataataatgttaacatgg

SEQ ID NO: 11520 - DNA, 22 bp, Artificial Sequence
  Target B2M Sequence complement
taataatgttaacatggacatg

SEQ ID NO: 11521 - DNA, 22 bp, Artificial Sequence
  Target B2M Sequence complement
aataatgttaacatggacatga

SEQ ID NO: 11522 - DNA, 22 bp, Artificial Sequence
  Target B2M Sequence complement
ataatgttaacatggacatgat

SEQ ID NO: 11523 - DNA, 22 bp, Artificial Sequence
  Target B2M Sequence complement
taatgttaacatggacatgatc

SEQ ID NO: 11524 - DNA, 22 bp, Artificial Sequence
  Target B2M Sequence complement
aatgttaacatggacatgatct

SEQ ID NO: 11525 - DNA, 22 bp, Artificial Sequence
  Target B2M Sequence complement
atgttaacatggacatgatctt

SEQ ID NO: 11526 - DNA, 22 bp, Artificial Sequence
  Target B2M Sequence complement
tgttaacatggacatgatcttc

SEQ ID NO: 11527 - DNA, 22 bp, Artificial Sequence
  Target B2M Sequence complement
gttaacatggacatgatcttct

SEQ ID NO: 11528 - DNA, 22 bp, Artificial Sequence
  Target B2M Sequence complement
ttaacatggacatgatcttctt

SEQ ID NO: 11529 - DNA, 22 bp, Artificial Sequence
  Target B2M Sequence complement
taacatggacatgatcttcttt

SEQ ID NO: 11530 - DNA, 22 bp, Artificial Sequence
  Target B2M Sequence complement
aacatggacatgatcttcttta

SEQ ID NO: 11531 - DNA, 22 bp, Artificial Sequence
  Target B2M Sequence complement
acatggacatgatcttctttat

SEQ ID NO: 11532 - DNA, 22 bp, Artificial Sequence
  Target B2M Sequence complement
catggacatgatcttctttata

SEQ ID NO: 11533 - DNA, 22 bp, Artificial Sequence
  Target B2M Sequence complement
atggacatgatcttctttataa

SEQ ID NO: 11534 - DNA, 22 bp, Artificial Sequence
  Target B2M Sequence complement
tggacatgatcttctttataat

SEQ ID NO: 11535 - DNA, 22 bp, Artificial Sequence
  Target B2M Sequence complement
ggacatgatcttctttataatt

SEQ ID NO: 11536 - DNA, 22 bp, Artificial Sequence
  Target B2M Sequence complement
gacatgatcttctttataattc

SEQ ID NO: 11537 - DNA, 22 bp, Artificial Sequence
  Target B2M Sequence complement
ctttataattctactttgagtg

SEQ ID NO: 11538 - DNA, 22 bp, Artificial Sequence
  Target B2M Sequence complement
tttataattctactttgagtgc

SEQ ID NO: 11539 - DNA, 22 bp, Artificial Sequence
  Target B2M Sequence complement
ttataattctactttgagtgct

SEQ ID NO: 11540 - DNA, 22 bp, Artificial Sequence
  Target B2M Sequence complement
tataattctactttgagtgctg

SEQ ID NO: 11541 - DNA, 22 bp, Artificial Sequence
  Target B2M Sequence complement
ataattctactttgagtgctgt

SEQ ID NO: 11542 - DNA, 22 bp, Artificial Sequence
  Target B2M Sequence complement
taattctactttgagtgctgtc

SEQ ID NO: 11543 - DNA, 22 bp, Artificial Sequence
  Target B2M Sequence complement
aattctactttgagtgctgtct

SEQ ID NO: 11544 - DNA, 22 bp, Artificial Sequence
  Target B2M Sequence complement
attctactttgagtgctgtctc

SEQ ID NO: 11545 - DNA, 22 bp, Artificial Sequence
  Target B2M Sequence complement
ttctactttgagtgctgtctcc

SEQ ID NO: 11546 - DNA, 22 bp, Artificial Sequence
  Target B2M Sequence complement
tctactttgagtgctgtctcca

SEQ ID NO: 11547 - DNA, 22 bp, Artificial Sequence
  Target B2M Sequence complement
ctactttgagtgctgtctccat

SEQ ID NO: 11548 - DNA, 22 bp, Artificial Sequence
  Target B2M Sequence complement
tactttgagtgctgtctccatg

SEQ ID NO: 11549 - DNA, 22 bp, Artificial Sequence
  Target B2M Sequence complement
actttgagtgctgtctccatgt

SEQ ID NO: 11550 - DNA, 22 bp, Artificial Sequence
  Target B2M Sequence complement
ctttgagtgctgtctccatgtt

SEQ ID NO: 11551 - DNA, 22 bp, Artificial Sequence
  Target B2M Sequence complement
tttgagtgctgtctccatgttt

SEQ ID NO: 11552 - DNA, 22 bp, Artificial Sequence
  Target B2M Sequence complement
ttgagtgctgtctccatgtttg

SEQ ID NO: 11553 - DNA, 22 bp, Artificial Sequence
  Target B2M Sequence complement
tgagtgctgtctccatgtttga

SEQ ID NO: 11554 - DNA, 22 bp, Artificial Sequence
  Target B2M Sequence complement
gagtgctgtctccatgtttgat

SEQ ID NO: 11555 - DNA, 22 bp, Artificial Sequence
  Target B2M Sequence complement
agtgctgtctccatgtttgatg

SEQ ID NO: 11556 - DNA, 22 bp, Artificial Sequence
  Target B2M Sequence complement
gtgctgtctccatgtttgatgt

SEQ ID NO: 11557 - DNA, 22 bp, Artificial Sequence
  Target B2M Sequence complement
tgctgtctccatgtttgatgta

SEQ ID NO: 11558 - DNA, 22 bp, Artificial Sequence
  Target B2M Sequence complement
gctgtctccatgtttgatgtat

SEQ ID NO: 11559 - DNA, 22 bp, Artificial Sequence
  Target B2M Sequence complement
ctgtctccatgtttgatgtatc

SEQ ID NO: 11560 - DNA, 22 bp, Artificial Sequence
  Target B2M Sequence complement
tgtctccatgtttgatgtatct

SEQ ID NO: 11561 - DNA, 22 bp, Artificial Sequence
  Target B2M Sequence complement
gtctccatgtttgatgtatctg

SEQ ID NO: 11562 - DNA, 22 bp, Artificial Sequence
  Target B2M Sequence complement
tctccatgtttgatgtatctga

SEQ ID NO: 11563 - DNA, 22 bp, Artificial Sequence
  Target B2M Sequence complement
ctccatgtttgatgtatctgag

SEQ ID NO: 11564 - DNA, 22 bp, Artificial Sequence
  Target B2M Sequence complement
tccatgtttgatgtatctgagc

SEQ ID NO: 11565 - DNA, 22 bp, Artificial Sequence
  Target B2M Sequence complement
ccatgtttgatgtatctgagca

SEQ ID NO: 11566 - DNA, 22 bp, Artificial Sequence
  Target B2M Sequence complement
catgtttgatgtatctgagcag

SEQ ID NO: 11567 - DNA, 22 bp, Artificial Sequence
  Target B2M Sequence complement
atgtttgatgtatctgagcagg

SEQ ID NO: 11568 - DNA, 22 bp, Artificial Sequence
  Target B2M Sequence complement
tgtttgatgtatctgagcaggt

SEQ ID NO: 11569 - DNA, 22 bp, Artificial Sequence
  Target B2M Sequence complement
gtttgatgtatctgagcaggtt

SEQ ID NO: 11570 - DNA, 22 bp, Artificial Sequence
  Target B2M Sequence complement
tttgatgtatctgagcaggttg

SEQ ID NO: 11571 - DNA, 22 bp, Artificial Sequence
  Target B2M Sequence complement
ttgatgtatctgagcaggttgc

SEQ ID NO: 11572 - DNA, 22 bp, Artificial Sequence
  Target B2M Sequence complement
tgatgtatctgagcaggttgct

SEQ ID NO: 11573 - DNA, 22 bp, Artificial Sequence
  Target B2M Sequence complement
gatgtatctgagcaggttgctc

SEQ ID NO: 11574 - DNA, 22 bp, Artificial Sequence
  Target B2M Sequence complement
atgtatctgagcaggttgctcc

SEQ ID NO: 11575 - DNA, 22 bp, Artificial Sequence
  Target B2M Sequence complement
tgtatctgagcaggttgctcca

SEQ ID NO: 11576 - DNA, 22 bp, Artificial Sequence
  Target B2M Sequence complement
gtatctgagcaggttgctccac

SEQ ID NO: 11577 - DNA, 22 bp, Artificial Sequence
  Target B2M Sequence complement
tatctgagcaggttgctccaca

SEQ ID NO: 11578 - DNA, 22 bp, Artificial Sequence
  Target B2M Sequence complement
atctgagcaggttgctccacag

SEQ ID NO: 11579 - DNA, 22 bp, Artificial Sequence
  Target B2M Sequence complement
tctgagcaggttgctccacagg

SEQ ID NO: 11580 - DNA, 22 bp, Artificial Sequence
  Target B2M Sequence complement
ctgagcaggttgctccacaggt

SEQ ID NO: 11581 - DNA, 22 bp, Artificial Sequence
  Target B2M Sequence complement
tgagcaggttgctccacaggta

SEQ ID NO: 11582 - DNA, 22 bp, Artificial Sequence
  Target B2M Sequence complement
gagcaggttgctccacaggtag

SEQ ID NO: 11583 - DNA, 22 bp, Artificial Sequence
  Target B2M Sequence complement
agcaggttgctccacaggtagc

SEQ ID NO: 11584 - DNA, 22 bp, Artificial Sequence
  Target B2M Sequence complement
gcaggttgctccacaggtagct

SEQ ID NO: 11585 - DNA, 22 bp, Artificial Sequence
  Target B2M Sequence complement
caggttgctccacaggtagctc

SEQ ID NO: 11586 - DNA, 22 bp, Artificial Sequence
  Target B2M Sequence complement
aggttgctccacaggtagctct

SEQ ID NO: 11587 - DNA, 22 bp, Artificial Sequence
  Target B2M Sequence complement
ggttgctccacaggtagctcta

SEQ ID NO: 11588 - DNA, 22 bp, Artificial Sequence
  Target B2M Sequence complement
gttgctccacaggtagctctag

SEQ ID NO: 11589 - DNA, 22 bp, Artificial Sequence
  Target B2M Sequence complement
ttgctccacaggtagctctagg

SEQ ID NO: 11590 - DNA, 22 bp, Artificial Sequence
  Target B2M Sequence complement
tgctccacaggtagctctagga

SEQ ID NO: 11591 - DNA, 22 bp, Artificial Sequence
  Target B2M Sequence complement
gctccacaggtagctctaggag

SEQ ID NO: 11592 - DNA, 22 bp, Artificial Sequence
  Target B2M Sequence complement
ctccacaggtagctctaggagg

SEQ ID NO: 11593 - DNA, 22 bp, Artificial Sequence
  Target B2M Sequence complement
tccacaggtagctctaggaggg

SEQ ID NO: 11594 - DNA, 22 bp, Artificial Sequence
  Target B2M Sequence complement
cacaggtagctctaggagggct

SEQ ID NO: 11595 - DNA, 22 bp, Artificial Sequence
  Target B2M Sequence complement
acaggtagctctaggagggctg

SEQ ID NO: 11596 - DNA, 22 bp, Artificial Sequence
  Target B2M Sequence complement
gtagctctaggagggctggcaa

SEQ ID NO: 11597 - DNA, 22 bp, Artificial Sequence
  Target B2M Sequence complement
tagctctaggagggctggcaac

SEQ ID NO: 11598 - DNA, 22 bp, Artificial Sequence
  Target B2M Sequence complement
agctctaggagggctggcaact

SEQ ID NO: 11599 - DNA, 22 bp, Artificial Sequence
  Target B2M Sequence complement
gctctaggagggctggcaactt

SEQ ID NO: 11600 - DNA, 22 bp, Artificial Sequence
  Target B2M Sequence complement
ctctaggagggctggcaactta

SEQ ID NO: 11601 - DNA, 22 bp, Artificial Sequence
  Target B2M Sequence complement
tctaggagggctggcaacttag

SEQ ID NO: 11602 - DNA, 22 bp, Artificial Sequence
  Target B2M Sequence complement
ctaggagggctggcaacttaga

SEQ ID NO: 11603 - DNA, 22 bp, Artificial Sequence
  Target B2M Sequence complement
taggagggctggcaacttagag

SEQ ID NO: 11604 - DNA, 22 bp, Artificial Sequence
  Target B2M Sequence complement
aggagggctggcaacttagagg

SEQ ID NO: 11605 - DNA, 22 bp, Artificial Sequence
  Target B2M Sequence complement
ggagggctggcaacttagaggt

SEQ ID NO: 11606 - DNA, 22 bp, Artificial Sequence
  Target B2M Sequence complement
gagggctggcaacttagaggtg

SEQ ID NO: 11607 - DNA, 22 bp, Artificial Sequence
  Target B2M Sequence complement
agggctggcaacttagaggtgg

SEQ ID NO: 11608 - DNA, 22 bp, Artificial Sequence
  Target B2M Sequence complement
gggagcagagaattctcttatc

SEQ ID NO: 11609 - DNA, 22 bp, Artificial Sequence
  Target B2M Sequence complement
ggagcagagaattctcttatcc

SEQ ID NO: 11610 - DNA, 22 bp, Artificial Sequence
  Target B2M Sequence complement
gagcagagaattctcttatcca

SEQ ID NO: 11611 - DNA, 22 bp, Artificial Sequence
  Target B2M Sequence complement
agcagagaattctcttatccaa

SEQ ID NO: 11612 - DNA, 22 bp, Artificial Sequence
  Target B2M Sequence complement
gcagagaattctcttatccaac

SEQ ID NO: 11613 - DNA, 22 bp, Artificial Sequence
  Target B2M Sequence complement
cagagaattctcttatccaaca

SEQ ID NO: 11614 - DNA, 22 bp, Artificial Sequence
  Target B2M Sequence complement
agagaattctcttatccaacat

SEQ ID NO: 11615 - DNA, 22 bp, Artificial Sequence
  Target B2M Sequence complement
gagaattctcttatccaacatc

SEQ ID NO: 11616 - DNA, 22 bp, Artificial Sequence
  Target B2M Sequence complement
agaattctcttatccaacatca

SEQ ID NO: 11617 - DNA, 22 bp, Artificial Sequence
  Target B2M Sequence complement
gaattctcttatccaacatcaa

SEQ ID NO: 11618 - DNA, 22 bp, Artificial Sequence
  Target B2M Sequence complement
aattctcttatccaacatcaac

SEQ ID NO: 11619 - DNA, 22 bp, Artificial Sequence
  Target B2M Sequence complement
attctcttatccaacatcaaca

SEQ ID NO: 11620 - DNA, 22 bp, Artificial Sequence
  Target B2M Sequence complement
ttctcttatccaacatcaacat

SEQ ID NO: 11621 - DNA, 22 bp, Artificial Sequence
  Target B2M Sequence complement
tctcttatccaacatcaacatc

SEQ ID NO: 11622 - DNA, 22 bp, Artificial Sequence
  Target B2M Sequence complement
ctcttatccaacatcaacatct

SEQ ID NO: 11623 - DNA, 22 bp, Artificial Sequence
  Target B2M Sequence complement
tcttatccaacatcaacatctt

SEQ ID NO: 11624 - DNA, 22 bp, Artificial Sequence
  Target B2M Sequence complement
cttatccaacatcaacatcttg

SEQ ID NO: 11625 - DNA, 22 bp, Artificial Sequence
  Target B2M Sequence complement
ttatccaacatcaacatcttgg

SEQ ID NO: 11626 - DNA, 22 bp, Artificial Sequence
  Target B2M Sequence complement
tatccaacatcaacatcttggt

SEQ ID NO: 11627 - DNA, 22 bp, Artificial Sequence
  Target B2M Sequence complement
atccaacatcaacatcttggtc

SEQ ID NO: 11628 - DNA, 22 bp, Artificial Sequence
  Target B2M Sequence complement
tccaacatcaacatcttggtca

SEQ ID NO: 11629 - DNA, 22 bp, Artificial Sequence
  Target B2M Sequence complement
ccaacatcaacatcttggtcag

SEQ ID NO: 11630 - DNA, 22 bp, Artificial Sequence
  Target B2M Sequence complement
caacatcaacatcttggtcaga

SEQ ID NO: 11631 - DNA, 22 bp, Artificial Sequence
  Target B2M Sequence complement
aacatcaacatcttggtcagat

SEQ ID NO: 11632 - DNA, 22 bp, Artificial Sequence
  Target B2M Sequence complement
acatcaacatcttggtcagatt

SEQ ID NO: 11633 - DNA, 22 bp, Artificial Sequence
  Target B2M Sequence complement
catcaacatcttggtcagattt

SEQ ID NO: 11634 - DNA, 22 bp, Artificial Sequence
  Target B2M Sequence complement
atcaacatcttggtcagatttg

SEQ ID NO: 11635 - DNA, 22 bp, Artificial Sequence
  Target B2M Sequence complement
tcaacatcttggtcagatttga

SEQ ID NO: 11636 - DNA, 22 bp, Artificial Sequence
  Target B2M Sequence complement
caacatcttggtcagatttgaa

SEQ ID NO: 11637 - DNA, 22 bp, Artificial Sequence
  Target B2M Sequence complement
aacatcttggtcagatttgaac

SEQ ID NO: 11638 - DNA, 22 bp, Artificial Sequence
  Target B2M Sequence complement
acatcttggtcagatttgaact

SEQ ID NO: 11639 - DNA, 22 bp, Artificial Sequence
  Target B2M Sequence complement
catcttggtcagatttgaactc

SEQ ID NO: 11640 - DNA, 22 bp, Artificial Sequence
  Target B2M Sequence complement
atcttggtcagatttgaactct

SEQ ID NO: 11641 - DNA, 22 bp, Artificial Sequence
  Target B2M Sequence complement
tcttggtcagatttgaactctt

SEQ ID NO: 11642 - DNA, 22 bp, Artificial Sequence
  Target B2M Sequence complement
cttggtcagatttgaactcttc

SEQ ID NO: 11643 - DNA, 22 bp, Artificial Sequence
  Target B2M Sequence complement
ttggtcagatttgaactcttca

SEQ ID NO: 11644 - DNA, 22 bp, Artificial Sequence
  Target B2M Sequence complement
tggtcagatttgaactcttcaa

SEQ ID NO: 11645 - DNA, 22 bp, Artificial Sequence
  Target B2M Sequence complement
ggtcagatttgaactcttcaat

SEQ ID NO: 11646 - DNA, 22 bp, Artificial Sequence
  Target B2M Sequence complement
gtcagatttgaactcttcaatc

SEQ ID NO: 11647 - DNA, 22 bp, Artificial Sequence
  Target B2M Sequence complement
tcagatttgaactcttcaatct

SEQ ID NO: 11648 - DNA, 22 bp, Artificial Sequence
  Target B2M Sequence complement
cagatttgaactcttcaatctc

SEQ ID NO: 11649 - DNA, 22 bp, Artificial Sequence
  Target B2M Sequence complement
agatttgaactcttcaatctct

SEQ ID NO: 11650 - DNA, 22 bp, Artificial Sequence
  Target B2M Sequence complement
gatttgaactcttcaatctctt

SEQ ID NO: 11651 - DNA, 22 bp, Artificial Sequence
  Target B2M Sequence complement
atttgaactcttcaatctcttg

SEQ ID NO: 11652 - DNA, 22 bp, Artificial Sequence
  Target B2M Sequence complement
tttgaactcttcaatctcttgc

SEQ ID NO: 11653 - DNA, 22 bp, Artificial Sequence
  Target B2M Sequence complement
ttgaactcttcaatctcttgca

SEQ ID NO: 11654 - DNA, 22 bp, Artificial Sequence
  Target B2M Sequence complement
tgaactcttcaatctcttgcac

SEQ ID NO: 11655 - DNA, 22 bp, Artificial Sequence
  Target B2M Sequence complement
gaactcttcaatctcttgcact

SEQ ID NO: 11656 - DNA, 22 bp, Artificial Sequence
  Target B2M Sequence complement
aactcttcaatctcttgcactc

SEQ ID NO: 11657 - DNA, 22 bp, Artificial Sequence
  Target B2M Sequence complement
actcttcaatctcttgcactca

SEQ ID NO: 11658 - DNA, 22 bp, Artificial Sequence
  Target B2M Sequence complement
ctcttcaatctcttgcactcaa

SEQ ID NO: 11659 - DNA, 22 bp, Artificial Sequence
  Target B2M Sequence complement
tcttcaatctcttgcactcaaa

SEQ ID NO: 11660 - DNA, 22 bp, Artificial Sequence
  Target B2M Sequence complement
cttcaatctcttgcactcaaag

SEQ ID NO: 11661 - DNA, 22 bp, Artificial Sequence
  Target B2M Sequence complement
ttcaatctcttgcactcaaagc

SEQ ID NO: 11662 - DNA, 22 bp, Artificial Sequence
  Target B2M Sequence complement
tcaatctcttgcactcaaagct

SEQ ID NO: 11663 - DNA, 22 bp, Artificial Sequence
  Target B2M Sequence complement
caatctcttgcactcaaagctt

SEQ ID NO: 11664 - DNA, 22 bp, Artificial Sequence
  Target B2M Sequence complement
aatctcttgcactcaaagcttg

SEQ ID NO: 11665 - DNA, 22 bp, Artificial Sequence
  Target B2M Sequence complement
atctcttgcactcaaagcttgt

SEQ ID NO: 11666 - DNA, 22 bp, Artificial Sequence
  Target B2M Sequence complement
tctcttgcactcaaagcttgtt

SEQ ID NO: 11667 - DNA, 22 bp, Artificial Sequence
  Target B2M Sequence complement
ctcttgcactcaaagcttgtta

SEQ ID NO: 11668 - DNA, 22 bp, Artificial Sequence
  Target B2M Sequence complement
tcttgcactcaaagcttgttaa

SEQ ID NO: 11669 - DNA, 22 bp, Artificial Sequence
  Target B2M Sequence complement
cttgcactcaaagcttgttaag

SEQ ID NO: 11670 - DNA, 22 bp, Artificial Sequence
  Target B2M Sequence complement
ttgcactcaaagcttgttaaga

SEQ ID NO: 11671 - DNA, 22 bp, Artificial Sequence
  Target B2M Sequence complement
tgcactcaaagcttgttaagat

SEQ ID NO: 11672 - DNA, 22 bp, Artificial Sequence
  Target B2M Sequence complement
gcactcaaagcttgttaagata

SEQ ID NO: 11673 - DNA, 22 bp, Artificial Sequence
  Target B2M Sequence complement
cactcaaagcttgttaagatag

SEQ ID NO: 11674 - DNA, 22 bp, Artificial Sequence
  Target B2M Sequence complement
actcaaagcttgttaagatagt

SEQ ID NO: 11675 - DNA, 22 bp, Artificial Sequence
  Target B2M Sequence complement
ctcaaagcttgttaagatagtt

SEQ ID NO: 11676 - DNA, 22 bp, Artificial Sequence
  Target B2M Sequence complement
tcaaagcttgttaagatagtta

SEQ ID NO: 11677 - DNA, 22 bp, Artificial Sequence
  Target B2M Sequence complement
caaagcttgttaagatagttaa

SEQ ID NO: 11678 - DNA, 22 bp, Artificial Sequence
  Target B2M Sequence complement
aaagcttgttaagatagttaag

SEQ ID NO: 11679 - DNA, 22 bp, Artificial Sequence
  Target B2M Sequence complement
aagcttgttaagatagttaagc

SEQ ID NO: 11680 - DNA, 22 bp, Artificial Sequence
  Target B2M Sequence complement
agcttgttaagatagttaagcg

SEQ ID NO: 11681 - DNA, 22 bp, Artificial Sequence
  Target B2M Sequence complement
gcttgttaagatagttaagcgt

SEQ ID NO: 11682 - DNA, 22 bp, Artificial Sequence
  Target B2M Sequence complement
cttgttaagatagttaagcgtg

SEQ ID NO: 11683 - DNA, 22 bp, Artificial Sequence
  Target B2M Sequence complement
ttgttaagatagttaagcgtgc

SEQ ID NO: 11684 - DNA, 22 bp, Artificial Sequence
  Target B2M Sequence complement
tgttaagatagttaagcgtgca

SEQ ID NO: 11685 - DNA, 22 bp, Artificial Sequence
  Target B2M Sequence complement
gttaagatagttaagcgtgcat

SEQ ID NO: 11686 - DNA, 22 bp, Artificial Sequence
  Target B2M Sequence complement
ttaagatagttaagcgtgcata

SEQ ID NO: 11687 - DNA, 22 bp, Artificial Sequence
  Target B2M Sequence complement
taagatagttaagcgtgcataa

SEQ ID NO: 11688 - DNA, 22 bp, Artificial Sequence
  Target B2M Sequence complement
aagatagttaagcgtgcataag

SEQ ID NO: 11689 - DNA, 22 bp, Artificial Sequence
  Target B2M Sequence complement
agatagttaagcgtgcataagt

SEQ ID NO: 11690 - DNA, 22 bp, Artificial Sequence
  Target B2M Sequence complement
gatagttaagcgtgcataagtt

SEQ ID NO: 11691 - DNA, 22 bp, Artificial Sequence
  Target B2M Sequence complement
atagttaagcgtgcataagtta

SEQ ID NO: 11692 - DNA, 22 bp, Artificial Sequence
  Target B2M Sequence complement
tagttaagcgtgcataagttaa

SEQ ID NO: 11693 - DNA, 22 bp, Artificial Sequence
  Target B2M Sequence complement
agttaagcgtgcataagttaac

SEQ ID NO: 11694 - DNA, 22 bp, Artificial Sequence
  Target B2M Sequence complement
gttaagcgtgcataagttaact

SEQ ID NO: 11695 - DNA, 22 bp, Artificial Sequence
  Target B2M Sequence complement
ttaagcgtgcataagttaactt

SEQ ID NO: 11696 - DNA, 22 bp, Artificial Sequence
  Target B2M Sequence complement
taagcgtgcataagttaacttc

SEQ ID NO: 11697 - DNA, 22 bp, Artificial Sequence
  Target B2M Sequence complement
aagcgtgcataagttaacttcc

SEQ ID NO: 11698 - DNA, 22 bp, Artificial Sequence
  Target B2M Sequence complement
agcgtgcataagttaacttcca

SEQ ID NO: 11699 - DNA, 22 bp, Artificial Sequence
  Target B2M Sequence complement
gcgtgcataagttaacttccaa

SEQ ID NO: 11700 - DNA, 22 bp, Artificial Sequence
  Target B2M Sequence complement
cgtgcataagttaacttccaat

SEQ ID NO: 11701 - DNA, 22 bp, Artificial Sequence
  Target B2M Sequence complement
gtgcataagttaacttccaatt

SEQ ID NO: 11702 - DNA, 22 bp, Artificial Sequence
  Target B2M Sequence complement
tgcataagttaacttccaattt

SEQ ID NO: 11703 - DNA, 22 bp, Artificial Sequence
  Target B2M Sequence complement
gcataagttaacttccaattta

SEQ ID NO: 11704 - DNA, 22 bp, Artificial Sequence
  Target B2M Sequence complement
cataagttaacttccaatttac

SEQ ID NO: 11705 - DNA, 22 bp, Artificial Sequence
  Target B2M Sequence complement
agttaacttccaatttacatac

SEQ ID NO: 11706 - DNA, 22 bp, Artificial Sequence
  Target B2M Sequence complement
gttaacttccaatttacatact

SEQ ID NO: 11707 - DNA, 22 bp, Artificial Sequence
  Target B2M Sequence complement
ttaacttccaatttacatactc

SEQ ID NO: 11708 - DNA, 22 bp, Artificial Sequence
  Target B2M Sequence complement
taacttccaatttacatactct

SEQ ID NO: 11709 - DNA, 22 bp, Artificial Sequence
  Target B2M Sequence complement
aacttccaatttacatactctg

SEQ ID NO: 11710 - DNA, 22 bp, Artificial Sequence
  Target B2M Sequence complement
acttccaatttacatactctgc

SEQ ID NO: 11711 - DNA, 22 bp, Artificial Sequence
  Target B2M Sequence complement
cttccaatttacatactctgct

SEQ ID NO: 11712 - DNA, 22 bp, Artificial Sequence
  Target B2M Sequence complement
ttccaatttacatactctgctt

SEQ ID NO: 11713 - DNA, 22 bp, Artificial Sequence
  Target B2M Sequence complement
tccaatttacatactctgctta

SEQ ID NO: 11714 - DNA, 22 bp, Artificial Sequence
  Target B2M Sequence complement
ccaatttacatactctgcttag

SEQ ID NO: 11715 - DNA, 22 bp, Artificial Sequence
  Target B2M Sequence complement
caatttacatactctgcttaga

SEQ ID NO: 11716 - DNA, 22 bp, Artificial Sequence
  Target B2M Sequence complement
aatttacatactctgcttagaa

SEQ ID NO: 11717 - DNA, 22 bp, Artificial Sequence
  Target B2M Sequence complement
atttacatactctgcttagaat

SEQ ID NO: 11718 - DNA, 22 bp, Artificial Sequence
  Target B2M Sequence complement
tttacatactctgcttagaatt

SEQ ID NO: 11719 - DNA, 22 bp, Artificial Sequence
  Target B2M Sequence complement
ttacatactctgcttagaattt

SEQ ID NO: 11720 - DNA, 22 bp, Artificial Sequence
  Target B2M Sequence complement
tacatactctgcttagaatttg

SEQ ID NO: 11721 - DNA, 22 bp, Artificial Sequence
  Target B2M Sequence complement
acatactctgcttagaatttgg

SEQ ID NO: 11722 - DNA, 22 bp, Artificial Sequence
  Target B2M Sequence complement
catactctgcttagaatttggg

SEQ ID NO: 11723 - DNA, 22 bp, Artificial Sequence
  Target B2M Sequence complement
atataattgacaggattattgg

SEQ ID NO: 11724 - DNA, 22 bp, Artificial Sequence
  Target B2M Sequence complement
tataattgacaggattattgga

SEQ ID NO: 11725 - DNA, 22 bp, Artificial Sequence
  Target B2M Sequence complement
ataattgacaggattattggaa

SEQ ID NO: 11726 - DNA, 22 bp, Artificial Sequence
  Target B2M Sequence complement
taattgacaggattattggaaa

SEQ ID NO: 11727 - DNA, 22 bp, Artificial Sequence
  Target B2M Sequence complement
aattgacaggattattggaaat

SEQ ID NO: 11728 - DNA, 22 bp, Artificial Sequence
  Target B2M Sequence complement
attgacaggattattggaaatt

SEQ ID NO: 11729 - DNA, 22 bp, Artificial Sequence
  Target B2M Sequence complement
ttgacaggattattggaaattt

SEQ ID NO: 11730 - DNA, 22 bp, Artificial Sequence
  Target B2M Sequence complement
tgacaggattattggaaatttg

SEQ ID NO: 11731 - DNA, 22 bp, Artificial Sequence
  Target B2M Sequence complement
gacaggattattggaaatttgt

SEQ ID NO: 11732 - DNA, 22 bp, Artificial Sequence
  Target B2M Sequence complement
acaggattattggaaatttgtt

SEQ ID NO: 11733 - DNA, 22 bp, Artificial Sequence
  Target B2M Sequence complement
caggattattggaaatttgtta

SEQ ID NO: 11734 - DNA, 22 bp, Artificial Sequence
  Target B2M Sequence complement
tatacatttgataaagtaaggc

SEQ ID NO: 11735 - DNA, 22 bp, Artificial Sequence
  Target B2M Sequence complement
atacatttgataaagtaaggca

SEQ ID NO: 11736 - DNA, 22 bp, Artificial Sequence
  Target B2M Sequence complement
tacatttgataaagtaaggcat

SEQ ID NO: 11737 - DNA, 22 bp, Artificial Sequence
  Target B2M Sequence complement
acatttgataaagtaaggcatg

SEQ ID NO: 11738 - DNA, 22 bp, Artificial Sequence
  Target B2M Sequence complement
catttgataaagtaaggcatgg

SEQ ID NO: 11739 - DNA, 22 bp, Artificial Sequence
  Target B2M Sequence complement
atttgataaagtaaggcatggt

SEQ ID NO: 11740 - DNA, 22 bp, Artificial Sequence
  Target B2M Sequence complement
tttgataaagtaaggcatggtt

SEQ ID NO: 11741 - DNA, 22 bp, Artificial Sequence
  Target B2M Sequence complement
ttgataaagtaaggcatggttg

SEQ ID NO: 11742 - DNA, 22 bp, Artificial Sequence
  Target B2M Sequence complement
tgataaagtaaggcatggttgt

SEQ ID NO: 11743 - DNA, 22 bp, Artificial Sequence
  Target B2M Sequence complement
gataaagtaaggcatggttgtg

SEQ ID NO: 11744 - DNA, 22 bp, Artificial Sequence
  Target B2M Sequence complement
ataaagtaaggcatggttgtgg

SEQ ID NO: 11745 - DNA, 22 bp, Artificial Sequence
  Target B2M Sequence complement
taaagtaaggcatggttgtggt

SEQ ID NO: 11746 - DNA, 22 bp, Artificial Sequence
  Target B2M Sequence complement
aaagtaaggcatggttgtggtt

SEQ ID NO: 11747 - DNA, 22 bp, Artificial Sequence
  Target B2M Sequence complement
aagtaaggcatggttgtggtta

SEQ ID NO: 11748 - DNA, 22 bp, Artificial Sequence
  Target B2M Sequence complement
agtaaggcatggttgtggttaa

SEQ ID NO: 11749 - DNA, 22 bp, Artificial Sequence
  Target B2M Sequence complement
gtaaggcatggttgtggttaat

SEQ ID NO: 11750 - DNA, 22 bp, Artificial Sequence
  Target B2M Sequence complement
taaggcatggttgtggttaatc

SEQ ID NO: 11751 - DNA, 22 bp, Artificial Sequence
  Target B2M Sequence complement
aaggcatggttgtggttaatct

SEQ ID NO: 11752 - DNA, 22 bp, Artificial Sequence
  Target B2M Sequence complement
aggcatggttgtggttaatctg

SEQ ID NO: 11753 - DNA, 22 bp, Artificial Sequence
  Target B2M Sequence complement
ggcatggttgtggttaatctgg

SEQ ID NO: 11754 - DNA, 22 bp, Artificial Sequence
  Target B2M Sequence complement
gcatggttgtggttaatctggt

SEQ ID NO: 11755 - DNA, 22 bp, Artificial Sequence
  Target B2M Sequence complement
catggttgtggttaatctggtt

SEQ ID NO: 11756 - DNA, 22 bp, Artificial Sequence
  Target B2M Sequence complement
atggttgtggttaatctggttt

SEQ ID NO: 11757 - DNA, 22 bp, Artificial Sequence
  Target B2M Sequence complement
tggttgtggttaatctggttta

SEQ ID NO: 11758 - DNA, 22 bp, Artificial Sequence
  Target B2M Sequence complement
ggttgtggttaatctggtttat

SEQ ID NO: 11759 - DNA, 22 bp, Artificial Sequence
  Target B2M Sequence complement
gttgtggttaatctggtttatt

SEQ ID NO: 11760 - DNA, 22 bp, Artificial Sequence
  Target B2M Sequence complement
ttgtggttaatctggtttattt

SEQ ID NO: 11761 - DNA, 22 bp, Artificial Sequence
  Target B2M Sequence complement
tgttccacaagttaaataaatc

SEQ ID NO: 11762 - DNA, 22 bp, Artificial Sequence
  Target B2M Sequence complement
gttccacaagttaaataaatca

SEQ ID NO: 11763 - DNA, 18 bp, Artificial Sequence
  Target B2M Sequence complement
attcgggccgagatgtct

SEQ ID NO: 11764 - DNA, 18 bp, Artificial Sequence
  Target B2M Sequence complement
tggagagagaattgaaaa

SEQ ID NO: 11765 - DNA, 18 bp, Artificial Sequence
  Target B2M Sequence complement
ggagagagaattgaaaaa

SEQ ID NO: 11766 - DNA, 18 bp, Artificial Sequence
  Target B2M Sequence complement
gagagagaattgaaaaag

SEQ ID NO: 11767 - DNA, 18 bp, Artificial Sequence
  Target B2M Sequence complement
agagagaattgaaaaagt

SEQ ID NO: 11768 - DNA, 18 bp, Artificial Sequence
  Target B2M Sequence complement
gagagaattgaaaaagtg

SEQ ID NO: 11769 - DNA, 18 bp, Artificial Sequence
  Target B2M Sequence complement
agagaattgaaaaagtgg

SEQ ID NO: 11770 - DNA, 18 bp, Artificial Sequence
  Target B2M Sequence complement
gagaattgaaaaagtgga

SEQ ID NO: 11771 - DNA, 18 bp, Artificial Sequence
  Target B2M Sequence complement
agaattgaaaaagtggag

SEQ ID NO: 11772 - DNA, 18 bp, Artificial Sequence
  Target B2M Sequence complement
gaattgaaaaagtggagc

SEQ ID NO: 11773 - DNA, 18 bp, Artificial Sequence
  Target B2M Sequence complement
aattgaaaaagtggagca

SEQ ID NO: 11774 - DNA, 18 bp, Artificial Sequence
  Target B2M Sequence complement
attgaaaaagtggagcat

SEQ ID NO: 11775 - DNA, 18 bp, Artificial Sequence
  Target B2M Sequence complement
ttgaaaaagtggagcatt

SEQ ID NO: 11776 - DNA, 18 bp, Artificial Sequence
  Target B2M Sequence complement
tgaaaaagtggagcattc

SEQ ID NO: 11777 - DNA, 18 bp, Artificial Sequence
  Target B2M Sequence complement
gaaaaagtggagcattca

SEQ ID NO: 11778 - DNA, 18 bp, Artificial Sequence
  Target B2M Sequence complement
aaaaagtggagcattcag

SEQ ID NO: 11779 - DNA, 18 bp, Artificial Sequence
  Target B2M Sequence complement
aaaagtggagcattcaga

SEQ ID NO: 11780 - DNA, 18 bp, Artificial Sequence
  Target B2M Sequence complement
ctacactgaattcacccc

SEQ ID NO: 11781 - DNA, 18 bp, Artificial Sequence
  Target B2M Sequence complement
tacactgaattcaccccc

SEQ ID NO: 11782 - DNA, 18 bp, Artificial Sequence
  Target B2M Sequence complement
acactgaattcaccccca

SEQ ID NO: 11783 - DNA, 18 bp, Artificial Sequence
  Target B2M Sequence complement
cactgaattcacccccac

SEQ ID NO: 11784 - DNA, 18 bp, Artificial Sequence
  Target B2M Sequence complement
actgaattcacccccact

SEQ ID NO: 11785 - DNA, 18 bp, Artificial Sequence
  Target B2M Sequence complement
ctgaattcacccccactg

SEQ ID NO: 11786 - DNA, 18 bp, Artificial Sequence
  Target B2M Sequence complement
tgaattcacccccactga

SEQ ID NO: 11787 - DNA, 18 bp, Artificial Sequence
  Target B2M Sequence complement
gaattcacccccactgaa

SEQ ID NO: 11788 - DNA, 18 bp, Artificial Sequence
  Target B2M Sequence complement
aattcacccccactgaaa

SEQ ID NO: 11789 - DNA, 18 bp, Artificial Sequence
  Target B2M Sequence complement
attcacccccactgaaaa

SEQ ID NO: 11790 - DNA, 18 bp, Artificial Sequence
  Target B2M Sequence complement
ttcacccccactgaaaaa

SEQ ID NO: 11791 - DNA, 18 bp, Artificial Sequence
  Target B2M Sequence complement
tcacccccactgaaaaag

SEQ ID NO: 11792 - DNA, 18 bp, Artificial Sequence
  Target B2M Sequence complement
cacccccactgaaaaaga

SEQ ID NO: 11793 - DNA, 18 bp, Artificial Sequence
  Target B2M Sequence complement
acccccactgaaaaagat

SEQ ID NO: 11794 - DNA, 18 bp, Artificial Sequence
  Target B2M Sequence complement
cccccactgaaaaagatg

SEQ ID NO: 11795 - DNA, 18 bp, Artificial Sequence
  Target B2M Sequence complement
ccccactgaaaaagatga

SEQ ID NO: 11796 - DNA, 18 bp, Artificial Sequence
  Target B2M Sequence complement
cccactgaaaaagatgag

SEQ ID NO: 11797 - DNA, 18 bp, Artificial Sequence
  Target B2M Sequence complement
ccactgaaaaagatgagt

SEQ ID NO: 11798 - DNA, 18 bp, Artificial Sequence
  Target B2M Sequence complement
cactgaaaaagatgagta

SEQ ID NO: 11799 - DNA, 18 bp, Artificial Sequence
  Target B2M Sequence complement
actgaaaaagatgagtat

SEQ ID NO: 11800 - DNA, 18 bp, Artificial Sequence
  Target B2M Sequence complement
ctgaaaaagatgagtatg

SEQ ID NO: 11801 - DNA, 18 bp, Artificial Sequence
  Target B2M Sequence complement
tgaaaaagatgagtatgc

SEQ ID NO: 11802 - DNA, 18 bp, Artificial Sequence
  Target B2M Sequence complement
gaaaaagatgagtatgcc

SEQ ID NO: 11803 - DNA, 18 bp, Artificial Sequence
  Target B2M Sequence complement
aaaaagatgagtatgcct

SEQ ID NO: 11804 - DNA, 18 bp, Artificial Sequence
  Target B2M Sequence complement
aaaagatgagtatgcctg

SEQ ID NO: 11805 - DNA, 18 bp, Artificial Sequence
  Target B2M Sequence complement
ttctgcttgcttgctttt

SEQ ID NO: 11806 - DNA, 18 bp, Artificial Sequence
  Target B2M Sequence complement
tctgcttgcttgcttttt

SEQ ID NO: 11807 - DNA, 18 bp, Artificial Sequence
  Target B2M Sequence complement
ctgcttgcttgcttttta

SEQ ID NO: 11808 - DNA, 18 bp, Artificial Sequence
  Target B2M Sequence complement
tgcttgcttgctttttaa

SEQ ID NO: 11809 - DNA, 18 bp, Artificial Sequence
  Target B2M Sequence complement
gcttgcttgctttttaat

SEQ ID NO: 11810 - DNA, 18 bp, Artificial Sequence
  Target B2M Sequence complement
cttgcttgctttttaata

SEQ ID NO: 11811 - DNA, 18 bp, Artificial Sequence
  Target B2M Sequence complement
gcttgctttttaatattg

SEQ ID NO: 11812 - DNA, 18 bp, Artificial Sequence
  Target B2M Sequence complement
tacactttatgcacaaaa

SEQ ID NO: 11813 - DNA, 18 bp, Artificial Sequence
  Target B2M Sequence complement
acactttatgcacaaaat

SEQ ID NO: 11814 - DNA, 18 bp, Artificial Sequence
  Target B2M Sequence complement
cactttatgcacaaaatg

SEQ ID NO: 11815 - DNA, 18 bp, Artificial Sequence
  Target B2M Sequence complement
actttatgcacaaaatgt

SEQ ID NO: 11816 - DNA, 18 bp, Artificial Sequence
  Target B2M Sequence complement
ctttatgcacaaaatgta

SEQ ID NO: 11817 - DNA, 18 bp, Artificial Sequence
  Target B2M Sequence complement
tttatgcacaaaatgtag

SEQ ID NO: 11818 - DNA, 18 bp, Artificial Sequence
  Target B2M Sequence complement
ttatgcacaaaatgtagg

SEQ ID NO: 11819 - DNA, 18 bp, Artificial Sequence
  Target B2M Sequence complement
tatgcacaaaatgtaggg

SEQ ID NO: 11820 - DNA, 18 bp, Artificial Sequence
  Target B2M Sequence complement
atgcacaaaatgtagggt

SEQ ID NO: 11821 - DNA, 18 bp, Artificial Sequence
  Target B2M Sequence complement
tgcacaaaatgtagggtt

SEQ ID NO: 11822 - DNA, 18 bp, Artificial Sequence
  Target B2M Sequence complement
gcacaaaatgtagggtta

SEQ ID NO: 11823 - DNA, 18 bp, Artificial Sequence
  Target B2M Sequence complement
cacaaaatgtagggttat

SEQ ID NO: 11824 - DNA, 18 bp, Artificial Sequence
  Target B2M Sequence complement
acaaaatgtagggttata

SEQ ID NO: 11825 - DNA, 18 bp, Artificial Sequence
  Target B2M Sequence complement
caaaatgtagggttataa

SEQ ID NO: 11826 - DNA, 18 bp, Artificial Sequence
  Target B2M Sequence complement
gcaacttagaggtgggga

SEQ ID NO: 11827 - DNA, 18 bp, Artificial Sequence
  Target B2M Sequence complement
caacttagaggtggggag

SEQ ID NO: 11828 - DNA, 18 bp, Artificial Sequence
  Target B2M Sequence complement
aacttagaggtggggagc

SEQ ID NO: 11829 - DNA, 18 bp, Artificial Sequence
  Target B2M Sequence complement
acttagaggtggggagca

SEQ ID NO: 11830 - DNA, 18 bp, Artificial Sequence
  Target B2M Sequence complement
ttagaggtggggagcaga

SEQ ID NO: 11831 - DNA, 18 bp, Artificial Sequence
  Target B2M Sequence complement
aggtggggagcagagaat

SEQ ID NO: 11832 - DNA, 18 bp, Artificial Sequence
  Target B2M Sequence complement
ggtggggagcagagaatt

SEQ ID NO: 11833 - DNA, 18 bp, Artificial Sequence
  Target B2M Sequence complement
gtggggagcagagaattc

SEQ ID NO: 11834 - DNA, 18 bp, Artificial Sequence
  Target B2M Sequence complement
tggggagcagagaattct

SEQ ID NO: 11835 - DNA, 18 bp, Artificial Sequence
  Target B2M Sequence complement
ggggagcagagaattctc

SEQ ID NO: 11836 - DNA, 18 bp, Artificial Sequence
  Target B2M Sequence complement
tctgcttagaatttgggg

SEQ ID NO: 11837 - DNA, 18 bp, Artificial Sequence
  Target B2M Sequence complement
ctgcttagaatttggggg

SEQ ID NO: 11838 - DNA, 18 bp, Artificial Sequence
  Target B2M Sequence complement
tgcttagaatttggggga

SEQ ID NO: 11839 - DNA, 18 bp, Artificial Sequence
  Target B2M Sequence complement
gcttagaatttgggggaa

SEQ ID NO: 11840 - DNA, 18 bp, Artificial Sequence
  Target B2M Sequence complement
cttagaatttgggggaaa

SEQ ID NO: 11841 - DNA, 18 bp, Artificial Sequence
  Target B2M Sequence complement
ttagaatttgggggaaaa

SEQ ID NO: 11842 - DNA, 18 bp, Artificial Sequence
  Target B2M Sequence complement
tagaatttgggggaaaat

SEQ ID NO: 11843 - DNA, 18 bp, Artificial Sequence
  Target B2M Sequence complement
agaatttgggggaaaatt

SEQ ID NO: 11844 - DNA, 18 bp, Artificial Sequence
  Target B2M Sequence complement
gaatttgggggaaaattt

SEQ ID NO: 11845 - DNA, 18 bp, Artificial Sequence
  Target B2M Sequence complement
aatttgggggaaaattta

SEQ ID NO: 11846 - DNA, 18 bp, Artificial Sequence
  Target B2M Sequence complement
atttgggggaaaatttag

SEQ ID NO: 11847 - DNA, 18 bp, Artificial Sequence
  Target B2M Sequence complement
tttgggggaaaatttaga

SEQ ID NO: 11848 - DNA, 18 bp, Artificial Sequence
  Target B2M Sequence complement
ttgggggaaaatttagaa

SEQ ID NO: 11849 - DNA, 18 bp, Artificial Sequence
  Target B2M Sequence complement
tgggggaaaatttagaaa

SEQ ID NO: 11850 - DNA, 18 bp, Artificial Sequence
  Target B2M Sequence complement
gggggaaaatttagaaat

SEQ ID NO: 11851 - DNA, 18 bp, Artificial Sequence
  Target B2M Sequence complement
ggggaaaatttagaaata

SEQ ID NO: 11852 - DNA, 18 bp, Artificial Sequence
  Target B2M Sequence complement
tgaatgaaacattttgtc

SEQ ID NO: 11853 - DNA, 18 bp, Artificial Sequence
  Target B2M Sequence complement
gaatgaaacattttgtca

SEQ ID NO: 11854 - DNA, 18 bp, Artificial Sequence
  Target B2M Sequence complement
tctggtttatttttgttc

SEQ ID NO: 11855 - DNA, 18 bp, Artificial Sequence
  Target B2M Sequence complement
ctggtttatttttgttcc

SEQ ID NO: 11856 - DNA, 18 bp, Artificial Sequence
  Target B2M Sequence complement
tggtttatttttgttcca

SEQ ID NO: 11857 - DNA, 18 bp, Artificial Sequence
  Target B2M Sequence complement
ggtttatttttgttccac

SEQ ID NO: 11858 - DNA, 18 bp, Artificial Sequence
  Target B2M Sequence complement
gtttatttttgttccaca

SEQ ID NO: 11859 - DNA, 18 bp, Artificial Sequence
  Target B2M Sequence complement
ttatttttgttccacaag

SEQ ID NO: 11860 - DNA, 18 bp, Artificial Sequence
  Target B2M Sequence complement
tatttttgttccacaagt

SEQ ID NO: 11861 - DNA, 18 bp, Artificial Sequence
  Target B2M Sequence complement
atttttgttccacaagtt

SEQ ID NO: 11862 - DNA, 18 bp, Artificial Sequence
  Target B2M Sequence complement
tttttgttccacaagtta

SEQ ID NO: 11863 - DNA, 18 bp, Artificial Sequence
  Target B2M Sequence complement
ttttgttccacaagttaa

SEQ ID NO: 11864 - DNA, 19 bp, Artificial Sequence
  Target B2M Sequence complement
acagcattcgggccgagat

SEQ ID NO: 11865 - DNA, 19 bp, Artificial Sequence
  Target B2M Sequence complement
agcattcgggccgagatgt

SEQ ID NO: 11866 - DNA, 19 bp, Artificial Sequence
  Target B2M Sequence complement
cattcgggccgagatgtct

SEQ ID NO: 11867 - DNA, 19 bp, Artificial Sequence
  Target B2M Sequence complement
attcgggccgagatgtctc

SEQ ID NO: 11868 - DNA, 19 bp, Artificial Sequence
  Target B2M Sequence complement
atggagagagaattgaaaa

SEQ ID NO: 11869 - DNA, 19 bp, Artificial Sequence
  Target B2M Sequence complement
tggagagagaattgaaaaa

SEQ ID NO: 11870 - DNA, 19 bp, Artificial Sequence
  Target B2M Sequence complement
ggagagagaattgaaaaag

SEQ ID NO: 11871 - DNA, 19 bp, Artificial Sequence
  Target B2M Sequence complement
gagagagaattgaaaaagt

SEQ ID NO: 11872 - DNA, 19 bp, Artificial Sequence
  Target B2M Sequence complement
agagagaattgaaaaagtg

SEQ ID NO: 11873 - DNA, 19 bp, Artificial Sequence
  Target B2M Sequence complement
gagagaattgaaaaagtgg

SEQ ID NO: 11874 - DNA, 19 bp, Artificial Sequence
  Target B2M Sequence complement
agagaattgaaaaagtgga

SEQ ID NO: 11875 - DNA, 19 bp, Artificial Sequence
  Target B2M Sequence complement
gagaattgaaaaagtggag

SEQ ID NO: 11876 - DNA, 19 bp, Artificial Sequence
  Target B2M Sequence complement
agaattgaaaaagtggagc

SEQ ID NO: 11877 - DNA, 19 bp, Artificial Sequence
  Target B2M Sequence complement
gaattgaaaaagtggagca

SEQ ID NO: 11878 - DNA, 19 bp, Artificial Sequence
  Target B2M Sequence complement
aattgaaaaagtggagcat

SEQ ID NO: 11879 - DNA, 19 bp, Artificial Sequence
  Target B2M Sequence complement
attgaaaaagtggagcatt

SEQ ID NO: 11880 - DNA, 19 bp, Artificial Sequence
  Target B2M Sequence complement
ttgaaaaagtggagcattc

SEQ ID NO: 11881 - DNA, 19 bp, Artificial Sequence
  Target B2M Sequence complement
tgaaaaagtggagcattca

SEQ ID NO: 11882 - DNA, 19 bp, Artificial Sequence
  Target B2M Sequence complement
gaaaaagtggagcattcag

SEQ ID NO: 11883 - DNA, 19 bp, Artificial Sequence
  Target B2M Sequence complement
aaaaagtggagcattcaga

SEQ ID NO: 11884 - DNA, 19 bp, Artificial Sequence
  Target B2M Sequence complement
aaaagtggagcattcagac

SEQ ID NO: 11885 - DNA, 19 bp, Artificial Sequence
  Target B2M Sequence complement
actacactgaattcacccc

SEQ ID NO: 11886 - DNA, 19 bp, Artificial Sequence
  Target B2M Sequence complement
ctacactgaattcaccccc

SEQ ID NO: 11887 - DNA, 19 bp, Artificial Sequence
  Target B2M Sequence complement
tacactgaattcaccccca

SEQ ID NO: 11888 - DNA, 19 bp, Artificial Sequence
  Target B2M Sequence complement
acactgaattcacccccac

SEQ ID NO: 11889 - DNA, 19 bp, Artificial Sequence
  Target B2M Sequence complement
cactgaattcacccccact

SEQ ID NO: 11890 - DNA, 19 bp, Artificial Sequence
  Target B2M Sequence complement
actgaattcacccccactg

SEQ ID NO: 11891 - DNA, 19 bp, Artificial Sequence
  Target B2M Sequence complement
ctgaattcacccccactga

SEQ ID NO: 11892 - DNA, 19 bp, Artificial Sequence
  Target B2M Sequence complement
tgaattcacccccactgaa

SEQ ID NO: 11893 - DNA, 19 bp, Artificial Sequence
  Target B2M Sequence complement
gaattcacccccactgaaa

SEQ ID NO: 11894 - DNA, 19 bp, Artificial Sequence
  Target B2M Sequence complement
aattcacccccactgaaaa

SEQ ID NO: 11895 - DNA, 19 bp, Artificial Sequence
  Target B2M Sequence complement
attcacccccactgaaaaa

SEQ ID NO: 11896 - DNA, 19 bp, Artificial Sequence
  Target B2M Sequence complement
ttcacccccactgaaaaag

SEQ ID NO: 11897 - DNA, 19 bp, Artificial Sequence
  Target B2M Sequence complement
tcacccccactgaaaaaga

SEQ ID NO: 11898 - DNA, 19 bp, Artificial Sequence
  Target B2M Sequence complement
cacccccactgaaaaagat

SEQ ID NO: 11899 - DNA, 19 bp, Artificial Sequence
  Target B2M Sequence complement
acccccactgaaaaagatg

SEQ ID NO: 11900 - DNA, 19 bp, Artificial Sequence
  Target B2M Sequence complement
cccccactgaaaaagatga

SEQ ID NO: 11901 - DNA, 19 bp, Artificial Sequence
  Target B2M Sequence complement
ccccactgaaaaagatgag

SEQ ID NO: 11902 - DNA, 19 bp, Artificial Sequence
  Target B2M Sequence complement
cccactgaaaaagatgagt

SEQ ID NO: 11903 - DNA, 19 bp, Artificial Sequence
  Target B2M Sequence complement
ccactgaaaaagatgagta

SEQ ID NO: 11904 - DNA, 19 bp, Artificial Sequence
  Target B2M Sequence complement
cactgaaaaagatgagtat

SEQ ID NO: 11905 - DNA, 19 bp, Artificial Sequence
  Target B2M Sequence complement
actgaaaaagatgagtatg

SEQ ID NO: 11906 - DNA, 19 bp, Artificial Sequence
  Target B2M Sequence complement
ctgaaaaagatgagtatgc

SEQ ID NO: 11907 - DNA, 19 bp, Artificial Sequence
  Target B2M Sequence complement
tgaaaaagatgagtatgcc

SEQ ID NO: 11908 - DNA, 19 bp, Artificial Sequence
  Target B2M Sequence complement
gaaaaagatgagtatgcct

SEQ ID NO: 11909 - DNA, 19 bp, Artificial Sequence
  Target B2M Sequence complement
aaaaagatgagtatgcctg

SEQ ID NO: 11910 - DNA, 19 bp, Artificial Sequence
  Target B2M Sequence complement
aaaagatgagtatgcctgc

SEQ ID NO: 11911 - DNA, 19 bp, Artificial Sequence
  Target B2M Sequence complement
attctgcttgcttgctttt

SEQ ID NO: 11912 - DNA, 19 bp, Artificial Sequence
  Target B2M Sequence complement
ttctgcttgcttgcttttt

SEQ ID NO: 11913 - DNA, 19 bp, Artificial Sequence
  Target B2M Sequence complement
tctgcttgcttgcttttta

SEQ ID NO: 11914 - DNA, 19 bp, Artificial Sequence
  Target B2M Sequence complement
ctgcttgcttgctttttaa

SEQ ID NO: 11915 - DNA, 19 bp, Artificial Sequence
  Target B2M Sequence complement
tgcttgcttgctttttaat

SEQ ID NO: 11916 - DNA, 19 bp, Artificial Sequence
  Target B2M Sequence complement
gcttgcttgctttttaata

SEQ ID NO: 11917 - DNA, 19 bp, Artificial Sequence
  Target B2M Sequence complement
cttgcttgctttttaatat

SEQ ID NO: 11918 - DNA, 19 bp, Artificial Sequence
  Target B2M Sequence complement
tgcttgctttttaatattg

SEQ ID NO: 11919 - DNA, 19 bp, Artificial Sequence
  Target B2M Sequence complement
gcttgctttttaatattga

SEQ ID NO: 11920 - DNA, 19 bp, Artificial Sequence
  Target B2M Sequence complement
ttacactttatgcacaaaa

SEQ ID NO: 11921 - DNA, 19 bp, Artificial Sequence
  Target B2M Sequence complement
tacactttatgcacaaaat

SEQ ID NO: 11922 - DNA, 19 bp, Artificial Sequence
  Target B2M Sequence complement
acactttatgcacaaaatg

SEQ ID NO: 11923 - DNA, 19 bp, Artificial Sequence
  Target B2M Sequence complement
cactttatgcacaaaatgt

SEQ ID NO: 11924 - DNA, 19 bp, Artificial Sequence
  Target B2M Sequence complement
actttatgcacaaaatgta

SEQ ID NO: 11925 - DNA, 19 bp, Artificial Sequence
  Target B2M Sequence complement
ctttatgcacaaaatgtag

SEQ ID NO: 11926 - DNA, 19 bp, Artificial Sequence
  Target B2M Sequence complement
tttatgcacaaaatgtagg

SEQ ID NO: 11927 - DNA, 19 bp, Artificial Sequence
  Target B2M Sequence complement
ttatgcacaaaatgtaggg

SEQ ID NO: 11928 - DNA, 19 bp, Artificial Sequence
  Target B2M Sequence complement
tatgcacaaaatgtagggt

SEQ ID NO: 11929 - DNA, 19 bp, Artificial Sequence
  Target B2M Sequence complement
atgcacaaaatgtagggtt

SEQ ID NO: 11930 - DNA, 19 bp, Artificial Sequence
  Target B2M Sequence complement
tgcacaaaatgtagggtta

SEQ ID NO: 11931 - DNA, 19 bp, Artificial Sequence
  Target B2M Sequence complement
gcacaaaatgtagggttat

SEQ ID NO: 11932 - DNA, 19 bp, Artificial Sequence
  Target B2M Sequence complement
cacaaaatgtagggttata

SEQ ID NO: 11933 - DNA, 19 bp, Artificial Sequence
  Target B2M Sequence complement
acaaaatgtagggttataa

SEQ ID NO: 11934 - DNA, 19 bp, Artificial Sequence
  Target B2M Sequence complement
caaaatgtagggttataat

SEQ ID NO: 11935 - DNA, 19 bp, Artificial Sequence
  Target B2M Sequence complement
tggcaacttagaggtgggg

SEQ ID NO: 11936 - DNA, 19 bp, Artificial Sequence
  Target B2M Sequence complement
ggcaacttagaggtgggga

SEQ ID NO: 11937 - DNA, 19 bp, Artificial Sequence
  Target B2M Sequence complement
gcaacttagaggtggggag

SEQ ID NO: 11938 - DNA, 19 bp, Artificial Sequence
  Target B2M Sequence complement
caacttagaggtggggagc

SEQ ID NO: 11939 - DNA, 19 bp, Artificial Sequence
  Target B2M Sequence complement
aacttagaggtggggagca

SEQ ID NO: 11940 - DNA, 19 bp, Artificial Sequence
  Target B2M Sequence complement
acttagaggtggggagcag

SEQ ID NO: 11941 - DNA, 19 bp, Artificial Sequence
  Target B2M Sequence complement
cttagaggtggggagcaga

SEQ ID NO: 11942 - DNA, 19 bp, Artificial Sequence
  Target B2M Sequence complement
ttagaggtggggagcagag

SEQ ID NO: 11943 - DNA, 19 bp, Artificial Sequence
  Target B2M Sequence complement
tagaggtggggagcagaga

SEQ ID NO: 11944 - DNA, 19 bp, Artificial Sequence
  Target B2M Sequence complement
agaggtggggagcagagaa

SEQ ID NO: 11945 - DNA, 19 bp, Artificial Sequence
  Target B2M Sequence complement
gaggtggggagcagagaat

SEQ ID NO: 11946 - DNA, 19 bp, Artificial Sequence
  Target B2M Sequence complement
aggtggggagcagagaatt

SEQ ID NO: 11947 - DNA, 19 bp, Artificial Sequence
  Target B2M Sequence complement
ggtggggagcagagaattc

SEQ ID NO: 11948 - DNA, 19 bp, Artificial Sequence
  Target B2M Sequence complement
gtggggagcagagaattct

SEQ ID NO: 11949 - DNA, 19 bp, Artificial Sequence
  Target B2M Sequence complement
tggggagcagagaattctc

SEQ ID NO: 11950 - DNA, 19 bp, Artificial Sequence
  Target B2M Sequence complement
ggggagcagagaattctct

SEQ ID NO: 11951 - DNA, 19 bp, Artificial Sequence
  Target B2M Sequence complement
ctctgcttagaatttgggg

SEQ ID NO: 11952 - DNA, 19 bp, Artificial Sequence
  Target B2M Sequence complement
tctgcttagaatttggggg

SEQ ID NO: 11953 - DNA, 19 bp, Artificial Sequence
  Target B2M Sequence complement
ctgcttagaatttggggga

SEQ ID NO: 11954 - DNA, 19 bp, Artificial Sequence
  Target B2M Sequence complement
tgcttagaatttgggggaa

SEQ ID NO: 11955 - DNA, 19 bp, Artificial Sequence
  Target B2M Sequence complement
gcttagaatttgggggaaa

SEQ ID NO: 11956 - DNA, 19 bp, Artificial Sequence
  Target B2M Sequence complement
cttagaatttgggggaaaa

SEQ ID NO: 11957 - DNA, 19 bp, Artificial Sequence
  Target B2M Sequence complement
ttagaatttgggggaaaat

SEQ ID NO: 11958 - DNA, 19 bp, Artificial Sequence
  Target B2M Sequence complement
tagaatttgggggaaaatt

SEQ ID NO: 11959 - DNA, 19 bp, Artificial Sequence
  Target B2M Sequence complement
agaatttgggggaaaattt

SEQ ID NO: 11960 - DNA, 19 bp, Artificial Sequence
  Target B2M Sequence complement
gaatttgggggaaaattta

SEQ ID NO: 11961 - DNA, 19 bp, Artificial Sequence
  Target B2M Sequence complement
aatttgggggaaaatttag

SEQ ID NO: 11962 - DNA, 19 bp, Artificial Sequence
  Target B2M Sequence complement
atttgggggaaaatttaga

SEQ ID NO: 11963 - DNA, 19 bp, Artificial Sequence
  Target B2M Sequence complement
tttgggggaaaatttagaa

SEQ ID NO: 11964 - DNA, 19 bp, Artificial Sequence
  Target B2M Sequence complement
ttgggggaaaatttagaaa

SEQ ID NO: 11965 - DNA, 19 bp, Artificial Sequence
  Target B2M Sequence complement
tgggggaaaatttagaaat

SEQ ID NO: 11966 - DNA, 19 bp, Artificial Sequence
  Target B2M Sequence complement
gggggaaaatttagaaata

SEQ ID NO: 11967 - DNA, 19 bp, Artificial Sequence
  Target B2M Sequence complement
ggggaaaatttagaaatat

SEQ ID NO: 11968 - DNA, 19 bp, Artificial Sequence
  Target B2M Sequence complement
atgaatgaaacattttgtc

SEQ ID NO: 11969 - DNA, 19 bp, Artificial Sequence
  Target B2M Sequence complement
tgaatgaaacattttgtca

SEQ ID NO: 11970 - DNA, 19 bp, Artificial Sequence
  Target B2M Sequence complement
gaatgaaacattttgtcat

SEQ ID NO: 11971 - DNA, 19 bp, Artificial Sequence
  Target B2M Sequence complement
ggttaatctggtttatttt

SEQ ID NO: 11972 - DNA, 19 bp, Artificial Sequence
  Target B2M Sequence complement
atctggtttatttttgttc

SEQ ID NO: 11973 - DNA, 19 bp, Artificial Sequence
  Target B2M Sequence complement
tctggtttatttttgttcc

SEQ ID NO: 11974 - DNA, 19 bp, Artificial Sequence
  Target B2M Sequence complement
ctggtttatttttgttcca

SEQ ID NO: 11975 - DNA, 19 bp, Artificial Sequence
  Target B2M Sequence complement
tggtttatttttgttccac

SEQ ID NO: 11976 - DNA, 19 bp, Artificial Sequence
  Target B2M Sequence complement
ggtttatttttgttccaca

SEQ ID NO: 11977 - DNA, 19 bp, Artificial Sequence
  Target B2M Sequence complement
gtttatttttgttccacaa

SEQ ID NO: 11978 - DNA, 19 bp, Artificial Sequence
  Target B2M Sequence complement
tttatttttgttccacaag

SEQ ID NO: 11979 - DNA, 19 bp, Artificial Sequence
  Target B2M Sequence complement
ttatttttgttccacaagt

SEQ ID NO: 11980 - DNA, 19 bp, Artificial Sequence
  Target B2M Sequence complement
tatttttgttccacaagtt

SEQ ID NO: 11981 - DNA, 19 bp, Artificial Sequence
  Target B2M Sequence complement
atttttgttccacaagtta

SEQ ID NO: 11982 - DNA, 19 bp, Artificial Sequence
  Target B2M Sequence complement
tttttgttccacaagttaa

SEQ ID NO: 11983 - DNA, 19 bp, Artificial Sequence
  Target B2M Sequence complement
ttttgttccacaagttaaa

SEQ ID NO: 11984 - DNA, 20 bp, Artificial Sequence
  Target B2M Sequence complement
aatggagagagaattgaaaa

SEQ ID NO: 11985 - DNA, 20 bp, Artificial Sequence
  Target B2M Sequence complement
atggagagagaattgaaaaa

SEQ ID NO: 11986 - DNA, 20 bp, Artificial Sequence
  Target B2M Sequence complement
tggagagagaattgaaaaag

SEQ ID NO: 11987 - DNA, 20 bp, Artificial Sequence
  Target B2M Sequence complement
ggagagagaattgaaaaagt

SEQ ID NO: 11988 - DNA, 20 bp, Artificial Sequence
  Target B2M Sequence complement
gagagagaattgaaaaagtg

SEQ ID NO: 11989 - DNA, 20 bp, Artificial Sequence
  Target B2M Sequence complement
agagagaattgaaaaagtgg

SEQ ID NO: 11990 - DNA, 20 bp, Artificial Sequence
  Target B2M Sequence complement
gagagaattgaaaaagtgga

SEQ ID NO: 11991 - DNA, 20 bp, Artificial Sequence
  Target B2M Sequence complement
agagaattgaaaaagtggag

SEQ ID NO: 11992 - DNA, 20 bp, Artificial Sequence
  Target B2M Sequence complement
gagaattgaaaaagtggagc

SEQ ID NO: 11993 - DNA, 20 bp, Artificial Sequence
  Target B2M Sequence complement
agaattgaaaaagtggagca

SEQ ID NO: 11994 - DNA, 20 bp, Artificial Sequence
  Target B2M Sequence complement
gaattgaaaaagtggagcat

SEQ ID NO: 11995 - DNA, 20 bp, Artificial Sequence
  Target B2M Sequence complement
aattgaaaaagtggagcatt

SEQ ID NO: 11996 - DNA, 20 bp, Artificial Sequence
  Target B2M Sequence complement
attgaaaaagtggagcattc

SEQ ID NO: 11997 - DNA, 20 bp, Artificial Sequence
  Target B2M Sequence complement
ttgaaaaagtggagcattca

SEQ ID NO: 11998 - DNA, 20 bp, Artificial Sequence
  Target B2M Sequence complement
tgaaaaagtggagcattcag

SEQ ID NO: 11999 - DNA, 20 bp, Artificial Sequence
  Target B2M Sequence complement
gaaaaagtggagcattcaga

SEQ ID NO: 12000 - DNA, 20 bp, Artificial Sequence
  Target B2M Sequence complement
aaaaagtggagcattcagac

SEQ ID NO: 12001 - DNA, 20 bp, Artificial Sequence
  Target B2M Sequence complement
aaaagtggagcattcagact

SEQ ID NO: 12002 - DNA, 20 bp, Artificial Sequence
  Target B2M Sequence complement
tactacactgaattcacccc

SEQ ID NO: 12003 - DNA, 20 bp, Artificial Sequence
  Target B2M Sequence complement
actacactgaattcaccccc

SEQ ID NO: 12004 - DNA, 20 bp, Artificial Sequence
  Target B2M Sequence complement
ctacactgaattcaccccca

SEQ ID NO: 12005 - DNA, 20 bp, Artificial Sequence
  Target B2M Sequence complement
tacactgaattcacccccac

SEQ ID NO: 12006 - DNA, 20 bp, Artificial Sequence
  Target B2M Sequence complement
acactgaattcacccccact

SEQ ID NO: 12007 - DNA, 20 bp, Artificial Sequence
  Target B2M Sequence complement
cactgaattcacccccactg

SEQ ID NO: 12008 - DNA, 20 bp, Artificial Sequence
  Target B2M Sequence complement
actgaattcacccccactga

SEQ ID NO: 12009 - DNA, 20 bp, Artificial Sequence
  Target B2M Sequence complement
ctgaattcacccccactgaa

SEQ ID NO: 12010 - DNA, 20 bp, Artificial Sequence
  Target B2M Sequence complement
tgaattcacccccactgaaa

SEQ ID NO: 12011 - DNA, 20 bp, Artificial Sequence
  Target B2M Sequence complement
gaattcacccccactgaaaa

SEQ ID NO: 12012 - DNA, 20 bp, Artificial Sequence
  Target B2M Sequence complement
aattcacccccactgaaaaa

SEQ ID NO: 12013 - DNA, 20 bp, Artificial Sequence
  Target B2M Sequence complement
attcacccccactgaaaaag

SEQ ID NO: 12014 - DNA, 20 bp, Artificial Sequence
  Target B2M Sequence complement
ttcacccccactgaaaaaga

SEQ ID NO: 12015 - DNA, 20 bp, Artificial Sequence
  Target B2M Sequence complement
tcacccccactgaaaaagat

SEQ ID NO: 12016 - DNA, 20 bp, Artificial Sequence
  Target B2M Sequence complement
cacccccactgaaaaagatg

SEQ ID NO: 12017 - DNA, 20 bp, Artificial Sequence
  Target B2M Sequence complement
acccccactgaaaaagatga

SEQ ID NO: 12018 - DNA, 20 bp, Artificial Sequence
  Target B2M Sequence complement
cccccactgaaaaagatgag

SEQ ID NO: 12019 - DNA, 20 bp, Artificial Sequence
  Target B2M Sequence complement
ccccactgaaaaagatgagt

SEQ ID NO: 12020 - DNA, 20 bp, Artificial Sequence
  Target B2M Sequence complement
cccactgaaaaagatgagta

SEQ ID NO: 12021 - DNA, 20 bp, Artificial Sequence
  Target B2M Sequence complement
ccactgaaaaagatgagtat

SEQ ID NO: 12022 - DNA, 20 bp, Artificial Sequence
  Target B2M Sequence complement
cactgaaaaagatgagtatg

SEQ ID NO: 12023 - DNA, 20 bp, Artificial Sequence
  Target B2M Sequence complement
actgaaaaagatgagtatgc

SEQ ID NO: 12024 - DNA, 20 bp, Artificial Sequence
  Target B2M Sequence complement
ctgaaaaagatgagtatgcc

SEQ ID NO: 12025 - DNA, 20 bp, Artificial Sequence
  Target B2M Sequence complement
tgaaaaagatgagtatgcct

SEQ ID NO: 12026 - DNA, 20 bp, Artificial Sequence
  Target B2M Sequence complement
gaaaaagatgagtatgcctg

SEQ ID NO: 12027 - DNA, 20 bp, Artificial Sequence
  Target B2M Sequence complement
aaaaagatgagtatgcctgc

SEQ ID NO: 12028 - DNA, 20 bp, Artificial Sequence
  Target B2M Sequence complement
aaaagatgagtatgcctgcc

SEQ ID NO: 12029 - DNA, 20 bp, Artificial Sequence
  Target B2M Sequence complement
aattctgcttgcttgctttt

SEQ ID NO: 12030 - DNA, 20 bp, Artificial Sequence
  Target B2M Sequence complement
attctgcttgcttgcttttt

SEQ ID NO: 12031 - DNA, 20 bp, Artificial Sequence
  Target B2M Sequence complement
ttctgcttgcttgcttttta

SEQ ID NO: 12032 - DNA, 20 bp, Artificial Sequence
  Target B2M Sequence complement
tctgcttgcttgctttttaa

SEQ ID NO: 12033 - DNA, 20 bp, Artificial Sequence
  Target B2M Sequence complement
ctgcttgcttgctttttaat

SEQ ID NO: 12034 - DNA, 20 bp, Artificial Sequence
  Target B2M Sequence complement
tgcttgcttgctttttaata

SEQ ID NO: 12035 - DNA, 20 bp, Artificial Sequence
  Target B2M Sequence complement
gcttgcttgctttttaatat

SEQ ID NO: 12036 - DNA, 20 bp, Artificial Sequence
  Target B2M Sequence complement
cttgcttgctttttaatatt

SEQ ID NO: 12037 - DNA, 20 bp, Artificial Sequence
  Target B2M Sequence complement
ttgcttgctttttaatattg

SEQ ID NO: 12038 - DNA, 20 bp, Artificial Sequence
  Target B2M Sequence complement
tgcttgctttttaatattga

SEQ ID NO: 12039 - DNA, 20 bp, Artificial Sequence
  Target B2M Sequence complement
gcttgctttttaatattgat

SEQ ID NO: 12040 - DNA, 20 bp, Artificial Sequence
  Target B2M Sequence complement
gctttttaatattgatatgc

SEQ ID NO: 12041 - DNA, 20 bp, Artificial Sequence
  Target B2M Sequence complement
cttacactttatgcacaaaa

SEQ ID NO: 12042 - DNA, 20 bp, Artificial Sequence
  Target B2M Sequence complement
ttacactttatgcacaaaat

SEQ ID NO: 12043 - DNA, 20 bp, Artificial Sequence
  Target B2M Sequence complement
tacactttatgcacaaaatg

SEQ ID NO: 12044 - DNA, 20 bp, Artificial Sequence
  Target B2M Sequence complement
acactttatgcacaaaatgt

SEQ ID NO: 12045 - DNA, 20 bp, Artificial Sequence
  Target B2M Sequence complement
cactttatgcacaaaatgta

SEQ ID NO: 12046 - DNA, 20 bp, Artificial Sequence
  Target B2M Sequence complement
actttatgcacaaaatgtag

SEQ ID NO: 12047 - DNA, 20 bp, Artificial Sequence
  Target B2M Sequence complement
ctttatgcacaaaatgtagg

SEQ ID NO: 12048 - DNA, 20 bp, Artificial Sequence
  Target B2M Sequence complement
tttatgcacaaaatgtaggg

SEQ ID NO: 12049 - DNA, 20 bp, Artificial Sequence
  Target B2M Sequence complement
ttatgcacaaaatgtagggt

SEQ ID NO: 12050 - DNA, 20 bp, Artificial Sequence
  Target B2M Sequence complement
tatgcacaaaatgtagggtt

SEQ ID NO: 12051 - DNA, 20 bp, Artificial Sequence
  Target B2M Sequence complement
atgcacaaaatgtagggtta

SEQ ID NO: 12052 - DNA, 20 bp, Artificial Sequence
  Target B2M Sequence complement
tgcacaaaatgtagggttat

SEQ ID NO: 12053 - DNA, 20 bp, Artificial Sequence
  Target B2M Sequence complement
gcacaaaatgtagggttata

SEQ ID NO: 12054 - DNA, 20 bp, Artificial Sequence
  Target B2M Sequence complement
cacaaaatgtagggttataa

SEQ ID NO: 12055 - DNA, 20 bp, Artificial Sequence
  Target B2M Sequence complement
acaaaatgtagggttataat

SEQ ID NO: 12056 - DNA, 20 bp, Artificial Sequence
  Target B2M Sequence complement
caaaatgtagggttataata

SEQ ID NO: 12057 - DNA, 20 bp, Artificial Sequence
  Target B2M Sequence complement
tggcaacttagaggtgggga

SEQ ID NO: 12058 - DNA, 20 bp, Artificial Sequence
  Target B2M Sequence complement
caacttagaggtggggagca

SEQ ID NO: 12059 - DNA, 20 bp, Artificial Sequence
  Target B2M Sequence complement
aacttagaggtggggagcag

SEQ ID NO: 12060 - DNA, 20 bp, Artificial Sequence
  Target B2M Sequence complement
acttagaggtggggagcaga

SEQ ID NO: 12061 - DNA, 20 bp, Artificial Sequence
  Target B2M Sequence complement
ttagaggtggggagcagaga

SEQ ID NO: 12062 - DNA, 20 bp, Artificial Sequence
  Target B2M Sequence complement
tagaggtggggagcagagaa

SEQ ID NO: 12063 - DNA, 20 bp, Artificial Sequence
  Target B2M Sequence complement
agaggtggggagcagagaat

SEQ ID NO: 12064 - DNA, 20 bp, Artificial Sequence
  Target B2M Sequence complement
gaggtggggagcagagaatt

SEQ ID NO: 12065 - DNA, 20 bp, Artificial Sequence
  Target B2M Sequence complement
aggtggggagcagagaattc

SEQ ID NO: 12066 - DNA, 20 bp, Artificial Sequence
  Target B2M Sequence complement
ggtggggagcagagaattct

SEQ ID NO: 12067 - DNA, 20 bp, Artificial Sequence
  Target B2M Sequence complement
gtggggagcagagaattctc

SEQ ID NO: 12068 - DNA, 20 bp, Artificial Sequence
  Target B2M Sequence complement
tggggagcagagaattctct

SEQ ID NO: 12069 - DNA, 20 bp, Artificial Sequence
  Target B2M Sequence complement
ggggagcagagaattctctt

SEQ ID NO: 12070 - DNA, 20 bp, Artificial Sequence
  Target B2M Sequence complement
actctgcttagaatttgggg

SEQ ID NO: 12071 - DNA, 20 bp, Artificial Sequence
  Target B2M Sequence complement
ctctgcttagaatttggggg

SEQ ID NO: 12072 - DNA, 20 bp, Artificial Sequence
  Target B2M Sequence complement
tctgcttagaatttggggga

SEQ ID NO: 12073 - DNA, 20 bp, Artificial Sequence
  Target B2M Sequence complement
ctgcttagaatttgggggaa

SEQ ID NO: 12074 - DNA, 20 bp, Artificial Sequence
  Target B2M Sequence complement
tgcttagaatttgggggaaa

SEQ ID NO: 12075 - DNA, 20 bp, Artificial Sequence
  Target B2M Sequence complement
gcttagaatttgggggaaaa

SEQ ID NO: 12076 - DNA, 20 bp, Artificial Sequence
  Target B2M Sequence complement
cttagaatttgggggaaaat

SEQ ID NO: 12077 - DNA, 20 bp, Artificial Sequence
  Target B2M Sequence complement
ttagaatttgggggaaaatt

SEQ ID NO: 12078 - DNA, 20 bp, Artificial Sequence
  Target B2M Sequence complement
tagaatttgggggaaaattt

SEQ ID NO: 12079 - DNA, 20 bp, Artificial Sequence
  Target B2M Sequence complement
agaatttgggggaaaattta

SEQ ID NO: 12080 - DNA, 20 bp, Artificial Sequence
  Target B2M Sequence complement
gaatttgggggaaaatttag

SEQ ID NO: 12081 - DNA, 20 bp, Artificial Sequence
  Target B2M Sequence complement
aatttgggggaaaatttaga

SEQ ID NO: 12082 - DNA, 20 bp, Artificial Sequence
  Target B2M Sequence complement
atttgggggaaaatttagaa

SEQ ID NO: 12083 - DNA, 20 bp, Artificial Sequence
  Target B2M Sequence complement
tttgggggaaaatttagaaa

SEQ ID NO: 12084 - DNA, 20 bp, Artificial Sequence
  Target B2M Sequence complement
ttgggggaaaatttagaaat

SEQ ID NO: 12085 - DNA, 20 bp, Artificial Sequence
  Target B2M Sequence complement
tgggggaaaatttagaaata

SEQ ID NO: 12086 - DNA, 20 bp, Artificial Sequence
  Target B2M Sequence complement
gggggaaaatttagaaatat

SEQ ID NO: 12087 - DNA, 20 bp, Artificial Sequence
  Target B2M Sequence complement
ggggaaaatttagaaatata

SEQ ID NO: 12088 - DNA, 20 bp, Artificial Sequence
  Target B2M Sequence complement
aatgaatgaaacattttgtc

SEQ ID NO: 12089 - DNA, 20 bp, Artificial Sequence
  Target B2M Sequence complement
atgaatgaaacattttgtca

SEQ ID NO: 12090 - DNA, 20 bp, Artificial Sequence
  Target B2M Sequence complement
tgaatgaaacattttgtcat

SEQ ID NO: 12091 - DNA, 20 bp, Artificial Sequence
  Target B2M Sequence complement
gaatgaaacattttgtcata

SEQ ID NO: 12092 - DNA, 20 bp, Artificial Sequence
  Target B2M Sequence complement
gaaacattttgtcatataag

SEQ ID NO: 12093 - DNA, 20 bp, Artificial Sequence
  Target B2M Sequence complement
cattttgtcatataagattc

SEQ ID NO: 12094 - DNA, 20 bp, Artificial Sequence
  Target B2M Sequence complement
tggttaatctggtttatttt

SEQ ID NO: 12095 - DNA, 20 bp, Artificial Sequence
  Target B2M Sequence complement
ggttaatctggtttattttt

SEQ ID NO: 12096 - DNA, 20 bp, Artificial Sequence
  Target B2M Sequence complement
gttaatctggtttatttttg

SEQ ID NO: 12097 - DNA, 20 bp, Artificial Sequence
  Target B2M Sequence complement
aatctggtttatttttgttc

SEQ ID NO: 12098 - DNA, 20 bp, Artificial Sequence
  Target B2M Sequence complement
atctggtttatttttgttcc

SEQ ID NO: 12099 - DNA, 20 bp, Artificial Sequence
  Target B2M Sequence complement
tctggtttatttttgttcca

SEQ ID NO: 12100 - DNA, 20 bp, Artificial Sequence
  Target B2M Sequence complement
ctggtttatttttgttccac

SEQ ID NO: 12101 - DNA, 20 bp, Artificial Sequence
  Target B2M Sequence complement
tggtttatttttgttccaca

SEQ ID NO: 12102 - DNA, 20 bp, Artificial Sequence
  Target B2M Sequence complement
ggtttatttttgttccacaa

SEQ ID NO: 12103 - DNA, 20 bp, Artificial Sequence
  Target B2M Sequence complement
gtttatttttgttccacaag

SEQ ID NO: 12104 - DNA, 20 bp, Artificial Sequence
  Target B2M Sequence complement
tttatttttgttccacaagt

SEQ ID NO: 12105 - DNA, 20 bp, Artificial Sequence
  Target B2M Sequence complement
ttatttttgttccacaagtt

SEQ ID NO: 12106 - DNA, 20 bp, Artificial Sequence
  Target B2M Sequence complement
tatttttgttccacaagtta

SEQ ID NO: 12107 - DNA, 20 bp, Artificial Sequence
  Target B2M Sequence complement
atttttgttccacaagttaa

SEQ ID NO: 12108 - DNA, 20 bp, Artificial Sequence
  Target B2M Sequence complement
tttttgttccacaagttaaa

SEQ ID NO: 12109 - DNA, 20 bp, Artificial Sequence
  Target B2M Sequence complement
ttttgttccacaagttaaat

SEQ ID NO: 12110 - DNA, 21 bp, Artificial Sequence
  Target B2M Sequence complement
tgacagcattcgggccgagat

SEQ ID NO: 12111 - DNA, 21 bp, Artificial Sequence
  Target B2M Sequence complement
acagcattcgggccgagatgt

SEQ ID NO: 12112 - DNA, 21 bp, Artificial Sequence
  Target B2M Sequence complement
agcattcgggccgagatgtct

SEQ ID NO: 12113 - DNA, 21 bp, Artificial Sequence
  Target B2M Sequence complement
gaatggagagagaattgaaaa

SEQ ID NO: 12114 - DNA, 21 bp, Artificial Sequence
  Target B2M Sequence complement
aatggagagagaattgaaaaa

SEQ ID NO: 12115 - DNA, 21 bp, Artificial Sequence
  Target B2M Sequence complement
atggagagagaattgaaaaag

SEQ ID NO: 12116 - DNA, 21 bp, Artificial Sequence
  Target B2M Sequence complement
tggagagagaattgaaaaagt

SEQ ID NO: 12117 - DNA, 21 bp, Artificial Sequence
  Target B2M Sequence complement
ggagagagaattgaaaaagtg

SEQ ID NO: 12118 - DNA, 21 bp, Artificial Sequence
  Target B2M Sequence complement
gagagagaattgaaaaagtgg

SEQ ID NO: 12119 - DNA, 21 bp, Artificial Sequence
  Target B2M Sequence complement
agagagaattgaaaaagtgga

SEQ ID NO: 12120 - DNA, 21 bp, Artificial Sequence
  Target B2M Sequence complement
gagagaattgaaaaagtggag

SEQ ID NO: 12121 - DNA, 21 bp, Artificial Sequence
  Target B2M Sequence complement
agagaattgaaaaagtggagc

SEQ ID NO: 12122 - DNA, 21 bp, Artificial Sequence
  Target B2M Sequence complement
gagaattgaaaaagtggagca

SEQ ID NO: 12123 - DNA, 21 bp, Artificial Sequence
  Target B2M Sequence complement
agaattgaaaaagtggagcat

SEQ ID NO: 12124 - DNA, 21 bp, Artificial Sequence
  Target B2M Sequence complement
gaattgaaaaagtggagcatt

SEQ ID NO: 12125 - DNA, 21 bp, Artificial Sequence
  Target B2M Sequence complement
aattgaaaaagtggagcattc

SEQ ID NO: 12126 - DNA, 21 bp, Artificial Sequence
  Target B2M Sequence complement
attgaaaaagtggagcattca

SEQ ID NO: 12127 - DNA, 21 bp, Artificial Sequence
  Target B2M Sequence complement
ttgaaaaagtggagcattcag

SEQ ID NO: 12128 - DNA, 21 bp, Artificial Sequence
  Target B2M Sequence complement
tgaaaaagtggagcattcaga

SEQ ID NO: 12129 - DNA, 21 bp, Artificial Sequence
  Target B2M Sequence complement
gaaaaagtggagcattcagac

SEQ ID NO: 12130 - DNA, 21 bp, Artificial Sequence
  Target B2M Sequence complement
aaaaagtggagcattcagact

SEQ ID NO: 12131 - DNA, 21 bp, Artificial Sequence
  Target B2M Sequence complement
aaaagtggagcattcagactt

SEQ ID NO: 12132 - DNA, 21 bp, Artificial Sequence
  Target B2M Sequence complement
gtactacactgaattcacccc

SEQ ID NO: 12133 - DNA, 21 bp, Artificial Sequence
  Target B2M Sequence complement
tactacactgaattcaccccc

SEQ ID NO: 12134 - DNA, 21 bp, Artificial Sequence
  Target B2M Sequence complement
actacactgaattcaccccca

SEQ ID NO: 12135 - DNA, 21 bp, Artificial Sequence
  Target B2M Sequence complement
ctacactgaattcacccccac

SEQ ID NO: 12136 - DNA, 21 bp, Artificial Sequence
  Target B2M Sequence complement
tacactgaattcacccccact

SEQ ID NO: 12137 - DNA, 21 bp, Artificial Sequence
  Target B2M Sequence complement
acactgaattcacccccactg

SEQ ID NO: 12138 - DNA, 21 bp, Artificial Sequence
  Target B2M Sequence complement
cactgaattcacccccactga

SEQ ID NO: 12139 - DNA, 21 bp, Artificial Sequence
  Target B2M Sequence complement
actgaattcacccccactgaa

SEQ ID NO: 12140 - DNA, 21 bp, Artificial Sequence
  Target B2M Sequence complement
ctgaattcacccccactgaaa

SEQ ID NO: 12141 - DNA, 21 bp, Artificial Sequence
  Target B2M Sequence complement
tgaattcacccccactgaaaa

SEQ ID NO: 12142 - DNA, 21 bp, Artificial Sequence
  Target B2M Sequence complement
gaattcacccccactgaaaaa

SEQ ID NO: 12143 - DNA, 21 bp, Artificial Sequence
  Target B2M Sequence complement
aattcacccccactgaaaaag

SEQ ID NO: 12144 - DNA, 21 bp, Artificial Sequence
  Target B2M Sequence complement
attcacccccactgaaaaaga

SEQ ID NO: 12145 - DNA, 21 bp, Artificial Sequence
  Target B2M Sequence complement
ttcacccccactgaaaaagat

SEQ ID NO: 12146 - DNA, 21 bp, Artificial Sequence
  Target B2M Sequence complement
tcacccccactgaaaaagatg

SEQ ID NO: 12147 - DNA, 21 bp, Artificial Sequence
  Target B2M Sequence complement
cacccccactgaaaaagatga

SEQ ID NO: 12148 - DNA, 21 bp, Artificial Sequence
  Target B2M Sequence complement
acccccactgaaaaagatgag

SEQ ID NO: 12149 - DNA, 21 bp, Artificial Sequence
  Target B2M Sequence complement
cccccactgaaaaagatgagt

SEQ ID NO: 12150 - DNA, 21 bp, Artificial Sequence
  Target B2M Sequence complement
ccccactgaaaaagatgagta

SEQ ID NO: 12151 - DNA, 21 bp, Artificial Sequence
  Target B2M Sequence complement
cccactgaaaaagatgagtat

SEQ ID NO: 12152 - DNA, 21 bp, Artificial Sequence
  Target B2M Sequence complement
ccactgaaaaagatgagtatg

SEQ ID NO: 12153 - DNA, 21 bp, Artificial Sequence
  Target B2M Sequence complement
cactgaaaaagatgagtatgc

SEQ ID NO: 12154 - DNA, 21 bp, Artificial Sequence
  Target B2M Sequence complement
actgaaaaagatgagtatgcc

SEQ ID NO: 12155 - DNA, 21 bp, Artificial Sequence
  Target B2M Sequence complement
ctgaaaaagatgagtatgcct

SEQ ID NO: 12156 - DNA, 21 bp, Artificial Sequence
  Target B2M Sequence complement
tgaaaaagatgagtatgcctg

SEQ ID NO: 12157 - DNA, 21 bp, Artificial Sequence
  Target B2M Sequence complement
gaaaaagatgagtatgcctgc

SEQ ID NO: 12158 - DNA, 21 bp, Artificial Sequence
  Target B2M Sequence complement
aaaaagatgagtatgcctgcc

SEQ ID NO: 12159 - DNA, 21 bp, Artificial Sequence
  Target B2M Sequence complement
aaaagatgagtatgcctgccg

SEQ ID NO: 12160 - DNA, 21 bp, Artificial Sequence
  Target B2M Sequence complement
aaattctgcttgcttgctttt

SEQ ID NO: 12161 - DNA, 21 bp, Artificial Sequence
  Target B2M Sequence complement
aattctgcttgcttgcttttt

SEQ ID NO: 12162 - DNA, 21 bp, Artificial Sequence
  Target B2M Sequence complement
attctgcttgcttgcttttta

SEQ ID NO: 12163 - DNA, 21 bp, Artificial Sequence
  Target B2M Sequence complement
ttctgcttgcttgctttttaa

SEQ ID NO: 12164 - DNA, 21 bp, Artificial Sequence
  Target B2M Sequence complement
tctgcttgcttgctttttaat

SEQ ID NO: 12165 - DNA, 21 bp, Artificial Sequence
  Target B2M Sequence complement
ctgcttgcttgctttttaata

SEQ ID NO: 12166 - DNA, 21 bp, Artificial Sequence
  Target B2M Sequence complement
tgcttgcttgctttttaatat

SEQ ID NO: 12167 - DNA, 21 bp, Artificial Sequence
  Target B2M Sequence complement
gcttgcttgctttttaatatt

SEQ ID NO: 12168 - DNA, 21 bp, Artificial Sequence
  Target B2M Sequence complement
cttgcttgctttttaatattg

SEQ ID NO: 12169 - DNA, 21 bp, Artificial Sequence
  Target B2M Sequence complement
acttacactttatgcacaaaa

SEQ ID NO: 12170 - DNA, 21 bp, Artificial Sequence
  Target B2M Sequence complement
cttacactttatgcacaaaat

SEQ ID NO: 12171 - DNA, 21 bp, Artificial Sequence
  Target B2M Sequence complement
ttacactttatgcacaaaatg

SEQ ID NO: 12172 - DNA, 21 bp, Artificial Sequence
  Target B2M Sequence complement
tacactttatgcacaaaatgt

SEQ ID NO: 12173 - DNA, 21 bp, Artificial Sequence
  Target B2M Sequence complement
acactttatgcacaaaatgta

SEQ ID NO: 12174 - DNA, 21 bp, Artificial Sequence
  Target B2M Sequence complement
cactttatgcacaaaatgtag

SEQ ID NO: 12175 - DNA, 21 bp, Artificial Sequence
  Target B2M Sequence complement
actttatgcacaaaatgtagg

SEQ ID NO: 12176 - DNA, 21 bp, Artificial Sequence
  Target B2M Sequence complement
ctttatgcacaaaatgtaggg

SEQ ID NO: 12177 - DNA, 21 bp, Artificial Sequence
  Target B2M Sequence complement
tttatgcacaaaatgtagggt

SEQ ID NO: 12178 - DNA, 21 bp, Artificial Sequence
  Target B2M Sequence complement
ttatgcacaaaatgtagggtt

SEQ ID NO: 12179 - DNA, 21 bp, Artificial Sequence
  Target B2M Sequence complement
tatgcacaaaatgtagggtta

SEQ ID NO: 12180 - DNA, 21 bp, Artificial Sequence
  Target B2M Sequence complement
atgcacaaaatgtagggttat

SEQ ID NO: 12181 - DNA, 21 bp, Artificial Sequence
  Target B2M Sequence complement
tgcacaaaatgtagggttata

SEQ ID NO: 12182 - DNA, 21 bp, Artificial Sequence
  Target B2M Sequence complement
gcacaaaatgtagggttataa

SEQ ID NO: 12183 - DNA, 21 bp, Artificial Sequence
  Target B2M Sequence complement
cacaaaatgtagggttataat

SEQ ID NO: 12184 - DNA, 21 bp, Artificial Sequence
  Target B2M Sequence complement
ctggcaacttagaggtgggga

SEQ ID NO: 12185 - DNA, 21 bp, Artificial Sequence
  Target B2M Sequence complement
tggcaacttagaggtggggag

SEQ ID NO: 12186 - DNA, 21 bp, Artificial Sequence
  Target B2M Sequence complement
gcaacttagaggtggggagca

SEQ ID NO: 12187 - DNA, 21 bp, Artificial Sequence
  Target B2M Sequence complement
caacttagaggtggggagcag

SEQ ID NO: 12188 - DNA, 21 bp, Artificial Sequence
  Target B2M Sequence complement
aacttagaggtggggagcaga

SEQ ID NO: 12189 - DNA, 21 bp, Artificial Sequence
  Target B2M Sequence complement
acttagaggtggggagcagag

SEQ ID NO: 12190 - DNA, 21 bp, Artificial Sequence
  Target B2M Sequence complement
cttagaggtggggagcagaga

SEQ ID NO: 12191 - DNA, 21 bp, Artificial Sequence
  Target B2M Sequence complement
ttagaggtggggagcagagaa

SEQ ID NO: 12192 - DNA, 21 bp, Artificial Sequence
  Target B2M Sequence complement
tagaggtggggagcagagaat

SEQ ID NO: 12193 - DNA, 21 bp, Artificial Sequence
  Target B2M Sequence complement
agaggtggggagcagagaatt

SEQ ID NO: 12194 - DNA, 21 bp, Artificial Sequence
  Target B2M Sequence complement
gaggtggggagcagagaattc

SEQ ID NO: 12195 - DNA, 21 bp, Artificial Sequence
  Target B2M Sequence complement
aggtggggagcagagaattct

SEQ ID NO: 12196 - DNA, 21 bp, Artificial Sequence
  Target B2M Sequence complement
ggtggggagcagagaattctc

SEQ ID NO: 12197 - DNA, 21 bp, Artificial Sequence
  Target B2M Sequence complement
gtggggagcagagaattctct

SEQ ID NO: 12198 - DNA, 21 bp, Artificial Sequence
  Target B2M Sequence complement
tggggagcagagaattctctt

SEQ ID NO: 12199 - DNA, 21 bp, Artificial Sequence
  Target B2M Sequence complement
ggggagcagagaattctctta

SEQ ID NO: 12200 - DNA, 21 bp, Artificial Sequence
  Target B2M Sequence complement
tactctgcttagaatttgggg

SEQ ID NO: 12201 - DNA, 21 bp, Artificial Sequence
  Target B2M Sequence complement
actctgcttagaatttggggg

SEQ ID NO: 12202 - DNA, 21 bp, Artificial Sequence
  Target B2M Sequence complement
ctctgcttagaatttggggga

SEQ ID NO: 12203 - DNA, 21 bp, Artificial Sequence
  Target B2M Sequence complement
tctgcttagaatttgggggaa

SEQ ID NO: 12204 - DNA, 21 bp, Artificial Sequence
  Target B2M Sequence complement
ctgcttagaatttgggggaaa

SEQ ID NO: 12205 - DNA, 21 bp, Artificial Sequence
  Target B2M Sequence complement
tgcttagaatttgggggaaaa

SEQ ID NO: 12206 - DNA, 21 bp, Artificial Sequence
  Target B2M Sequence complement
gcttagaatttgggggaaaat

SEQ ID NO: 12207 - DNA, 21 bp, Artificial Sequence
  Target B2M Sequence complement
cttagaatttgggggaaaatt

SEQ ID NO: 12208 - DNA, 21 bp, Artificial Sequence
  Target B2M Sequence complement
ttagaatttgggggaaaattt

SEQ ID NO: 12209 - DNA, 21 bp, Artificial Sequence
  Target B2M Sequence complement
tagaatttgggggaaaattta

SEQ ID NO: 12210 - DNA, 21 bp, Artificial Sequence
  Target B2M Sequence complement
agaatttgggggaaaatttag

SEQ ID NO: 12211 - DNA, 21 bp, Artificial Sequence
  Target B2M Sequence complement
gaatttgggggaaaatttaga

SEQ ID NO: 12212 - DNA, 21 bp, Artificial Sequence
  Target B2M Sequence complement
aatttgggggaaaatttagaa

SEQ ID NO: 12213 - DNA, 21 bp, Artificial Sequence
  Target B2M Sequence complement
atttgggggaaaatttagaaa

SEQ ID NO: 12214 - DNA, 21 bp, Artificial Sequence
  Target B2M Sequence complement
tttgggggaaaatttagaaat

SEQ ID NO: 12215 - DNA, 21 bp, Artificial Sequence
  Target B2M Sequence complement
ttgggggaaaatttagaaata

SEQ ID NO: 12216 - DNA, 21 bp, Artificial Sequence
  Target B2M Sequence complement
tgggggaaaatttagaaatat

SEQ ID NO: 12217 - DNA, 21 bp, Artificial Sequence
  Target B2M Sequence complement
gggggaaaatttagaaatata

SEQ ID NO: 12218 - DNA, 21 bp, Artificial Sequence
  Target B2M Sequence complement
gtggttaatctggtttatttt

SEQ ID NO: 12219 - DNA, 21 bp, Artificial Sequence
  Target B2M Sequence complement
ggttaatctggtttatttttg

SEQ ID NO: 12220 - DNA, 21 bp, Artificial Sequence
  Target B2M Sequence complement
aatctggtttatttttgttcc

SEQ ID NO: 12221 - DNA, 21 bp, Artificial Sequence
  Target B2M Sequence complement
atctggtttatttttgttcca

SEQ ID NO: 12222 - DNA, 21 bp, Artificial Sequence
  Target B2M Sequence complement
tctggtttatttttgttccac

SEQ ID NO: 12223 - DNA, 21 bp, Artificial Sequence
  Target B2M Sequence complement
ctggtttatttttgttccaca

SEQ ID NO: 12224 - DNA, 21 bp, Artificial Sequence
  Target B2M Sequence complement
tggtttatttttgttccacaa

SEQ ID NO: 12225 - DNA, 21 bp, Artificial Sequence
  Target B2M Sequence complement
ggtttatttttgttccacaag

SEQ ID NO: 12226 - DNA, 21 bp, Artificial Sequence
  Target B2M Sequence complement
gtttatttttgttccacaagt

SEQ ID NO: 12227 - DNA, 22 bp, Artificial Sequence
  Target B2M Sequence complement
aagctgacagcattcgggccga

SEQ ID NO: 12228 - DNA, 22 bp, Artificial Sequence
  Target B2M Sequence complement
ctgacagcattcgggccgagat

SEQ ID NO: 12229 - DNA, 22 bp, Artificial Sequence
  Target B2M Sequence complement
tgacagcattcgggccgagatg

SEQ ID NO: 12230 - DNA, 22 bp, Artificial Sequence
  Target B2M Sequence complement
gacagcattcgggccgagatgt

SEQ ID NO: 12231 - DNA, 22 bp, Artificial Sequence
  Target B2M Sequence complement
acagcattcgggccgagatgtc

SEQ ID NO: 12232 - DNA, 22 bp, Artificial Sequence
  Target B2M Sequence complement
cagcattcgggccgagatgtct

SEQ ID NO: 12233 - DNA, 22 bp, Artificial Sequence
  Target B2M Sequence complement
agcattcgggccgagatgtctc

SEQ ID NO: 12234 - DNA, 22 bp, Artificial Sequence
  Target B2M Sequence complement
attcgggccgagatgtctcgct

SEQ ID NO: 12235 - DNA, 22 bp, Artificial Sequence
  Target B2M Sequence complement
agaatggagagagaattgaaaa

SEQ ID NO: 12236 - DNA, 22 bp, Artificial Sequence
  Target B2M Sequence complement
gaatggagagagaattgaaaaa

SEQ ID NO: 12237 - DNA, 22 bp, Artificial Sequence
  Target B2M Sequence complement
aatggagagagaattgaaaaag

SEQ ID NO: 12238 - DNA, 22 bp, Artificial Sequence
  Target B2M Sequence complement
atggagagagaattgaaaaagt

SEQ ID NO: 12239 - DNA, 22 bp, Artificial Sequence
  Target B2M Sequence complement
tggagagagaattgaaaaagtg

SEQ ID NO: 12240 - DNA, 22 bp, Artificial Sequence
  Target B2M Sequence complement
ggagagagaattgaaaaagtgg

SEQ ID NO: 12241 - DNA, 22 bp, Artificial Sequence
  Target B2M Sequence complement
gagagagaattgaaaaagtgga

SEQ ID NO: 12242 - DNA, 22 bp, Artificial Sequence
  Target B2M Sequence complement
agagagaattgaaaaagtggag

SEQ ID NO: 12243 - DNA, 22 bp, Artificial Sequence
  Target B2M Sequence complement
gagagaattgaaaaagtggagc

SEQ ID NO: 12244 - DNA, 22 bp, Artificial Sequence
  Target B2M Sequence complement
agagaattgaaaaagtggagca

SEQ ID NO: 12245 - DNA, 22 bp, Artificial Sequence
  Target B2M Sequence complement
gagaattgaaaaagtggagcat

SEQ ID NO: 12246 - DNA, 22 bp, Artificial Sequence
  Target B2M Sequence complement
agaattgaaaaagtggagcatt

SEQ ID NO: 12247 - DNA, 22 bp, Artificial Sequence
  Target B2M Sequence complement
gaattgaaaaagtggagcattc

SEQ ID NO: 12248 - DNA, 22 bp, Artificial Sequence
  Target B2M Sequence complement
aattgaaaaagtggagcattca

SEQ ID NO: 12249 - DNA, 22 bp, Artificial Sequence
  Target B2M Sequence complement
attgaaaaagtggagcattcag

SEQ ID NO: 12250 - DNA, 22 bp, Artificial Sequence
  Target B2M Sequence complement
ttgaaaaagtggagcattcaga

SEQ ID NO: 12251 - DNA, 22 bp, Artificial Sequence
  Target B2M Sequence complement
tgaaaaagtggagcattcagac

SEQ ID NO: 12252 - DNA, 22 bp, Artificial Sequence
  Target B2M Sequence complement
gaaaaagtggagcattcagact

SEQ ID NO: 12253 - DNA, 22 bp, Artificial Sequence
  Target B2M Sequence complement
aaaaagtggagcattcagactt

SEQ ID NO: 12254 - DNA, 22 bp, Artificial Sequence
  Target B2M Sequence complement
aaaagtggagcattcagacttg

SEQ ID NO: 12255 - DNA, 22 bp, Artificial Sequence
  Target B2M Sequence complement
tgtactacactgaattcacccc

SEQ ID NO: 12256 - DNA, 22 bp, Artificial Sequence
  Target B2M Sequence complement
gtactacactgaattcaccccc

SEQ ID NO: 12257 - DNA, 22 bp, Artificial Sequence
  Target B2M Sequence complement
tactacactgaattcaccccca

SEQ ID NO: 12258 - DNA, 22 bp, Artificial Sequence
  Target B2M Sequence complement
actacactgaattcacccccac

SEQ ID NO: 12259 - DNA, 22 bp, Artificial Sequence
  Target B2M Sequence complement
ctacactgaattcacccccact

SEQ ID NO: 12260 - DNA, 22 bp, Artificial Sequence
  Target B2M Sequence complement
tacactgaattcacccccactg

SEQ ID NO: 12261 - DNA, 22 bp, Artificial Sequence
  Target B2M Sequence complement
acactgaattcacccccactga

SEQ ID NO: 12262 - DNA, 22 bp, Artificial Sequence
  Target B2M Sequence complement
cactgaattcacccccactgaa

SEQ ID NO: 12263 - DNA, 22 bp, Artificial Sequence
  Target B2M Sequence complement
actgaattcacccccactgaaa

SEQ ID NO: 12264 - DNA, 22 bp, Artificial Sequence
  Target B2M Sequence complement
ctgaattcacccccactgaaaa

SEQ ID NO: 12265 - DNA, 22 bp, Artificial Sequence
  Target B2M Sequence complement
tgaattcacccccactgaaaaa

SEQ ID NO: 12266 - DNA, 22 bp, Artificial Sequence
  Target B2M Sequence complement
gaattcacccccactgaaaaag

SEQ ID NO: 12267 - DNA, 22 bp, Artificial Sequence
  Target B2M Sequence complement
aattcacccccactgaaaaaga

SEQ ID NO: 12268 - DNA, 22 bp, Artificial Sequence
  Target B2M Sequence complement
attcacccccactgaaaaagat

SEQ ID NO: 12269 - DNA, 22 bp, Artificial Sequence
  Target B2M Sequence complement
ttcacccccactgaaaaagatg

SEQ ID NO: 12270 - DNA, 22 bp, Artificial Sequence
  Target B2M Sequence complement
tcacccccactgaaaaagatga

SEQ ID NO: 12271 - DNA, 22 bp, Artificial Sequence
  Target B2M Sequence complement
cacccccactgaaaaagatgag

SEQ ID NO: 12272 - DNA, 22 bp, Artificial Sequence
  Target B2M Sequence complement
acccccactgaaaaagatgagt

SEQ ID NO: 12273 - DNA, 22 bp, Artificial Sequence
  Target B2M Sequence complement
cccccactgaaaaagatgagta

SEQ ID NO: 12274 - DNA, 22 bp, Artificial Sequence
  Target B2M Sequence complement
ccccactgaaaaagatgagtat

SEQ ID NO: 12275 - DNA, 22 bp, Artificial Sequence
  Target B2M Sequence complement
cccactgaaaaagatgagtatg

SEQ ID NO: 12276 - DNA, 22 bp, Artificial Sequence
  Target B2M Sequence complement
ccactgaaaaagatgagtatgc

SEQ ID NO: 12277 - DNA, 22 bp, Artificial Sequence
  Target B2M Sequence complement
cactgaaaaagatgagtatgcc

SEQ ID NO: 12278 - DNA, 22 bp, Artificial Sequence
  Target B2M Sequence complement
actgaaaaagatgagtatgcct

SEQ ID NO: 12279 - DNA, 22 bp, Artificial Sequence
  Target B2M Sequence complement
ctgaaaaagatgagtatgcctg

SEQ ID NO: 12280 - DNA, 22 bp, Artificial Sequence
  Target B2M Sequence complement
tgaaaaagatgagtatgcctgc

SEQ ID NO: 12281 - DNA, 22 bp, Artificial Sequence
  Target B2M Sequence complement
gaaaaagatgagtatgcctgcc

SEQ ID NO: 12282 - DNA, 22 bp, Artificial Sequence
  Target B2M Sequence complement
aaaaagatgagtatgcctgccg

SEQ ID NO: 12283 - DNA, 22 bp, Artificial Sequence
  Target B2M Sequence complement
aaaagatgagtatgcctgccgt

SEQ ID NO: 12284 - DNA, 22 bp, Artificial Sequence
  Target B2M Sequence complement
caaattctgcttgcttgctttt

SEQ ID NO: 12285 - DNA, 22 bp, Artificial Sequence
  Target B2M Sequence complement
aaattctgcttgcttgcttttt

SEQ ID NO: 12286 - DNA, 22 bp, Artificial Sequence
  Target B2M Sequence complement
aattctgcttgcttgcttttta

SEQ ID NO: 12287 - DNA, 22 bp, Artificial Sequence
  Target B2M Sequence complement
attctgcttgcttgctttttaa

SEQ ID NO: 12288 - DNA, 22 bp, Artificial Sequence
  Target B2M Sequence complement
ttctgcttgcttgctttttaat

SEQ ID NO: 12289 - DNA, 22 bp, Artificial Sequence
  Target B2M Sequence complement
tctgcttgcttgctttttaata

SEQ ID NO: 12290 - DNA, 22 bp, Artificial Sequence
  Target B2M Sequence complement
ctgcttgcttgctttttaatat

SEQ ID NO: 12291 - DNA, 22 bp, Artificial Sequence
  Target B2M Sequence complement
tgcttgcttgctttttaatatt

SEQ ID NO: 12292 - DNA, 22 bp, Artificial Sequence
  Target B2M Sequence complement
gcttgcttgctttttaatattg

SEQ ID NO: 12293 - DNA, 22 bp, Artificial Sequence
  Target B2M Sequence complement
cttgcttgctttttaatattga

SEQ ID NO: 12294 - DNA, 22 bp, Artificial Sequence
  Target B2M Sequence complement
cacttacactttatgcacaaaa

SEQ ID NO: 12295 - DNA, 22 bp, Artificial Sequence
  Target B2M Sequence complement
acttacactttatgcacaaaat

SEQ ID NO: 12296 - DNA, 22 bp, Artificial Sequence
  Target B2M Sequence complement
cttacactttatgcacaaaatg

SEQ ID NO: 12297 - DNA, 22 bp, Artificial Sequence
  Target B2M Sequence complement
ttacactttatgcacaaaatgt

SEQ ID NO: 12298 - DNA, 22 bp, Artificial Sequence
  Target B2M Sequence complement
tacactttatgcacaaaatgta

SEQ ID NO: 12299 - DNA, 22 bp, Artificial Sequence
  Target B2M Sequence complement
acactttatgcacaaaatgtag

SEQ ID NO: 12300 - DNA, 22 bp, Artificial Sequence
  Target B2M Sequence complement
cactttatgcacaaaatgtagg

SEQ ID NO: 12301 - DNA, 22 bp, Artificial Sequence
  Target B2M Sequence complement
actttatgcacaaaatgtaggg

SEQ ID NO: 12302 - DNA, 22 bp, Artificial Sequence
  Target B2M Sequence complement
ctttatgcacaaaatgtagggt

SEQ ID NO: 12303 - DNA, 22 bp, Artificial Sequence
  Target B2M Sequence complement
tttatgcacaaaatgtagggtt

SEQ ID NO: 12304 - DNA, 22 bp, Artificial Sequence
  Target B2M Sequence complement
ttatgcacaaaatgtagggtta

SEQ ID NO: 12305 - DNA, 22 bp, Artificial Sequence
  Target B2M Sequence complement
tatgcacaaaatgtagggttat

SEQ ID NO: 12306 - DNA, 22 bp, Artificial Sequence
  Target B2M Sequence complement
atgcacaaaatgtagggttata

SEQ ID NO: 12307 - DNA, 22 bp, Artificial Sequence
  Target B2M Sequence complement
tgcacaaaatgtagggttataa

SEQ ID NO: 12308 - DNA, 22 bp, Artificial Sequence
  Target B2M Sequence complement
gcacaaaatgtagggttataat

SEQ ID NO: 12309 - DNA, 22 bp, Artificial Sequence
  Target B2M Sequence complement
cacaaaatgtagggttataata

SEQ ID NO: 12310 - DNA, 22 bp, Artificial Sequence
  Target B2M Sequence complement
gctggcaacttagaggtgggga

SEQ ID NO: 12311 - DNA, 22 bp, Artificial Sequence
  Target B2M Sequence complement
ctggcaacttagaggtggggag

SEQ ID NO: 12312 - DNA, 22 bp, Artificial Sequence
  Target B2M Sequence complement
tggcaacttagaggtggggagc

SEQ ID NO: 12313 - DNA, 22 bp, Artificial Sequence
  Target B2M Sequence complement
ggcaacttagaggtggggagca

SEQ ID NO: 12314 - DNA, 22 bp, Artificial Sequence
  Target B2M Sequence complement
gcaacttagaggtggggagcag

SEQ ID NO: 12315 - DNA, 22 bp, Artificial Sequence
  Target B2M Sequence complement
caacttagaggtggggagcaga

SEQ ID NO: 12316 - DNA, 22 bp, Artificial Sequence
  Target B2M Sequence complement
aacttagaggtggggagcagag

SEQ ID NO: 12317 - DNA, 22 bp, Artificial Sequence
  Target B2M Sequence complement
acttagaggtggggagcagaga

SEQ ID NO: 12318 - DNA, 22 bp, Artificial Sequence
  Target B2M Sequence complement
cttagaggtggggagcagagaa

SEQ ID NO: 12319 - DNA, 22 bp, Artificial Sequence
  Target B2M Sequence complement
ttagaggtggggagcagagaat

SEQ ID NO: 12320 - DNA, 22 bp, Artificial Sequence
  Target B2M Sequence complement
tagaggtggggagcagagaatt

SEQ ID NO: 12321 - DNA, 22 bp, Artificial Sequence
  Target B2M Sequence complement
agaggtggggagcagagaattc

SEQ ID NO: 12322 - DNA, 22 bp, Artificial Sequence
  Target B2M Sequence complement
gaggtggggagcagagaattct

SEQ ID NO: 12323 - DNA, 22 bp, Artificial Sequence
  Target B2M Sequence complement
aggtggggagcagagaattctc

SEQ ID NO: 12324 - DNA, 22 bp, Artificial Sequence
  Target B2M Sequence complement
ggtggggagcagagaattctct

SEQ ID NO: 12325 - DNA, 22 bp, Artificial Sequence
  Target B2M Sequence complement
gtggggagcagagaattctctt

SEQ ID NO: 12326 - DNA, 22 bp, Artificial Sequence
  Target B2M Sequence complement
tggggagcagagaattctctta

SEQ ID NO: 12327 - DNA, 22 bp, Artificial Sequence
  Target B2M Sequence complement
ggggagcagagaattctcttat

SEQ ID NO: 12328 - DNA, 22 bp, Artificial Sequence
  Target B2M Sequence complement
atactctgcttagaatttgggg

SEQ ID NO: 12329 - DNA, 22 bp, Artificial Sequence
  Target B2M Sequence complement
tactctgcttagaatttggggg

SEQ ID NO: 12330 - DNA, 22 bp, Artificial Sequence
  Target B2M Sequence complement
actctgcttagaatttggggga

SEQ ID NO: 12331 - DNA, 22 bp, Artificial Sequence
  Target B2M Sequence complement
ctctgcttagaatttgggggaa

SEQ ID NO: 12332 - DNA, 22 bp, Artificial Sequence
  Target B2M Sequence complement
tctgcttagaatttgggggaaa

SEQ ID NO: 12333 - DNA, 22 bp, Artificial Sequence
  Target B2M Sequence complement
ctgcttagaatttgggggaaaa

SEQ ID NO: 12334 - DNA, 22 bp, Artificial Sequence
  Target B2M Sequence complement
tgcttagaatttgggggaaaat

SEQ ID NO: 12335 - DNA, 22 bp, Artificial Sequence
  Target B2M Sequence complement
gcttagaatttgggggaaaatt

SEQ ID NO: 12336 - DNA, 22 bp, Artificial Sequence
  Target B2M Sequence complement
cttagaatttgggggaaaattt

SEQ ID NO: 12337 - DNA, 22 bp, Artificial Sequence
  Target B2M Sequence complement
ttagaatttgggggaaaattta

SEQ ID NO: 12338 - DNA, 22 bp, Artificial Sequence
  Target B2M Sequence complement
tagaatttgggggaaaatttag

SEQ ID NO: 12339 - DNA, 22 bp, Artificial Sequence
  Target B2M Sequence complement
agaatttgggggaaaatttaga

SEQ ID NO: 12340 - DNA, 22 bp, Artificial Sequence
  Target B2M Sequence complement
gaatttgggggaaaatttagaa

SEQ ID NO: 12341 - DNA, 22 bp, Artificial Sequence
  Target B2M Sequence complement
aatttgggggaaaatttagaaa

SEQ ID NO: 12342 - DNA, 22 bp, Artificial Sequence
  Target B2M Sequence complement
atttgggggaaaatttagaaat

SEQ ID NO: 12343 - DNA, 22 bp, Artificial Sequence
  Target B2M Sequence complement
tttgggggaaaatttagaaata

SEQ ID NO: 12344 - DNA, 22 bp, Artificial Sequence
  Target B2M Sequence complement
ttgggggaaaatttagaaatat

SEQ ID NO: 12345 - DNA, 22 bp, Artificial Sequence
  Target B2M Sequence complement
tgggggaaaatttagaaatata

SEQ ID NO: 12346 - DNA, 22 bp, Artificial Sequence
  Target B2M Sequence complement
gggggaaaatttagaaatataa

SEQ ID NO: 12347 - DNA, 22 bp, Artificial Sequence
  Target B2M Sequence complement
tgtggttaatctggtttatttt

SEQ ID NO: 12348 - DNA, 22 bp, Artificial Sequence
  Target B2M Sequence complement
gtggttaatctggtttattttt

SEQ ID NO: 12349 - DNA, 22 bp, Artificial Sequence
  Target B2M Sequence complement
tggttaatctggtttatttttg

SEQ ID NO: 12350 - DNA, 22 bp, Artificial Sequence
  Target B2M Sequence complement
ggttaatctggtttatttttgt

SEQ ID NO: 12351 - DNA, 22 bp, Artificial Sequence
  Target B2M Sequence complement
taatctggtttatttttgttcc

SEQ ID NO: 12352 - DNA, 22 bp, Artificial Sequence
  Target B2M Sequence complement
aatctggtttatttttgttcca

SEQ ID NO: 12353 - DNA, 22 bp, Artificial Sequence
  Target B2M Sequence complement
atctggtttatttttgttccac

SEQ ID NO: 12354 - DNA, 22 bp, Artificial Sequence
  Target B2M Sequence complement
tctggtttatttttgttccaca

SEQ ID NO: 12355 - DNA, 22 bp, Artificial Sequence
  Target B2M Sequence complement
ctggtttatttttgttccacaa

SEQ ID NO: 12356 - DNA, 22 bp, Artificial Sequence
  Target B2M Sequence complement
tggtttatttttgttccacaag

SEQ ID NO: 12357 - DNA, 22 bp, Artificial Sequence
  Target B2M Sequence complement
ggtttatttttgttccacaagt

SEQ ID NO: 12358 - DNA, 22 bp, Artificial Sequence
  Target B2M Sequence complement
gtttatttttgttccacaagtt

SEQ ID NO: 12359 - DNA, 18 bp, Artificial Sequence
  Target B2M Sequence complement
agctgacagcattcgggc

SEQ ID NO: 12360 - DNA, 18 bp, Artificial Sequence
  Target B2M Sequence complement
gctgacagcattcgggcc

SEQ ID NO: 12361 - DNA, 18 bp, Artificial Sequence
  Target B2M Sequence complement
ctgacagcattcgggccg

SEQ ID NO: 12362 - DNA, 18 bp, Artificial Sequence
  Target B2M Sequence complement
tgacagcattcgggccga

SEQ ID NO: 12363 - DNA, 18 bp, Artificial Sequence
  Target B2M Sequence complement
gacagcattcgggccgag

SEQ ID NO: 12364 - DNA, 18 bp, Artificial Sequence
  Target B2M Sequence complement
acagcattcgggccgaga

SEQ ID NO: 12365 - DNA, 18 bp, Artificial Sequence
  Target B2M Sequence complement
cagcattcgggccgagat

SEQ ID NO: 12366 - DNA, 18 bp, Artificial Sequence
  Target B2M Sequence complement
agcattcgggccgagatg

SEQ ID NO: 12367 - DNA, 18 bp, Artificial Sequence
  Target B2M Sequence complement
gcattcgggccgagatgt

SEQ ID NO: 12368 - DNA, 18 bp, Artificial Sequence
  Target B2M Sequence complement
cattcgggccgagatgtc

SEQ ID NO: 12369 - DNA, 18 bp, Artificial Sequence
  Target B2M Sequence complement
ttcgggccgagatgtctc

SEQ ID NO: 12370 - DNA, 18 bp, Artificial Sequence
  Target B2M Sequence complement
tcgggccgagatgtctcg

SEQ ID NO: 12371 - DNA, 18 bp, Artificial Sequence
  Target B2M Sequence complement
cgggccgagatgtctcgc

SEQ ID NO: 12372 - DNA, 18 bp, Artificial Sequence
  Target B2M Sequence complement
gggccgagatgtctcgct

SEQ ID NO: 12373 - DNA, 18 bp, Artificial Sequence
  Target B2M Sequence complement
ggccgagatgtctcgctc

SEQ ID NO: 12374 - DNA, 18 bp, Artificial Sequence
  Target B2M Sequence complement
gccgagatgtctcgctcc

SEQ ID NO: 12375 - DNA, 18 bp, Artificial Sequence
  Target B2M Sequence complement
ccgagatgtctcgctccg

SEQ ID NO: 12376 - DNA, 18 bp, Artificial Sequence
  Target B2M Sequence complement
cgagatgtctcgctccgt

SEQ ID NO: 12377 - DNA, 18 bp, Artificial Sequence
  Target B2M Sequence complement
gagatgtctcgctccgtg

SEQ ID NO: 12378 - DNA, 18 bp, Artificial Sequence
  Target B2M Sequence complement
agatgtctcgctccgtgg

SEQ ID NO: 12379 - DNA, 18 bp, Artificial Sequence
  Target B2M Sequence complement
gatgtctcgctccgtggc

SEQ ID NO: 12380 - DNA, 18 bp, Artificial Sequence
  Target B2M Sequence complement
atgtctcgctccgtggcc

SEQ ID NO: 12381 - DNA, 18 bp, Artificial Sequence
  Target B2M Sequence complement
tgtctcgctccgtggcct

SEQ ID NO: 12382 - DNA, 18 bp, Artificial Sequence
  Target B2M Sequence complement
gtctcgctccgtggcctt

SEQ ID NO: 12383 - DNA, 18 bp, Artificial Sequence
  Target B2M Sequence complement
tctcgctccgtggcctta

SEQ ID NO: 12384 - DNA, 18 bp, Artificial Sequence
  Target B2M Sequence complement
ctcgctccgtggccttag

SEQ ID NO: 12385 - DNA, 18 bp, Artificial Sequence
  Target B2M Sequence complement
tcgctccgtggccttagc

SEQ ID NO: 12386 - DNA, 18 bp, Artificial Sequence
  Target B2M Sequence complement
cgctccgtggccttagct

SEQ ID NO: 12387 - DNA, 18 bp, Artificial Sequence
  Target B2M Sequence complement
gctccgtggccttagctg

SEQ ID NO: 12388 - DNA, 18 bp, Artificial Sequence
  Target B2M Sequence complement
ctccgtggccttagctgt

SEQ ID NO: 12389 - DNA, 18 bp, Artificial Sequence
  Target B2M Sequence complement
tccgtggccttagctgtg

SEQ ID NO: 12390 - DNA, 18 bp, Artificial Sequence
  Target B2M Sequence complement
ccgtggccttagctgtgc

SEQ ID NO: 12391 - DNA, 18 bp, Artificial Sequence
  Target B2M Sequence complement
cgtggccttagctgtgct

SEQ ID NO: 12392 - DNA, 18 bp, Artificial Sequence
  Target B2M Sequence complement
gtggccttagctgtgctc

SEQ ID NO: 12393 - DNA, 18 bp, Artificial Sequence
  Target B2M Sequence complement
tggccttagctgtgctcg

SEQ ID NO: 12394 - DNA, 18 bp, Artificial Sequence
  Target B2M Sequence complement
ggccttagctgtgctcgc

SEQ ID NO: 12395 - DNA, 18 bp, Artificial Sequence
  Target B2M Sequence complement
gccttagctgtgctcgcg

SEQ ID NO: 12396 - DNA, 18 bp, Artificial Sequence
  Target B2M Sequence complement
ccttagctgtgctcgcgc

SEQ ID NO: 12397 - DNA, 18 bp, Artificial Sequence
  Target B2M Sequence complement
cttagctgtgctcgcgct

SEQ ID NO: 12398 - DNA, 18 bp, Artificial Sequence
  Target B2M Sequence complement
tagctgtgctcgcgctac

SEQ ID NO: 12399 - DNA, 18 bp, Artificial Sequence
  Target B2M Sequence complement
agctgtgctcgcgctact

SEQ ID NO: 12400 - DNA, 18 bp, Artificial Sequence
  Target B2M Sequence complement
gctgtgctcgcgctactc

SEQ ID NO: 12401 - DNA, 18 bp, Artificial Sequence
  Target B2M Sequence complement
ctgtgctcgcgctactct

SEQ ID NO: 12402 - DNA, 18 bp, Artificial Sequence
  Target B2M Sequence complement
tgtgctcgcgctactctc

SEQ ID NO: 12403 - DNA, 18 bp, Artificial Sequence
  Target B2M Sequence complement
gtgctcgcgctactctct

SEQ ID NO: 12404 - DNA, 18 bp, Artificial Sequence
  Target B2M Sequence complement
tgctcgcgctactctctc

SEQ ID NO: 12405 - DNA, 18 bp, Artificial Sequence
  Target B2M Sequence complement
gctcgcgctactctctct

SEQ ID NO: 12406 - DNA, 18 bp, Artificial Sequence
  Target B2M Sequence complement
ctctttctggcctggagg

SEQ ID NO: 12407 - DNA, 18 bp, Artificial Sequence
  Target B2M Sequence complement
tctttctggcctggaggc

SEQ ID NO: 12408 - DNA, 18 bp, Artificial Sequence
  Target B2M Sequence complement
ctttctggcctggaggct

SEQ ID NO: 12409 - DNA, 18 bp, Artificial Sequence
  Target B2M Sequence complement
tctggcctggaggctatc

SEQ ID NO: 12410 - DNA, 18 bp, Artificial Sequence
  Target B2M Sequence complement
ctggcctggaggctatcc

SEQ ID NO: 12411 - DNA, 18 bp, Artificial Sequence
  Target B2M Sequence complement
tggcctggaggctatcca

SEQ ID NO: 12412 - DNA, 18 bp, Artificial Sequence
  Target B2M Sequence complement
ggcctggaggctatccag

SEQ ID NO: 12413 - DNA, 18 bp, Artificial Sequence
  Target B2M Sequence complement
gcctggaggctatccagc

SEQ ID NO: 12414 - DNA, 18 bp, Artificial Sequence
  Target B2M Sequence complement
cctggaggctatccagcg

SEQ ID NO: 12415 - DNA, 18 bp, Artificial Sequence
  Target B2M Sequence complement
ctggaggctatccagcgt

SEQ ID NO: 12416 - DNA, 18 bp, Artificial Sequence
  Target B2M Sequence complement
ggaggctatccagcgtac

SEQ ID NO: 12417 - DNA, 18 bp, Artificial Sequence
  Target B2M Sequence complement
ggctatccagcgtactcc

SEQ ID NO: 12418 - DNA, 18 bp, Artificial Sequence
  Target B2M Sequence complement
gagtatgcctgccgtgtg

SEQ ID NO: 12419 - DNA, 18 bp, Artificial Sequence
  Target B2M Sequence complement
atgcctgccgtgtgaacc

SEQ ID NO: 12420 - DNA, 18 bp, Artificial Sequence
  Target B2M Sequence complement
tgcctgccgtgtgaacca

SEQ ID NO: 12421 - DNA, 18 bp, Artificial Sequence
  Target B2M Sequence complement
gcctgccgtgtgaaccat

SEQ ID NO: 12422 - DNA, 18 bp, Artificial Sequence
  Target B2M Sequence complement
cctgccgtgtgaaccatg

SEQ ID NO: 12423 - DNA, 18 bp, Artificial Sequence
  Target B2M Sequence complement
ttgcttgctttttaatat

SEQ ID NO: 12424 - DNA, 18 bp, Artificial Sequence
  Target B2M Sequence complement
tgcttgctttttaatatt

SEQ ID NO: 12425 - DNA, 18 bp, Artificial Sequence
  Target B2M Sequence complement
cttgctttttaatattga

SEQ ID NO: 12426 - DNA, 18 bp, Artificial Sequence
  Target B2M Sequence complement
ttgctttttaatattgat

SEQ ID NO: 12427 - DNA, 18 bp, Artificial Sequence
  Target B2M Sequence complement
tgctttttaatattgata

SEQ ID NO: 12428 - DNA, 18 bp, Artificial Sequence
  Target B2M Sequence complement
gctttttaatattgatat

SEQ ID NO: 12429 - DNA, 18 bp, Artificial Sequence
  Target B2M Sequence complement
ctttttaatattgatatg

SEQ ID NO: 12430 - DNA, 18 bp, Artificial Sequence
  Target B2M Sequence complement
tttttaatattgatatgc

SEQ ID NO: 12431 - DNA, 18 bp, Artificial Sequence
  Target B2M Sequence complement
ttttaatattgatatgct

SEQ ID NO: 12432 - DNA, 18 bp, Artificial Sequence
  Target B2M Sequence complement
tttaatattgatatgctt

SEQ ID NO: 12433 - DNA, 18 bp, Artificial Sequence
  Target B2M Sequence complement
ttaatattgatatgctta

SEQ ID NO: 12434 - DNA, 18 bp, Artificial Sequence
  Target B2M Sequence complement
taatattgatatgcttat

SEQ ID NO: 12435 - DNA, 18 bp, Artificial Sequence
  Target B2M Sequence complement
aatattgatatgcttata

SEQ ID NO: 12436 - DNA, 18 bp, Artificial Sequence
  Target B2M Sequence complement
atattgatatgcttatac

SEQ ID NO: 12437 - DNA, 18 bp, Artificial Sequence
  Target B2M Sequence complement
tattgatatgcttataca

SEQ ID NO: 12438 - DNA, 18 bp, Artificial Sequence
  Target B2M Sequence complement
ttatacacttacacttta

SEQ ID NO: 12439 - DNA, 18 bp, Artificial Sequence
  Target B2M Sequence complement
tatacacttacactttat

SEQ ID NO: 12440 - DNA, 18 bp, Artificial Sequence
  Target B2M Sequence complement
aaaatgtagggttataat

SEQ ID NO: 12441 - DNA, 18 bp, Artificial Sequence
  Target B2M Sequence complement
aaatgtagggttataata

SEQ ID NO: 12442 - DNA, 18 bp, Artificial Sequence
  Target B2M Sequence complement
aatgtagggttataataa

SEQ ID NO: 12443 - DNA, 18 bp, Artificial Sequence
  Target B2M Sequence complement
atgtagggttataataat

SEQ ID NO: 12444 - DNA, 18 bp, Artificial Sequence
  Target B2M Sequence complement
tagggttataataatgtt

SEQ ID NO: 12445 - DNA, 18 bp, Artificial Sequence
  Target B2M Sequence complement
agggttataataatgtta

SEQ ID NO: 12446 - DNA, 18 bp, Artificial Sequence
  Target B2M Sequence complement
gggttataataatgttaa

SEQ ID NO: 12447 - DNA, 18 bp, Artificial Sequence
  Target B2M Sequence complement
ggttataataatgttaac

SEQ ID NO: 12448 - DNA, 18 bp, Artificial Sequence
  Target B2M Sequence complement
gttataataatgttaaca

SEQ ID NO: 12449 - DNA, 18 bp, Artificial Sequence
  Target B2M Sequence complement
ttataataatgttaacat

SEQ ID NO: 12450 - DNA, 18 bp, Artificial Sequence
  Target B2M Sequence complement
tataataatgttaacatg

SEQ ID NO: 12451 - DNA, 18 bp, Artificial Sequence
  Target B2M Sequence complement
ataataatgttaacatgg

SEQ ID NO: 12452 - DNA, 18 bp, Artificial Sequence
  Target B2M Sequence complement
taataatgttaacatgga

SEQ ID NO: 12453 - DNA, 18 bp, Artificial Sequence
  Target B2M Sequence complement
acatgatcttctttataa

SEQ ID NO: 12454 - DNA, 18 bp, Artificial Sequence
  Target B2M Sequence complement
catgatcttctttataat

SEQ ID NO: 12455 - DNA, 18 bp, Artificial Sequence
  Target B2M Sequence complement
atgatcttctttataatt

SEQ ID NO: 12456 - DNA, 18 bp, Artificial Sequence
  Target B2M Sequence complement
tgatcttctttataattc

SEQ ID NO: 12457 - DNA, 18 bp, Artificial Sequence
  Target B2M Sequence complement
gatcttctttataattct

SEQ ID NO: 12458 - DNA, 18 bp, Artificial Sequence
  Target B2M Sequence complement
atcttctttataattcta

SEQ ID NO: 12459 - DNA, 18 bp, Artificial Sequence
  Target B2M Sequence complement
tcttctttataattctac

SEQ ID NO: 12460 - DNA, 18 bp, Artificial Sequence
  Target B2M Sequence complement
cttctttataattctact

SEQ ID NO: 12461 - DNA, 18 bp, Artificial Sequence
  Target B2M Sequence complement
ttctttataattctactt

SEQ ID NO: 12462 - DNA, 18 bp, Artificial Sequence
  Target B2M Sequence complement
tctttataattctacttt

SEQ ID NO: 12463 - DNA, 18 bp, Artificial Sequence
  Target B2M Sequence complement
ctttataattctactttg

SEQ ID NO: 12464 - DNA, 18 bp, Artificial Sequence
  Target B2M Sequence complement
tttataattctactttga

SEQ ID NO: 12465 - DNA, 18 bp, Artificial Sequence
  Target B2M Sequence complement
ttataattctactttgag

SEQ ID NO: 12466 - DNA, 18 bp, Artificial Sequence
  Target B2M Sequence complement
tataattctactttgagt

SEQ ID NO: 12467 - DNA, 18 bp, Artificial Sequence
  Target B2M Sequence complement
ctgagcaggttgctccac

SEQ ID NO: 12468 - DNA, 18 bp, Artificial Sequence
  Target B2M Sequence complement
gagcaggttgctccacag

SEQ ID NO: 12469 - DNA, 18 bp, Artificial Sequence
  Target B2M Sequence complement
agcaggttgctccacagg

SEQ ID NO: 12470 - DNA, 18 bp, Artificial Sequence
  Target B2M Sequence complement
gcaggttgctccacaggt

SEQ ID NO: 12471 - DNA, 18 bp, Artificial Sequence
  Target B2M Sequence complement
ggttgctccacaggtagc

SEQ ID NO: 12472 - DNA, 18 bp, Artificial Sequence
  Target B2M Sequence complement
caggtagctctaggaggg

SEQ ID NO: 12473 - DNA, 18 bp, Artificial Sequence
  Target B2M Sequence complement
aggtagctctaggagggc

SEQ ID NO: 12474 - DNA, 18 bp, Artificial Sequence
  Target B2M Sequence complement
ggtagctctaggagggct

SEQ ID NO: 12475 - DNA, 18 bp, Artificial Sequence
  Target B2M Sequence complement
gtagctctaggagggctg

SEQ ID NO: 12476 - DNA, 18 bp, Artificial Sequence
  Target B2M Sequence complement
tagctctaggagggctgg

SEQ ID NO: 12477 - DNA, 18 bp, Artificial Sequence
  Target B2M Sequence complement
agctctaggagggctggc

SEQ ID NO: 12478 - DNA, 18 bp, Artificial Sequence
  Target B2M Sequence complement
gctctaggagggctggca

SEQ ID NO: 12479 - DNA, 18 bp, Artificial Sequence
  Target B2M Sequence complement
ctctaggagggctggcaa

SEQ ID NO: 12480 - DNA, 18 bp, Artificial Sequence
  Target B2M Sequence complement
tctaggagggctggcaac

SEQ ID NO: 12481 - DNA, 18 bp, Artificial Sequence
  Target B2M Sequence complement
ctaggagggctggcaact

SEQ ID NO: 12482 - DNA, 18 bp, Artificial Sequence
  Target B2M Sequence complement
ggagggctggcaacttag

SEQ ID NO: 12483 - DNA, 18 bp, Artificial Sequence
  Target B2M Sequence complement
gggctggcaacttagagg

SEQ ID NO: 12484 - DNA, 18 bp, Artificial Sequence
  Target B2M Sequence complement
ggcaacttagaggtgggg

SEQ ID NO: 12485 - DNA, 18 bp, Artificial Sequence
  Target B2M Sequence complement
cttagaggtggggagcag

SEQ ID NO: 12486 - DNA, 18 bp, Artificial Sequence
  Target B2M Sequence complement
tagaggtggggagcagag

SEQ ID NO: 12487 - DNA, 18 bp, Artificial Sequence
  Target B2M Sequence complement
agaggtggggagcagaga

SEQ ID NO: 12488 - DNA, 18 bp, Artificial Sequence
  Target B2M Sequence complement
gaggtggggagcagagaa

SEQ ID NO: 12489 - DNA, 18 bp, Artificial Sequence
  Target B2M Sequence complement
ataagttaacttccaatt

SEQ ID NO: 12490 - DNA, 18 bp, Artificial Sequence
  Target B2M Sequence complement
taagttaacttccaattt

SEQ ID NO: 12491 - DNA, 18 bp, Artificial Sequence
  Target B2M Sequence complement
aagttaacttccaattta

SEQ ID NO: 12492 - DNA, 18 bp, Artificial Sequence
  Target B2M Sequence complement
ttaacttccaatttacat

SEQ ID NO: 12493 - DNA, 18 bp, Artificial Sequence
  Target B2M Sequence complement
taacttccaatttacata

SEQ ID NO: 12494 - DNA, 18 bp, Artificial Sequence
  Target B2M Sequence complement
gggaaaatttagaaatat

SEQ ID NO: 12495 - DNA, 18 bp, Artificial Sequence
  Target B2M Sequence complement
ggaaaatttagaaatata

SEQ ID NO: 12496 - DNA, 18 bp, Artificial Sequence
  Target B2M Sequence complement
gaaaatttagaaatataa

SEQ ID NO: 12497 - DNA, 18 bp, Artificial Sequence
  Target B2M Sequence complement
aaaatttagaaatataat

SEQ ID NO: 12498 - DNA, 18 bp, Artificial Sequence
  Target B2M Sequence complement
aaatttagaaatataatt

SEQ ID NO: 12499 - DNA, 18 bp, Artificial Sequence
  Target B2M Sequence complement
aatttagaaatataattg

SEQ ID NO: 12500 - DNA, 18 bp, Artificial Sequence
  Target B2M Sequence complement
atttagaaatataattga

SEQ ID NO: 12501 - DNA, 18 bp, Artificial Sequence
  Target B2M Sequence complement
tttagaaatataattgac

SEQ ID NO: 12502 - DNA, 18 bp, Artificial Sequence
  Target B2M Sequence complement
ttagaaatataattgaca

SEQ ID NO: 12503 - DNA, 18 bp, Artificial Sequence
  Target B2M Sequence complement
tagaaatataattgacag

SEQ ID NO: 12504 - DNA, 18 bp, Artificial Sequence
  Target B2M Sequence complement
aaatataattgacaggat

SEQ ID NO: 12505 - DNA, 18 bp, Artificial Sequence
  Target B2M Sequence complement
aatataattgacaggatt

SEQ ID NO: 12506 - DNA, 18 bp, Artificial Sequence
  Target B2M Sequence complement
atataattgacaggatta

SEQ ID NO: 12507 - DNA, 18 bp, Artificial Sequence
  Target B2M Sequence complement
tataattgacaggattat

SEQ ID NO: 12508 - DNA, 18 bp, Artificial Sequence
  Target B2M Sequence complement
ataattgacaggattatt

SEQ ID NO: 12509 - DNA, 18 bp, Artificial Sequence
  Target B2M Sequence complement
gattattggaaatttgtt

SEQ ID NO: 12510 - DNA, 18 bp, Artificial Sequence
  Target B2M Sequence complement
attattggaaatttgtta

SEQ ID NO: 12511 - DNA, 18 bp, Artificial Sequence
  Target B2M Sequence complement
ttattggaaatttgttat

SEQ ID NO: 12512 - DNA, 18 bp, Artificial Sequence
  Target B2M Sequence complement
tattggaaatttgttata

SEQ ID NO: 12513 - DNA, 18 bp, Artificial Sequence
  Target B2M Sequence complement
attggaaatttgttataa

SEQ ID NO: 12514 - DNA, 18 bp, Artificial Sequence
  Target B2M Sequence complement
ttggaaatttgttataat

SEQ ID NO: 12515 - DNA, 18 bp, Artificial Sequence
  Target B2M Sequence complement
tggaaatttgttataatg

SEQ ID NO: 12516 - DNA, 18 bp, Artificial Sequence
  Target B2M Sequence complement
ggaaatttgttataatga

SEQ ID NO: 12517 - DNA, 18 bp, Artificial Sequence
  Target B2M Sequence complement
gaaatttgttataatgaa

SEQ ID NO: 12518 - DNA, 18 bp, Artificial Sequence
  Target B2M Sequence complement
aaatttgttataatgaat

SEQ ID NO: 12519 - DNA, 18 bp, Artificial Sequence
  Target B2M Sequence complement
aatttgttataatgaatg

SEQ ID NO: 12520 - DNA, 18 bp, Artificial Sequence
  Target B2M Sequence complement
atttgttataatgaatga

SEQ ID NO: 12521 - DNA, 18 bp, Artificial Sequence
  Target B2M Sequence complement
tttgttataatgaatgaa

SEQ ID NO: 12522 - DNA, 18 bp, Artificial Sequence
  Target B2M Sequence complement
ttgttataatgaatgaaa

SEQ ID NO: 12523 - DNA, 18 bp, Artificial Sequence
  Target B2M Sequence complement
tgttataatgaatgaaac

SEQ ID NO: 12524 - DNA, 18 bp, Artificial Sequence
  Target B2M Sequence complement
gttataatgaatgaaaca

SEQ ID NO: 12525 - DNA, 18 bp, Artificial Sequence
  Target B2M Sequence complement
ttataatgaatgaaacat

SEQ ID NO: 12526 - DNA, 18 bp, Artificial Sequence
  Target B2M Sequence complement
tataatgaatgaaacatt

SEQ ID NO: 12527 - DNA, 18 bp, Artificial Sequence
  Target B2M Sequence complement
ataatgaatgaaacattt

SEQ ID NO: 12528 - DNA, 18 bp, Artificial Sequence
  Target B2M Sequence complement
taatgaatgaaacatttt

SEQ ID NO: 12529 - DNA, 18 bp, Artificial Sequence
  Target B2M Sequence complement
aatgaatgaaacattttg

SEQ ID NO: 12530 - DNA, 18 bp, Artificial Sequence
  Target B2M Sequence complement
atgaatgaaacattttgt

SEQ ID NO: 12531 - DNA, 18 bp, Artificial Sequence
  Target B2M Sequence complement
aatgaaacattttgtcat

SEQ ID NO: 12532 - DNA, 18 bp, Artificial Sequence
  Target B2M Sequence complement
atgaaacattttgtcata

SEQ ID NO: 12533 - DNA, 18 bp, Artificial Sequence
  Target B2M Sequence complement
tgaaacattttgtcatat

SEQ ID NO: 12534 - DNA, 18 bp, Artificial Sequence
  Target B2M Sequence complement
gaaacattttgtcatata

SEQ ID NO: 12535 - DNA, 18 bp, Artificial Sequence
  Target B2M Sequence complement
aaacattttgtcatataa

SEQ ID NO: 12536 - DNA, 18 bp, Artificial Sequence
  Target B2M Sequence complement
aacattttgtcatataag

SEQ ID NO: 12537 - DNA, 18 bp, Artificial Sequence
  Target B2M Sequence complement
acattttgtcatataaga

SEQ ID NO: 12538 - DNA, 18 bp, Artificial Sequence
  Target B2M Sequence complement
cattttgtcatataagat

SEQ ID NO: 12539 - DNA, 18 bp, Artificial Sequence
  Target B2M Sequence complement
attttgtcatataagatt

SEQ ID NO: 12540 - DNA, 18 bp, Artificial Sequence
  Target B2M Sequence complement
ttttgtcatataagattc

SEQ ID NO: 12541 - DNA, 18 bp, Artificial Sequence
  Target B2M Sequence complement
tttgtcatataagattca

SEQ ID NO: 12542 - DNA, 18 bp, Artificial Sequence
  Target B2M Sequence complement
ttgtcatataagattcat

SEQ ID NO: 12543 - DNA, 18 bp, Artificial Sequence
  Target B2M Sequence complement
tgtcatataagattcata

SEQ ID NO: 12544 - DNA, 18 bp, Artificial Sequence
  Target B2M Sequence complement
gtcatataagattcatat

SEQ ID NO: 12545 - DNA, 18 bp, Artificial Sequence
  Target B2M Sequence complement
tcatataagattcatatt

SEQ ID NO: 12546 - DNA, 18 bp, Artificial Sequence
  Target B2M Sequence complement
catataagattcatattt

SEQ ID NO: 12547 - DNA, 18 bp, Artificial Sequence
  Target B2M Sequence complement
atataagattcatattta

SEQ ID NO: 12548 - DNA, 18 bp, Artificial Sequence
  Target B2M Sequence complement
tataagattcatatttac

SEQ ID NO: 12549 - DNA, 18 bp, Artificial Sequence
  Target B2M Sequence complement
ataagattcatatttact

SEQ ID NO: 12550 - DNA, 18 bp, Artificial Sequence
  Target B2M Sequence complement
taagattcatatttactt

SEQ ID NO: 12551 - DNA, 18 bp, Artificial Sequence
  Target B2M Sequence complement
aagattcatatttacttc

SEQ ID NO: 12552 - DNA, 18 bp, Artificial Sequence
  Target B2M Sequence complement
agattcatatttacttct

SEQ ID NO: 12553 - DNA, 18 bp, Artificial Sequence
  Target B2M Sequence complement
gattcatatttacttctt

SEQ ID NO: 12554 - DNA, 18 bp, Artificial Sequence
  Target B2M Sequence complement
attcatatttacttctta

SEQ ID NO: 12555 - DNA, 18 bp, Artificial Sequence
  Target B2M Sequence complement
ttcatatttacttcttat

SEQ ID NO: 12556 - DNA, 18 bp, Artificial Sequence
  Target B2M Sequence complement
tcatatttacttcttata

SEQ ID NO: 12557 - DNA, 18 bp, Artificial Sequence
  Target B2M Sequence complement
catatttacttcttatac

SEQ ID NO: 12558 - DNA, 18 bp, Artificial Sequence
  Target B2M Sequence complement
atatttacttcttataca

SEQ ID NO: 12559 - DNA, 18 bp, Artificial Sequence
  Target B2M Sequence complement
tatttacttcttatacat

SEQ ID NO: 12560 - DNA, 18 bp, Artificial Sequence
  Target B2M Sequence complement
atttacttcttatacatt

SEQ ID NO: 12561 - DNA, 18 bp, Artificial Sequence
  Target B2M Sequence complement
tttacttcttatacattt

SEQ ID NO: 12562 - DNA, 18 bp, Artificial Sequence
  Target B2M Sequence complement
ttacttcttatacatttg

SEQ ID NO: 12563 - DNA, 18 bp, Artificial Sequence
  Target B2M Sequence complement
tacttcttatacatttga

SEQ ID NO: 12564 - DNA, 18 bp, Artificial Sequence
  Target B2M Sequence complement
acttcttatacatttgat

SEQ ID NO: 12565 - DNA, 18 bp, Artificial Sequence
  Target B2M Sequence complement
cttcttatacatttgata

SEQ ID NO: 12566 - DNA, 18 bp, Artificial Sequence
  Target B2M Sequence complement
ttcttatacatttgataa

SEQ ID NO: 12567 - DNA, 18 bp, Artificial Sequence
  Target B2M Sequence complement
tcttatacatttgataaa

SEQ ID NO: 12568 - DNA, 18 bp, Artificial Sequence
  Target B2M Sequence complement
cttatacatttgataaag

SEQ ID NO: 12569 - DNA, 18 bp, Artificial Sequence
  Target B2M Sequence complement
ttatacatttgataaagt

SEQ ID NO: 12570 - DNA, 18 bp, Artificial Sequence
  Target B2M Sequence complement
tatacatttgataaagta

SEQ ID NO: 12571 - DNA, 18 bp, Artificial Sequence
  Target B2M Sequence complement
atacatttgataaagtaa

SEQ ID NO: 12572 - DNA, 18 bp, Artificial Sequence
  Target B2M Sequence complement
tacatttgataaagtaag

SEQ ID NO: 12573 - DNA, 18 bp, Artificial Sequence
  Target B2M Sequence complement
gttaatctggtttatttt

SEQ ID NO: 12574 - DNA, 18 bp, Artificial Sequence
  Target B2M Sequence complement
ttaatctggtttattttt

SEQ ID NO: 12575 - DNA, 18 bp, Artificial Sequence
  Target B2M Sequence complement
taatctggtttatttttg

SEQ ID NO: 12576 - DNA, 18 bp, Artificial Sequence
  Target B2M Sequence complement
aatctggtttatttttgt

SEQ ID NO: 12577 - DNA, 18 bp, Artificial Sequence
  Target B2M Sequence complement
atctggtttatttttgtt

SEQ ID NO: 12578 - DNA, 18 bp, Artificial Sequence
  Target B2M Sequence complement
tttatttttgttccacaa

SEQ ID NO: 12579 - DNA, 18 bp, Artificial Sequence
  Target B2M Sequence complement
ttccacaagttaaataaa

SEQ ID NO: 12580 - DNA, 18 bp, Artificial Sequence
  Target B2M Sequence complement
tccacaagttaaataaat

SEQ ID NO: 12581 - DNA, 18 bp, Artificial Sequence
  Target B2M Sequence complement
cacaagttaaataaatca

SEQ ID NO: 12582 - DNA, 18 bp, Artificial Sequence
  Target B2M Sequence complement
acaagttaaataaatcat

SEQ ID NO: 12583 - DNA, 18 bp, Artificial Sequence
  Target B2M Sequence complement
caagttaaataaatcata

SEQ ID NO: 12584 - DNA, 18 bp, Artificial Sequence
  Target B2M Sequence complement
aagttaaataaatcataa

SEQ ID NO: 12585 - DNA, 18 bp, Artificial Sequence
  Target B2M Sequence complement
agttaaataaatcataaa

SEQ ID NO: 12586 - DNA, 18 bp, Artificial Sequence
  Target B2M Sequence complement
gttaaataaatcataaaa

SEQ ID NO: 12587 - DNA, 18 bp, Artificial Sequence
  Target B2M Sequence complement
ttaaataaatcataaaac

SEQ ID NO: 12588 - DNA, 18 bp, Artificial Sequence
  Target B2M Sequence complement
taaataaatcataaaact

SEQ ID NO: 12589 - DNA, 18 bp, Artificial Sequence
  Target B2M Sequence complement
aaataaatcataaaactt

SEQ ID NO: 12590 - DNA, 18 bp, Artificial Sequence
  Target B2M Sequence complement
aataaatcataaaacttg

SEQ ID NO: 12591 - DNA, 18 bp, Artificial Sequence
  Target B2M Sequence complement
ataaatcataaaacttga

SEQ ID NO: 12592 - DNA, 19 bp, Artificial Sequence
  Target B2M Sequence complement
agctgacagcattcgggcc

SEQ ID NO: 12593 - DNA, 19 bp, Artificial Sequence
  Target B2M Sequence complement
gctgacagcattcgggccg

SEQ ID NO: 12594 - DNA, 19 bp, Artificial Sequence
  Target B2M Sequence complement
ctgacagcattcgggccga

SEQ ID NO: 12595 - DNA, 19 bp, Artificial Sequence
  Target B2M Sequence complement
tgacagcattcgggccgag

SEQ ID NO: 12596 - DNA, 19 bp, Artificial Sequence
  Target B2M Sequence complement
gacagcattcgggccgaga

SEQ ID NO: 12597 - DNA, 19 bp, Artificial Sequence
  Target B2M Sequence complement
cagcattcgggccgagatg

SEQ ID NO: 12598 - DNA, 19 bp, Artificial Sequence
  Target B2M Sequence complement
gcattcgggccgagatgtc

SEQ ID NO: 12599 - DNA, 19 bp, Artificial Sequence
  Target B2M Sequence complement
ttcgggccgagatgtctcg

SEQ ID NO: 12600 - DNA, 19 bp, Artificial Sequence
  Target B2M Sequence complement
tcgggccgagatgtctcgc

SEQ ID NO: 12601 - DNA, 19 bp, Artificial Sequence
  Target B2M Sequence complement
cgggccgagatgtctcgct

SEQ ID NO: 12602 - DNA, 19 bp, Artificial Sequence
  Target B2M Sequence complement
gggccgagatgtctcgctc

SEQ ID NO: 12603 - DNA, 19 bp, Artificial Sequence
  Target B2M Sequence complement
ggccgagatgtctcgctcc

SEQ ID NO: 12604 - DNA, 19 bp, Artificial Sequence
  Target B2M Sequence complement
gccgagatgtctcgctccg

SEQ ID NO: 12605 - DNA, 19 bp, Artificial Sequence
  Target B2M Sequence complement
ccgagatgtctcgctccgt

SEQ ID NO: 12606 - DNA, 19 bp, Artificial Sequence
  Target B2M Sequence complement
cgagatgtctcgctccgtg

SEQ ID NO: 12607 - DNA, 19 bp, Artificial Sequence
  Target B2M Sequence complement
gagatgtctcgctccgtgg

SEQ ID NO: 12608 - DNA, 19 bp, Artificial Sequence
  Target B2M Sequence complement
agatgtctcgctccgtggc

SEQ ID NO: 12609 - DNA, 19 bp, Artificial Sequence
  Target B2M Sequence complement
gatgtctcgctccgtggcc

SEQ ID NO: 12610 - DNA, 19 bp, Artificial Sequence
  Target B2M Sequence complement
atgtctcgctccgtggcct

SEQ ID NO: 12611 - DNA, 19 bp, Artificial Sequence
  Target B2M Sequence complement
tgtctcgctccgtggcctt

SEQ ID NO: 12612 - DNA, 19 bp, Artificial Sequence
  Target B2M Sequence complement
gtctcgctccgtggcctta

SEQ ID NO: 12613 - DNA, 19 bp, Artificial Sequence
  Target B2M Sequence complement
tctcgctccgtggccttag

SEQ ID NO: 12614 - DNA, 19 bp, Artificial Sequence
  Target B2M Sequence complement
ctcgctccgtggccttagc

SEQ ID NO: 12615 - DNA, 19 bp, Artificial Sequence
  Target B2M Sequence complement
tcgctccgtggccttagct

SEQ ID NO: 12616 - DNA, 19 bp, Artificial Sequence
  Target B2M Sequence complement
cgctccgtggccttagctg

SEQ ID NO: 12617 - DNA, 19 bp, Artificial Sequence
  Target B2M Sequence complement
gctccgtggccttagctgt

SEQ ID NO: 12618 - DNA, 19 bp, Artificial Sequence
  Target B2M Sequence complement
ctccgtggccttagctgtg

SEQ ID NO: 12619 - DNA, 19 bp, Artificial Sequence
  Target B2M Sequence complement
tccgtggccttagctgtgc

SEQ ID NO: 12620 - DNA, 19 bp, Artificial Sequence
  Target B2M Sequence complement
ccgtggccttagctgtgct

SEQ ID NO: 12621 - DNA, 19 bp, Artificial Sequence
  Target B2M Sequence complement
cgtggccttagctgtgctc

SEQ ID NO: 12622 - DNA, 19 bp, Artificial Sequence
  Target B2M Sequence complement
gtggccttagctgtgctcg

SEQ ID NO: 12623 - DNA, 19 bp, Artificial Sequence
  Target B2M Sequence complement
tggccttagctgtgctcgc

SEQ ID NO: 12624 - DNA, 19 bp, Artificial Sequence
  Target B2M Sequence complement
ggccttagctgtgctcgcg

SEQ ID NO: 12625 - DNA, 19 bp, Artificial Sequence
  Target B2M Sequence complement
gccttagctgtgctcgcgc

SEQ ID NO: 12626 - DNA, 19 bp, Artificial Sequence
  Target B2M Sequence complement
ccttagctgtgctcgcgct

SEQ ID NO: 12627 - DNA, 19 bp, Artificial Sequence
  Target B2M Sequence complement
agctgtgctcgcgctactc

SEQ ID NO: 12628 - DNA, 19 bp, Artificial Sequence
  Target B2M Sequence complement
gctgtgctcgcgctactct

SEQ ID NO: 12629 - DNA, 19 bp, Artificial Sequence
  Target B2M Sequence complement
ctgtgctcgcgctactctc

SEQ ID NO: 12630 - DNA, 19 bp, Artificial Sequence
  Target B2M Sequence complement
gtgctcgcgctactctctc

SEQ ID NO: 12631 - DNA, 19 bp, Artificial Sequence
  Target B2M Sequence complement
ctctttctggcctggaggc

SEQ ID NO: 12632 - DNA, 19 bp, Artificial Sequence
  Target B2M Sequence complement
tctggcctggaggctatcc

SEQ ID NO: 12633 - DNA, 19 bp, Artificial Sequence
  Target B2M Sequence complement
ctggcctggaggctatcca

SEQ ID NO: 12634 - DNA, 19 bp, Artificial Sequence
  Target B2M Sequence complement
tggcctggaggctatccag

SEQ ID NO: 12635 - DNA, 19 bp, Artificial Sequence
  Target B2M Sequence complement
ggcctggaggctatccagc

SEQ ID NO: 12636 - DNA, 19 bp, Artificial Sequence
  Target B2M Sequence complement
gcctggaggctatccagcg

SEQ ID NO: 12637 - DNA, 19 bp, Artificial Sequence
  Target B2M Sequence complement
cctggaggctatccagcgt

SEQ ID NO: 12638 - DNA, 19 bp, Artificial Sequence
  Target B2M Sequence complement
gcctgccgtgtgaaccatg

SEQ ID NO: 12639 - DNA, 19 bp, Artificial Sequence
  Target B2M Sequence complement
ttgcttgctttttaatatt

SEQ ID NO: 12640 - DNA, 19 bp, Artificial Sequence
  Target B2M Sequence complement
cttgctttttaatattgat

SEQ ID NO: 12641 - DNA, 19 bp, Artificial Sequence
  Target B2M Sequence complement
ttgctttttaatattgata

SEQ ID NO: 12642 - DNA, 19 bp, Artificial Sequence
  Target B2M Sequence complement
tgctttttaatattgatat

SEQ ID NO: 12643 - DNA, 19 bp, Artificial Sequence
  Target B2M Sequence complement
gctttttaatattgatatg

SEQ ID NO: 12644 - DNA, 19 bp, Artificial Sequence
  Target B2M Sequence complement
ctttttaatattgatatgc

SEQ ID NO: 12645 - DNA, 19 bp, Artificial Sequence
  Target B2M Sequence complement
tttttaatattgatatgct

SEQ ID NO: 12646 - DNA, 19 bp, Artificial Sequence
  Target B2M Sequence complement
ttttaatattgatatgctt

SEQ ID NO: 12647 - DNA, 19 bp, Artificial Sequence
  Target B2M Sequence complement
tttaatattgatatgctta

SEQ ID NO: 12648 - DNA, 19 bp, Artificial Sequence
  Target B2M Sequence complement
ttaatattgatatgcttat

SEQ ID NO: 12649 - DNA, 19 bp, Artificial Sequence
  Target B2M Sequence complement
taatattgatatgcttata

SEQ ID NO: 12650 - DNA, 19 bp, Artificial Sequence
  Target B2M Sequence complement
aatattgatatgcttatac

SEQ ID NO: 12651 - DNA, 19 bp, Artificial Sequence
  Target B2M Sequence complement
atattgatatgcttataca

SEQ ID NO: 12652 - DNA, 19 bp, Artificial Sequence
  Target B2M Sequence complement
ttatacacttacactttat

SEQ ID NO: 12653 - DNA, 19 bp, Artificial Sequence
  Target B2M Sequence complement
aaaatgtagggttataata

SEQ ID NO: 12654 - DNA, 19 bp, Artificial Sequence
  Target B2M Sequence complement
aaatgtagggttataataa

SEQ ID NO: 12655 - DNA, 19 bp, Artificial Sequence
  Target B2M Sequence complement
aatgtagggttataataat

SEQ ID NO: 12656 - DNA, 19 bp, Artificial Sequence
  Target B2M Sequence complement
tagggttataataatgtta

SEQ ID NO: 12657 - DNA, 19 bp, Artificial Sequence
  Target B2M Sequence complement
agggttataataatgttaa

SEQ ID NO: 12658 - DNA, 19 bp, Artificial Sequence
  Target B2M Sequence complement
ggttataataatgttaaca

SEQ ID NO: 12659 - DNA, 19 bp, Artificial Sequence
  Target B2M Sequence complement
gttataataatgttaacat

SEQ ID NO: 12660 - DNA, 19 bp, Artificial Sequence
  Target B2M Sequence complement
ttataataatgttaacatg

SEQ ID NO: 12661 - DNA, 19 bp, Artificial Sequence
  Target B2M Sequence complement
tataataatgttaacatgg

SEQ ID NO: 12662 - DNA, 19 bp, Artificial Sequence
  Target B2M Sequence complement
ataataatgttaacatgga

SEQ ID NO: 12663 - DNA, 19 bp, Artificial Sequence
  Target B2M Sequence complement
acatgatcttctttataat

SEQ ID NO: 12664 - DNA, 19 bp, Artificial Sequence
  Target B2M Sequence complement
catgatcttctttataatt

SEQ ID NO: 12665 - DNA, 19 bp, Artificial Sequence
  Target B2M Sequence complement
atgatcttctttataattc

SEQ ID NO: 12666 - DNA, 19 bp, Artificial Sequence
  Target B2M Sequence complement
tgatcttctttataattct

SEQ ID NO: 12667 - DNA, 19 bp, Artificial Sequence
  Target B2M Sequence complement
gatcttctttataattcta

SEQ ID NO: 12668 - DNA, 19 bp, Artificial Sequence
  Target B2M Sequence complement
atcttctttataattctac

SEQ ID NO: 12669 - DNA, 19 bp, Artificial Sequence
  Target B2M Sequence complement
tcttctttataattctact

SEQ ID NO: 12670 - DNA, 19 bp, Artificial Sequence
  Target B2M Sequence complement
cttctttataattctactt

SEQ ID NO: 12671 - DNA, 19 bp, Artificial Sequence
  Target B2M Sequence complement
ttctttataattctacttt

SEQ ID NO: 12672 - DNA, 19 bp, Artificial Sequence
  Target B2M Sequence complement
tctttataattctactttg

SEQ ID NO: 12673 - DNA, 19 bp, Artificial Sequence
  Target B2M Sequence complement
ctttataattctactttga

SEQ ID NO: 12674 - DNA, 19 bp, Artificial Sequence
  Target B2M Sequence complement
tttataattctactttgag

SEQ ID NO: 12675 - DNA, 19 bp, Artificial Sequence
  Target B2M Sequence complement
ttataattctactttgagt

SEQ ID NO: 12676 - DNA, 19 bp, Artificial Sequence
  Target B2M Sequence complement
gagcaggttgctccacagg

SEQ ID NO: 12677 - DNA, 19 bp, Artificial Sequence
  Target B2M Sequence complement
caggtagctctaggagggc

SEQ ID NO: 12678 - DNA, 19 bp, Artificial Sequence
  Target B2M Sequence complement
ggtagctctaggagggctg

SEQ ID NO: 12679 - DNA, 19 bp, Artificial Sequence
  Target B2M Sequence complement
gtagctctaggagggctgg

SEQ ID NO: 12680 - DNA, 19 bp, Artificial Sequence
  Target B2M Sequence complement
tagctctaggagggctggc

SEQ ID NO: 12681 - DNA, 19 bp, Artificial Sequence
  Target B2M Sequence complement
agctctaggagggctggca

SEQ ID NO: 12682 - DNA, 19 bp, Artificial Sequence
  Target B2M Sequence complement
gctctaggagggctggcaa

SEQ ID NO: 12683 - DNA, 19 bp, Artificial Sequence
  Target B2M Sequence complement
ctctaggagggctggcaac

SEQ ID NO: 12684 - DNA, 19 bp, Artificial Sequence
  Target B2M Sequence complement
ataagttaacttccaattt

SEQ ID NO: 12685 - DNA, 19 bp, Artificial Sequence
  Target B2M Sequence complement
taagttaacttccaattta

SEQ ID NO: 12686 - DNA, 19 bp, Artificial Sequence
  Target B2M Sequence complement
ttaacttccaatttacata

SEQ ID NO: 12687 - DNA, 19 bp, Artificial Sequence
  Target B2M Sequence complement
gggaaaatttagaaatata

SEQ ID NO: 12688 - DNA, 19 bp, Artificial Sequence
  Target B2M Sequence complement
ggaaaatttagaaatataa

SEQ ID NO: 12689 - DNA, 19 bp, Artificial Sequence
  Target B2M Sequence complement
gaaaatttagaaatataat

SEQ ID NO: 12690 - DNA, 19 bp, Artificial Sequence
  Target B2M Sequence complement
aaaatttagaaatataatt

SEQ ID NO: 12691 - DNA, 19 bp, Artificial Sequence
  Target B2M Sequence complement
aaatttagaaatataattg

SEQ ID NO: 12692 - DNA, 19 bp, Artificial Sequence
  Target B2M Sequence complement
aatttagaaatataattga

SEQ ID NO: 12693 - DNA, 19 bp, Artificial Sequence
  Target B2M Sequence complement
atttagaaatataattgac

SEQ ID NO: 12694 - DNA, 19 bp, Artificial Sequence
  Target B2M Sequence complement
tttagaaatataattgaca

SEQ ID NO: 12695 - DNA, 19 bp, Artificial Sequence
  Target B2M Sequence complement
ttagaaatataattgacag

SEQ ID NO: 12696 - DNA, 19 bp, Artificial Sequence
  Target B2M Sequence complement
aaatataattgacaggatt

SEQ ID NO: 12697 - DNA, 19 bp, Artificial Sequence
  Target B2M Sequence complement
aatataattgacaggatta

SEQ ID NO: 12698 - DNA, 19 bp, Artificial Sequence
  Target B2M Sequence complement
atataattgacaggattat

SEQ ID NO: 12699 - DNA, 19 bp, Artificial Sequence
  Target B2M Sequence complement
tataattgacaggattatt

SEQ ID NO: 12700 - DNA, 19 bp, Artificial Sequence
  Target B2M Sequence complement
gattattggaaatttgtta

SEQ ID NO: 12701 - DNA, 19 bp, Artificial Sequence
  Target B2M Sequence complement
attattggaaatttgttat

SEQ ID NO: 12702 - DNA, 19 bp, Artificial Sequence
  Target B2M Sequence complement
ttattggaaatttgttata

SEQ ID NO: 12703 - DNA, 19 bp, Artificial Sequence
  Target B2M Sequence complement
tattggaaatttgttataa

SEQ ID NO: 12704 - DNA, 19 bp, Artificial Sequence
  Target B2M Sequence complement
attggaaatttgttataat

SEQ ID NO: 12705 - DNA, 19 bp, Artificial Sequence
  Target B2M Sequence complement
ttggaaatttgttataatg

SEQ ID NO: 12706 - DNA, 19 bp, Artificial Sequence
  Target B2M Sequence complement
tggaaatttgttataatga

SEQ ID NO: 12707 - DNA, 19 bp, Artificial Sequence
  Target B2M Sequence complement
ggaaatttgttataatgaa

SEQ ID NO: 12708 - DNA, 19 bp, Artificial Sequence
  Target B2M Sequence complement
gaaatttgttataatgaat

SEQ ID NO: 12709 - DNA, 19 bp, Artificial Sequence
  Target B2M Sequence complement
aaatttgttataatgaatg

SEQ ID NO: 12710 - DNA, 19 bp, Artificial Sequence
  Target B2M Sequence complement
aatttgttataatgaatga

SEQ ID NO: 12711 - DNA, 19 bp, Artificial Sequence
  Target B2M Sequence complement
atttgttataatgaatgaa

SEQ ID NO: 12712 - DNA, 19 bp, Artificial Sequence
  Target B2M Sequence complement
tttgttataatgaatgaaa

SEQ ID NO: 12713 - DNA, 19 bp, Artificial Sequence
  Target B2M Sequence complement
ttgttataatgaatgaaac

SEQ ID NO: 12714 - DNA, 19 bp, Artificial Sequence
  Target B2M Sequence complement
tgttataatgaatgaaaca

SEQ ID NO: 12715 - DNA, 19 bp, Artificial Sequence
  Target B2M Sequence complement
gttataatgaatgaaacat

SEQ ID NO: 12716 - DNA, 19 bp, Artificial Sequence
  Target B2M Sequence complement
ttataatgaatgaaacatt

SEQ ID NO: 12717 - DNA, 19 bp, Artificial Sequence
  Target B2M Sequence complement
tataatgaatgaaacattt

SEQ ID NO: 12718 - DNA, 19 bp, Artificial Sequence
  Target B2M Sequence complement
ataatgaatgaaacatttt

SEQ ID NO: 12719 - DNA, 19 bp, Artificial Sequence
  Target B2M Sequence complement
taatgaatgaaacattttg

SEQ ID NO: 12720 - DNA, 19 bp, Artificial Sequence
  Target B2M Sequence complement
aatgaatgaaacattttgt

SEQ ID NO: 12721 - DNA, 19 bp, Artificial Sequence
  Target B2M Sequence complement
aatgaaacattttgtcata

SEQ ID NO: 12722 - DNA, 19 bp, Artificial Sequence
  Target B2M Sequence complement
atgaaacattttgtcatat

SEQ ID NO: 12723 - DNA, 19 bp, Artificial Sequence
  Target B2M Sequence complement
tgaaacattttgtcatata

SEQ ID NO: 12724 - DNA, 19 bp, Artificial Sequence
  Target B2M Sequence complement
gaaacattttgtcatataa

SEQ ID NO: 12725 - DNA, 19 bp, Artificial Sequence
  Target B2M Sequence complement
aaacattttgtcatataag

SEQ ID NO: 12726 - DNA, 19 bp, Artificial Sequence
  Target B2M Sequence complement
aacattttgtcatataaga

SEQ ID NO: 12727 - DNA, 19 bp, Artificial Sequence
  Target B2M Sequence complement
acattttgtcatataagat

SEQ ID NO: 12728 - DNA, 19 bp, Artificial Sequence
  Target B2M Sequence complement
cattttgtcatataagatt

SEQ ID NO: 12729 - DNA, 19 bp, Artificial Sequence
  Target B2M Sequence complement
attttgtcatataagattc

SEQ ID NO: 12730 - DNA, 19 bp, Artificial Sequence
  Target B2M Sequence complement
ttttgtcatataagattca

SEQ ID NO: 12731 - DNA, 19 bp, Artificial Sequence
  Target B2M Sequence complement
tttgtcatataagattcat

SEQ ID NO: 12732 - DNA, 19 bp, Artificial Sequence
  Target B2M Sequence complement
ttgtcatataagattcata

SEQ ID NO: 12733 - DNA, 19 bp, Artificial Sequence
  Target B2M Sequence complement
tgtcatataagattcatat

SEQ ID NO: 12734 - DNA, 19 bp, Artificial Sequence
  Target B2M Sequence complement
gtcatataagattcatatt

SEQ ID NO: 12735 - DNA, 19 bp, Artificial Sequence
  Target B2M Sequence complement
tcatataagattcatattt

SEQ ID NO: 12736 - DNA, 19 bp, Artificial Sequence
  Target B2M Sequence complement
catataagattcatattta

SEQ ID NO: 12737 - DNA, 19 bp, Artificial Sequence
  Target B2M Sequence complement
atataagattcatatttac

SEQ ID NO: 12738 - DNA, 19 bp, Artificial Sequence
  Target B2M Sequence complement
tataagattcatatttact

SEQ ID NO: 12739 - DNA, 19 bp, Artificial Sequence
  Target B2M Sequence complement
ataagattcatatttactt

SEQ ID NO: 12740 - DNA, 19 bp, Artificial Sequence
  Target B2M Sequence complement
taagattcatatttacttc

SEQ ID NO: 12741 - DNA, 19 bp, Artificial Sequence
  Target B2M Sequence complement
aagattcatatttacttct

SEQ ID NO: 12742 - DNA, 19 bp, Artificial Sequence
  Target B2M Sequence complement
agattcatatttacttctt

SEQ ID NO: 12743 - DNA, 19 bp, Artificial Sequence
  Target B2M Sequence complement
gattcatatttacttctta

SEQ ID NO: 12744 - DNA, 19 bp, Artificial Sequence
  Target B2M Sequence complement
attcatatttacttcttat

SEQ ID NO: 12745 - DNA, 19 bp, Artificial Sequence
  Target B2M Sequence complement
ttcatatttacttcttata

SEQ ID NO: 12746 - DNA, 19 bp, Artificial Sequence
  Target B2M Sequence complement
tcatatttacttcttatac

SEQ ID NO: 12747 - DNA, 19 bp, Artificial Sequence
  Target B2M Sequence complement
catatttacttcttataca

SEQ ID NO: 12748 - DNA, 19 bp, Artificial Sequence
  Target B2M Sequence complement
atatttacttcttatacat

SEQ ID NO: 12749 - DNA, 19 bp, Artificial Sequence
  Target B2M Sequence complement
tatttacttcttatacatt

SEQ ID NO: 12750 - DNA, 19 bp, Artificial Sequence
  Target B2M Sequence complement
atttacttcttatacattt

SEQ ID NO: 12751 - DNA, 19 bp, Artificial Sequence
  Target B2M Sequence complement
tttacttcttatacatttg

SEQ ID NO: 12752 - DNA, 19 bp, Artificial Sequence
  Target B2M Sequence complement
ttacttcttatacatttga

SEQ ID NO: 12753 - DNA, 19 bp, Artificial Sequence
  Target B2M Sequence complement
tacttcttatacatttgat

SEQ ID NO: 12754 - DNA, 19 bp, Artificial Sequence
  Target B2M Sequence complement
acttcttatacatttgata

SEQ ID NO: 12755 - DNA, 19 bp, Artificial Sequence
  Target B2M Sequence complement
cttcttatacatttgataa

SEQ ID NO: 12756 - DNA, 19 bp, Artificial Sequence
  Target B2M Sequence complement
ttcttatacatttgataaa

SEQ ID NO: 12757 - DNA, 19 bp, Artificial Sequence
  Target B2M Sequence complement
tcttatacatttgataaag

SEQ ID NO: 12758 - DNA, 19 bp, Artificial Sequence
  Target B2M Sequence complement
cttatacatttgataaagt

SEQ ID NO: 12759 - DNA, 19 bp, Artificial Sequence
  Target B2M Sequence complement
ttatacatttgataaagta

SEQ ID NO: 12760 - DNA, 19 bp, Artificial Sequence
  Target B2M Sequence complement
tatacatttgataaagtaa

SEQ ID NO: 12761 - DNA, 19 bp, Artificial Sequence
  Target B2M Sequence complement
atacatttgataaagtaag

SEQ ID NO: 12762 - DNA, 19 bp, Artificial Sequence
  Target B2M Sequence complement
gttaatctggtttattttt

SEQ ID NO: 12763 - DNA, 19 bp, Artificial Sequence
  Target B2M Sequence complement
ttaatctggtttatttttg

SEQ ID NO: 12764 - DNA, 19 bp, Artificial Sequence
  Target B2M Sequence complement
taatctggtttatttttgt

SEQ ID NO: 12765 - DNA, 19 bp, Artificial Sequence
  Target B2M Sequence complement
aatctggtttatttttgtt

SEQ ID NO: 12766 - DNA, 19 bp, Artificial Sequence
  Target B2M Sequence complement
ttccacaagttaaataaat

SEQ ID NO: 12767 - DNA, 19 bp, Artificial Sequence
  Target B2M Sequence complement
cacaagttaaataaatcat

SEQ ID NO: 12768 - DNA, 19 bp, Artificial Sequence
  Target B2M Sequence complement
acaagttaaataaatcata

SEQ ID NO: 12769 - DNA, 19 bp, Artificial Sequence
  Target B2M Sequence complement
caagttaaataaatcataa

SEQ ID NO: 12770 - DNA, 19 bp, Artificial Sequence
  Target B2M Sequence complement
aagttaaataaatcataaa

SEQ ID NO: 12771 - DNA, 19 bp, Artificial Sequence
  Target B2M Sequence complement
agttaaataaatcataaaa

SEQ ID NO: 12772 - DNA, 19 bp, Artificial Sequence
  Target B2M Sequence complement
gttaaataaatcataaaac

SEQ ID NO: 12773 - DNA, 19 bp, Artificial Sequence
  Target B2M Sequence complement
ttaaataaatcataaaact

SEQ ID NO: 12774 - DNA, 19 bp, Artificial Sequence
  Target B2M Sequence complement
taaataaatcataaaactt

SEQ ID NO: 12775 - DNA, 19 bp, Artificial Sequence
  Target B2M Sequence complement
aaataaatcataaaacttg

SEQ ID NO: 12776 - DNA, 19 bp, Artificial Sequence
  Target B2M Sequence complement
aataaatcataaaacttga

SEQ ID NO: 12777 - DNA, 20 bp, Artificial Sequence
  Target B2M Sequence complement
gaagctgacagcattcgggc

SEQ ID NO: 12778 - DNA, 20 bp, Artificial Sequence
  Target B2M Sequence complement
aagctgacagcattcgggcc

SEQ ID NO: 12779 - DNA, 20 bp, Artificial Sequence
  Target B2M Sequence complement
agctgacagcattcgggccg

SEQ ID NO: 12780 - DNA, 20 bp, Artificial Sequence
  Target B2M Sequence complement
gctgacagcattcgggccga

SEQ ID NO: 12781 - DNA, 20 bp, Artificial Sequence
  Target B2M Sequence complement
ctgacagcattcgggccgag

SEQ ID NO: 12782 - DNA, 20 bp, Artificial Sequence
  Target B2M Sequence complement
tgacagcattcgggccgaga

SEQ ID NO: 12783 - DNA, 20 bp, Artificial Sequence
  Target B2M Sequence complement
gacagcattcgggccgagat

SEQ ID NO: 12784 - DNA, 20 bp, Artificial Sequence
  Target B2M Sequence complement
acagcattcgggccgagatg

SEQ ID NO: 12785 - DNA, 20 bp, Artificial Sequence
  Target B2M Sequence complement
cagcattcgggccgagatgt

SEQ ID NO: 12786 - DNA, 20 bp, Artificial Sequence
  Target B2M Sequence complement
agcattcgggccgagatgtc

SEQ ID NO: 12787 - DNA, 20 bp, Artificial Sequence
  Target B2M Sequence complement
gcattcgggccgagatgtct

SEQ ID NO: 12788 - DNA, 20 bp, Artificial Sequence
  Target B2M Sequence complement
cattcgggccgagatgtctc

SEQ ID NO: 12789 - DNA, 20 bp, Artificial Sequence
  Target B2M Sequence complement
attcgggccgagatgtctcg

SEQ ID NO: 12790 - DNA, 20 bp, Artificial Sequence
  Target B2M Sequence complement
ttcgggccgagatgtctcgc

SEQ ID NO: 12791 - DNA, 20 bp, Artificial Sequence
  Target B2M Sequence complement
tcgggccgagatgtctcgct

SEQ ID NO: 12792 - DNA, 20 bp, Artificial Sequence
  Target B2M Sequence complement
cgggccgagatgtctcgctc

SEQ ID NO: 12793 - DNA, 20 bp, Artificial Sequence
  Target B2M Sequence complement
gggccgagatgtctcgctcc

SEQ ID NO: 12794 - DNA, 20 bp, Artificial Sequence
  Target B2M Sequence complement
ggccgagatgtctcgctccg

SEQ ID NO: 12795 - DNA, 20 bp, Artificial Sequence
  Target B2M Sequence complement
gccgagatgtctcgctccgt

SEQ ID NO: 12796 - DNA, 20 bp, Artificial Sequence
  Target B2M Sequence complement
ccgagatgtctcgctccgtg

SEQ ID NO: 12797 - DNA, 20 bp, Artificial Sequence
  Target B2M Sequence complement
cgagatgtctcgctccgtgg

SEQ ID NO: 12798 - DNA, 20 bp, Artificial Sequence
  Target B2M Sequence complement
gagatgtctcgctccgtggc

SEQ ID NO: 12799 - DNA, 20 bp, Artificial Sequence
  Target B2M Sequence complement
agatgtctcgctccgtggcc

SEQ ID NO: 12800 - DNA, 20 bp, Artificial Sequence
  Target B2M Sequence complement
gatgtctcgctccgtggcct

SEQ ID NO: 12801 - DNA, 20 bp, Artificial Sequence
  Target B2M Sequence complement
atgtctcgctccgtggcctt

SEQ ID NO: 12802 - DNA, 20 bp, Artificial Sequence
  Target B2M Sequence complement
tgtctcgctccgtggcctta

SEQ ID NO: 12803 - DNA, 20 bp, Artificial Sequence
  Target B2M Sequence complement
gtctcgctccgtggccttag

SEQ ID NO: 12804 - DNA, 20 bp, Artificial Sequence
  Target B2M Sequence complement
tctcgctccgtggccttagc

SEQ ID NO: 12805 - DNA, 20 bp, Artificial Sequence
  Target B2M Sequence complement
ctcgctccgtggccttagct

SEQ ID NO: 12806 - DNA, 20 bp, Artificial Sequence
  Target B2M Sequence complement
tcgctccgtggccttagctg

SEQ ID NO: 12807 - DNA, 20 bp, Artificial Sequence
  Target B2M Sequence complement
cgctccgtggccttagctgt

SEQ ID NO: 12808 - DNA, 20 bp, Artificial Sequence
  Target B2M Sequence complement
gctccgtggccttagctgtg

SEQ ID NO: 12809 - DNA, 20 bp, Artificial Sequence
  Target B2M Sequence complement
ctccgtggccttagctgtgc

SEQ ID NO: 12810 - DNA, 20 bp, Artificial Sequence
  Target B2M Sequence complement
tccgtggccttagctgtgct

SEQ ID NO: 12811 - DNA, 20 bp, Artificial Sequence
  Target B2M Sequence complement
ccgtggccttagctgtgctc

SEQ ID NO: 12812 - DNA, 20 bp, Artificial Sequence
  Target B2M Sequence complement
cgtggccttagctgtgctcg

SEQ ID NO: 12813 - DNA, 20 bp, Artificial Sequence
  Target B2M Sequence complement
gtggccttagctgtgctcgc

SEQ ID NO: 12814 - DNA, 20 bp, Artificial Sequence
  Target B2M Sequence complement
tggccttagctgtgctcgcg

SEQ ID NO: 12815 - DNA, 20 bp, Artificial Sequence
  Target B2M Sequence complement
ggccttagctgtgctcgcgc

SEQ ID NO: 12816 - DNA, 20 bp, Artificial Sequence
  Target B2M Sequence complement
gccttagctgtgctcgcgct

SEQ ID NO: 12817 - DNA, 20 bp, Artificial Sequence
  Target B2M Sequence complement
ccttagctgtgctcgcgcta

SEQ ID NO: 12818 - DNA, 20 bp, Artificial Sequence
  Target B2M Sequence complement
cttagctgtgctcgcgctac

SEQ ID NO: 12819 - DNA, 20 bp, Artificial Sequence
  Target B2M Sequence complement
tagctgtgctcgcgctactc

SEQ ID NO: 12820 - DNA, 20 bp, Artificial Sequence
  Target B2M Sequence complement
agctgtgctcgcgctactct

SEQ ID NO: 12821 - DNA, 20 bp, Artificial Sequence
  Target B2M Sequence complement
gctgtgctcgcgctactctc

SEQ ID NO: 12822 - DNA, 20 bp, Artificial Sequence
  Target B2M Sequence complement
ctgtgctcgcgctactctct

SEQ ID NO: 12823 - DNA, 20 bp, Artificial Sequence
  Target B2M Sequence complement
tgtgctcgcgctactctctc

SEQ ID NO: 12824 - DNA, 20 bp, Artificial Sequence
  Target B2M Sequence complement
gtgctcgcgctactctctct

SEQ ID NO: 12825 - DNA, 20 bp, Artificial Sequence
  Target B2M Sequence complement
ctctctttctggcctggagg

SEQ ID NO: 12826 - DNA, 20 bp, Artificial Sequence
  Target B2M Sequence complement
tctctttctggcctggaggc

SEQ ID NO: 12827 - DNA, 20 bp, Artificial Sequence
  Target B2M Sequence complement
ctctttctggcctggaggct

SEQ ID NO: 12828 - DNA, 20 bp, Artificial Sequence
  Target B2M Sequence complement
ttctggcctggaggctatcc

SEQ ID NO: 12829 - DNA, 20 bp, Artificial Sequence
  Target B2M Sequence complement
tctggcctggaggctatcca

SEQ ID NO: 12830 - DNA, 20 bp, Artificial Sequence
  Target B2M Sequence complement
ctggcctggaggctatccag

SEQ ID NO: 12831 - DNA, 20 bp, Artificial Sequence
  Target B2M Sequence complement
tggcctggaggctatccagc

SEQ ID NO: 12832 - DNA, 20 bp, Artificial Sequence
  Target B2M Sequence complement
ggcctggaggctatccagcg

SEQ ID NO: 12833 - DNA, 20 bp, Artificial Sequence
  Target B2M Sequence complement
gcctggaggctatccagcgt

SEQ ID NO: 12834 - DNA, 20 bp, Artificial Sequence
  Target B2M Sequence complement
cctggaggctatccagcgta

SEQ ID NO: 12835 - DNA, 20 bp, Artificial Sequence
  Target B2M Sequence complement
ctggaggctatccagcgtac

SEQ ID NO: 12836 - DNA, 20 bp, Artificial Sequence
  Target B2M Sequence complement
ggaggctatccagcgtactc

SEQ ID NO: 12837 - DNA, 20 bp, Artificial Sequence
  Target B2M Sequence complement
gaggctatccagcgtactcc

SEQ ID NO: 12838 - DNA, 20 bp, Artificial Sequence
  Target B2M Sequence complement
gtatgcctgccgtgtgaacc

SEQ ID NO: 12839 - DNA, 20 bp, Artificial Sequence
  Target B2M Sequence complement
tgcctgccgtgtgaaccatg

SEQ ID NO: 12840 - DNA, 20 bp, Artificial Sequence
  Target B2M Sequence complement
gcctgccgtgtgaaccatgt

SEQ ID NO: 12841 - DNA, 20 bp, Artificial Sequence
  Target B2M Sequence complement
cctgccgtgtgaaccatgtg

SEQ ID NO: 12842 - DNA, 20 bp, Artificial Sequence
  Target B2M Sequence complement
cttgctttttaatattgata

SEQ ID NO: 12843 - DNA, 20 bp, Artificial Sequence
  Target B2M Sequence complement
ttgctttttaatattgatat

SEQ ID NO: 12844 - DNA, 20 bp, Artificial Sequence
  Target B2M Sequence complement
tgctttttaatattgatatg

SEQ ID NO: 12845 - DNA, 20 bp, Artificial Sequence
  Target B2M Sequence complement
ctttttaatattgatatgct

SEQ ID NO: 12846 - DNA, 20 bp, Artificial Sequence
  Target B2M Sequence complement
tttttaatattgatatgctt

SEQ ID NO: 12847 - DNA, 20 bp, Artificial Sequence
  Target B2M Sequence complement
ttttaatattgatatgctta

SEQ ID NO: 12848 - DNA, 20 bp, Artificial Sequence
  Target B2M Sequence complement
tttaatattgatatgcttat

SEQ ID NO: 12849 - DNA, 20 bp, Artificial Sequence
  Target B2M Sequence complement
ttaatattgatatgcttata

SEQ ID NO: 12850 - DNA, 20 bp, Artificial Sequence
  Target B2M Sequence complement
taatattgatatgcttatac

SEQ ID NO: 12851 - DNA, 20 bp, Artificial Sequence
  Target B2M Sequence complement
aatattgatatgcttataca

SEQ ID NO: 12852 - DNA, 20 bp, Artificial Sequence
  Target B2M Sequence complement
aaaatgtagggttataataa

SEQ ID NO: 12853 - DNA, 20 bp, Artificial Sequence
  Target B2M Sequence complement
aaatgtagggttataataat

SEQ ID NO: 12854 - DNA, 20 bp, Artificial Sequence
  Target B2M Sequence complement
tagggttataataatgttaa

SEQ ID NO: 12855 - DNA, 20 bp, Artificial Sequence
  Target B2M Sequence complement
ggttataataatgttaacat

SEQ ID NO: 12856 - DNA, 20 bp, Artificial Sequence
  Target B2M Sequence complement
gttataataatgttaacatg

SEQ ID NO: 12857 - DNA, 20 bp, Artificial Sequence
  Target B2M Sequence complement
ttataataatgttaacatgg

SEQ ID NO: 12858 - DNA, 20 bp, Artificial Sequence
  Target B2M Sequence complement
tataataatgttaacatgga

SEQ ID NO: 12859 - DNA, 20 bp, Artificial Sequence
  Target B2M Sequence complement
acatgatcttctttataatt

SEQ ID NO: 12860 - DNA, 20 bp, Artificial Sequence
  Target B2M Sequence complement
atgatcttctttataattct

SEQ ID NO: 12861 - DNA, 20 bp, Artificial Sequence
  Target B2M Sequence complement
tgatcttctttataattcta

SEQ ID NO: 12862 - DNA, 20 bp, Artificial Sequence
  Target B2M Sequence complement
atcttctttataattctact

SEQ ID NO: 12863 - DNA, 20 bp, Artificial Sequence
  Target B2M Sequence complement
tcttctttataattctactt

SEQ ID NO: 12864 - DNA, 20 bp, Artificial Sequence
  Target B2M Sequence complement
cttctttataattctacttt

SEQ ID NO: 12865 - DNA, 20 bp, Artificial Sequence
  Target B2M Sequence complement
ttctttataattctactttg

SEQ ID NO: 12866 - DNA, 20 bp, Artificial Sequence
  Target B2M Sequence complement
tctttataattctactttga

SEQ ID NO: 12867 - DNA, 20 bp, Artificial Sequence
  Target B2M Sequence complement
tttataattctactttgagt

SEQ ID NO: 12868 - DNA, 20 bp, Artificial Sequence
  Target B2M Sequence complement
ctgagcaggttgctccacag

SEQ ID NO: 12869 - DNA, 20 bp, Artificial Sequence
  Target B2M Sequence complement
tgagcaggttgctccacagg

SEQ ID NO: 12870 - DNA, 20 bp, Artificial Sequence
  Target B2M Sequence complement
gagcaggttgctccacaggt

SEQ ID NO: 12871 - DNA, 20 bp, Artificial Sequence
  Target B2M Sequence complement
gcaggttgctccacaggtag

SEQ ID NO: 12872 - DNA, 20 bp, Artificial Sequence
  Target B2M Sequence complement
caggttgctccacaggtagc

SEQ ID NO: 12873 - DNA, 20 bp, Artificial Sequence
  Target B2M Sequence complement
ggttgctccacaggtagctc

SEQ ID NO: 12874 - DNA, 20 bp, Artificial Sequence
  Target B2M Sequence complement
gctccacaggtagctctagg

SEQ ID NO: 12875 - DNA, 20 bp, Artificial Sequence
  Target B2M Sequence complement
ccacaggtagctctaggagg

SEQ ID NO: 12876 - DNA, 20 bp, Artificial Sequence
  Target B2M Sequence complement
cacaggtagctctaggaggg

SEQ ID NO: 12877 - DNA, 20 bp, Artificial Sequence
  Target B2M Sequence complement
acaggtagctctaggagggc

SEQ ID NO: 12878 - DNA, 20 bp, Artificial Sequence
  Target B2M Sequence complement
caggtagctctaggagggct

SEQ ID NO: 12879 - DNA, 20 bp, Artificial Sequence
  Target B2M Sequence complement
aggtagctctaggagggctg

SEQ ID NO: 12880 - DNA, 20 bp, Artificial Sequence
  Target B2M Sequence complement
ggtagctctaggagggctgg

SEQ ID NO: 12881 - DNA, 20 bp, Artificial Sequence
  Target B2M Sequence complement
gtagctctaggagggctggc

SEQ ID NO: 12882 - DNA, 20 bp, Artificial Sequence
  Target B2M Sequence complement
tagctctaggagggctggca

SEQ ID NO: 12883 - DNA, 20 bp, Artificial Sequence
  Target B2M Sequence complement
agctctaggagggctggcaa

SEQ ID NO: 12884 - DNA, 20 bp, Artificial Sequence
  Target B2M Sequence complement
gctctaggagggctggcaac

SEQ ID NO: 12885 - DNA, 20 bp, Artificial Sequence
  Target B2M Sequence complement
ctctaggagggctggcaact

SEQ ID NO: 12886 - DNA, 20 bp, Artificial Sequence
  Target B2M Sequence complement
ggagggctggcaacttagag

SEQ ID NO: 12887 - DNA, 20 bp, Artificial Sequence
  Target B2M Sequence complement
gagggctggcaacttagagg

SEQ ID NO: 12888 - DNA, 20 bp, Artificial Sequence
  Target B2M Sequence complement
gggctggcaacttagaggtg

SEQ ID NO: 12889 - DNA, 20 bp, Artificial Sequence
  Target B2M Sequence complement
ggctggcaacttagaggtgg

SEQ ID NO: 12890 - DNA, 20 bp, Artificial Sequence
  Target B2M Sequence complement
gctggcaacttagaggtggg

SEQ ID NO: 12891 - DNA, 20 bp, Artificial Sequence
  Target B2M Sequence complement
ctggcaacttagaggtgggg

SEQ ID NO: 12892 - DNA, 20 bp, Artificial Sequence
  Target B2M Sequence complement
ggcaacttagaggtggggag

SEQ ID NO: 12893 - DNA, 20 bp, Artificial Sequence
  Target B2M Sequence complement
gcaacttagaggtggggagc

SEQ ID NO: 12894 - DNA, 20 bp, Artificial Sequence
  Target B2M Sequence complement
cttagaggtggggagcagag

SEQ ID NO: 12895 - DNA, 20 bp, Artificial Sequence
  Target B2M Sequence complement
ataagttaacttccaattta

SEQ ID NO: 12896 - DNA, 20 bp, Artificial Sequence
  Target B2M Sequence complement
gggaaaatttagaaatataa

SEQ ID NO: 12897 - DNA, 20 bp, Artificial Sequence
  Target B2M Sequence complement
ggaaaatttagaaatataat

SEQ ID NO: 12898 - DNA, 20 bp, Artificial Sequence
  Target B2M Sequence complement
gaaaatttagaaatataatt

SEQ ID NO: 12899 - DNA, 20 bp, Artificial Sequence
  Target B2M Sequence complement
aaaatttagaaatataattg

SEQ ID NO: 12900 - DNA, 20 bp, Artificial Sequence
  Target B2M Sequence complement
aaatttagaaatataattga

SEQ ID NO: 12901 - DNA, 20 bp, Artificial Sequence
  Target B2M Sequence complement
aatttagaaatataattgac

SEQ ID NO: 12902 - DNA, 20 bp, Artificial Sequence
  Target B2M Sequence complement
atttagaaatataattgaca

SEQ ID NO: 12903 - DNA, 20 bp, Artificial Sequence
  Target B2M Sequence complement
tttagaaatataattgacag

SEQ ID NO: 12904 - DNA, 20 bp, Artificial Sequence
  Target B2M Sequence complement
aaatataattgacaggatta

SEQ ID NO: 12905 - DNA, 20 bp, Artificial Sequence
  Target B2M Sequence complement
aatataattgacaggattat

SEQ ID NO: 12906 - DNA, 20 bp, Artificial Sequence
  Target B2M Sequence complement
atataattgacaggattatt

SEQ ID NO: 12907 - DNA, 20 bp, Artificial Sequence
  Target B2M Sequence complement
gattattggaaatttgttat

SEQ ID NO: 12908 - DNA, 20 bp, Artificial Sequence
  Target B2M Sequence complement
attattggaaatttgttata

SEQ ID NO: 12909 - DNA, 20 bp, Artificial Sequence
  Target B2M Sequence complement
ttattggaaatttgttataa

SEQ ID NO: 12910 - DNA, 20 bp, Artificial Sequence
  Target B2M Sequence complement
tattggaaatttgttataat

SEQ ID NO: 12911 - DNA, 20 bp, Artificial Sequence
  Target B2M Sequence complement
attggaaatttgttataatg

SEQ ID NO: 12912 - DNA, 20 bp, Artificial Sequence
  Target B2M Sequence complement
ttggaaatttgttataatga

SEQ ID NO: 12913 - DNA, 20 bp, Artificial Sequence
  Target B2M Sequence complement
tggaaatttgttataatgaa

SEQ ID NO: 12914 - DNA, 20 bp, Artificial Sequence
  Target B2M Sequence complement
ggaaatttgttataatgaat

SEQ ID NO: 12915 - DNA, 20 bp, Artificial Sequence
  Target B2M Sequence complement
gaaatttgttataatgaatg

SEQ ID NO: 12916 - DNA, 20 bp, Artificial Sequence
  Target B2M Sequence complement
aaatttgttataatgaatga

SEQ ID NO: 12917 - DNA, 20 bp, Artificial Sequence
  Target B2M Sequence complement
aatttgttataatgaatgaa

SEQ ID NO: 12918 - DNA, 20 bp, Artificial Sequence
  Target B2M Sequence complement
atttgttataatgaatgaaa

SEQ ID NO: 12919 - DNA, 20 bp, Artificial Sequence
  Target B2M Sequence complement
tttgttataatgaatgaaac

SEQ ID NO: 12920 - DNA, 20 bp, Artificial Sequence
  Target B2M Sequence complement
ttgttataatgaatgaaaca

SEQ ID NO: 12921 - DNA, 20 bp, Artificial Sequence
  Target B2M Sequence complement
tgttataatgaatgaaacat

SEQ ID NO: 12922 - DNA, 20 bp, Artificial Sequence
  Target B2M Sequence complement
gttataatgaatgaaacatt

SEQ ID NO: 12923 - DNA, 20 bp, Artificial Sequence
  Target B2M Sequence complement
ttataatgaatgaaacattt

SEQ ID NO: 12924 - DNA, 20 bp, Artificial Sequence
  Target B2M Sequence complement
tataatgaatgaaacatttt

SEQ ID NO: 12925 - DNA, 20 bp, Artificial Sequence
  Target B2M Sequence complement
ataatgaatgaaacattttg

SEQ ID NO: 12926 - DNA, 20 bp, Artificial Sequence
  Target B2M Sequence complement
taatgaatgaaacattttgt

SEQ ID NO: 12927 - DNA, 20 bp, Artificial Sequence
  Target B2M Sequence complement
aatgaaacattttgtcatat

SEQ ID NO: 12928 - DNA, 20 bp, Artificial Sequence
  Target B2M Sequence complement
atgaaacattttgtcatata

SEQ ID NO: 12929 - DNA, 20 bp, Artificial Sequence
  Target B2M Sequence complement
tgaaacattttgtcatataa

SEQ ID NO: 12930 - DNA, 20 bp, Artificial Sequence
  Target B2M Sequence complement
aaacattttgtcatataaga

SEQ ID NO: 12931 - DNA, 20 bp, Artificial Sequence
  Target B2M Sequence complement
aacattttgtcatataagat

SEQ ID NO: 12932 - DNA, 20 bp, Artificial Sequence
  Target B2M Sequence complement
acattttgtcatataagatt

SEQ ID NO: 12933 - DNA, 20 bp, Artificial Sequence
  Target B2M Sequence complement
attttgtcatataagattca

SEQ ID NO: 12934 - DNA, 20 bp, Artificial Sequence
  Target B2M Sequence complement
ttttgtcatataagattcat

SEQ ID NO: 12935 - DNA, 20 bp, Artificial Sequence
  Target B2M Sequence complement
tttgtcatataagattcata

SEQ ID NO: 12936 - DNA, 20 bp, Artificial Sequence
  Target B2M Sequence complement
ttgtcatataagattcatat

SEQ ID NO: 12937 - DNA, 20 bp, Artificial Sequence
  Target B2M Sequence complement
tgtcatataagattcatatt

SEQ ID NO: 12938 - DNA, 20 bp, Artificial Sequence
  Target B2M Sequence complement
gtcatataagattcatattt

SEQ ID NO: 12939 - DNA, 20 bp, Artificial Sequence
  Target B2M Sequence complement
tcatataagattcatattta

SEQ ID NO: 12940 - DNA, 20 bp, Artificial Sequence
  Target B2M Sequence complement
catataagattcatatttac

SEQ ID NO: 12941 - DNA, 20 bp, Artificial Sequence
  Target B2M Sequence complement
atataagattcatatttact

SEQ ID NO: 12942 - DNA, 20 bp, Artificial Sequence
  Target B2M Sequence complement
tataagattcatatttactt

SEQ ID NO: 12943 - DNA, 20 bp, Artificial Sequence
  Target B2M Sequence complement
ataagattcatatttacttc

SEQ ID NO: 12944 - DNA, 20 bp, Artificial Sequence
  Target B2M Sequence complement
taagattcatatttacttct

SEQ ID NO: 12945 - DNA, 20 bp, Artificial Sequence
  Target B2M Sequence complement
aagattcatatttacttctt

SEQ ID NO: 12946 - DNA, 20 bp, Artificial Sequence
  Target B2M Sequence complement
agattcatatttacttctta

SEQ ID NO: 12947 - DNA, 20 bp, Artificial Sequence
  Target B2M Sequence complement
gattcatatttacttcttat

SEQ ID NO: 12948 - DNA, 20 bp, Artificial Sequence
  Target B2M Sequence complement
attcatatttacttcttata

SEQ ID NO: 12949 - DNA, 20 bp, Artificial Sequence
  Target B2M Sequence complement
ttcatatttacttcttatac

SEQ ID NO: 12950 - DNA, 20 bp, Artificial Sequence
  Target B2M Sequence complement
tcatatttacttcttataca

SEQ ID NO: 12951 - DNA, 20 bp, Artificial Sequence
  Target B2M Sequence complement
catatttacttcttatacat

SEQ ID NO: 12952 - DNA, 20 bp, Artificial Sequence
  Target B2M Sequence complement
atatttacttcttatacatt

SEQ ID NO: 12953 - DNA, 20 bp, Artificial Sequence
  Target B2M Sequence complement
tatttacttcttatacattt

SEQ ID NO: 12954 - DNA, 20 bp, Artificial Sequence
  Target B2M Sequence complement
atttacttcttatacatttg

SEQ ID NO: 12955 - DNA, 20 bp, Artificial Sequence
  Target B2M Sequence complement
tttacttcttatacatttga

SEQ ID NO: 12956 - DNA, 20 bp, Artificial Sequence
  Target B2M Sequence complement
ttacttcttatacatttgat

SEQ ID NO: 12957 - DNA, 20 bp, Artificial Sequence
  Target B2M Sequence complement
tacttcttatacatttgata

SEQ ID NO: 12958 - DNA, 20 bp, Artificial Sequence
  Target B2M Sequence complement
acttcttatacatttgataa

SEQ ID NO: 12959 - DNA, 20 bp, Artificial Sequence
  Target B2M Sequence complement
cttcttatacatttgataaa

SEQ ID NO: 12960 - DNA, 20 bp, Artificial Sequence
  Target B2M Sequence complement
ttcttatacatttgataaag

SEQ ID NO: 12961 - DNA, 20 bp, Artificial Sequence
  Target B2M Sequence complement
tcttatacatttgataaagt

SEQ ID NO: 12962 - DNA, 20 bp, Artificial Sequence
  Target B2M Sequence complement
cttatacatttgataaagta

SEQ ID NO: 12963 - DNA, 20 bp, Artificial Sequence
  Target B2M Sequence complement
ttatacatttgataaagtaa

SEQ ID NO: 12964 - DNA, 20 bp, Artificial Sequence
  Target B2M Sequence complement
tatacatttgataaagtaag

SEQ ID NO: 12965 - DNA, 20 bp, Artificial Sequence
  Target B2M Sequence complement
ttaatctggtttatttttgt

SEQ ID NO: 12966 - DNA, 20 bp, Artificial Sequence
  Target B2M Sequence complement
taatctggtttatttttgtt

SEQ ID NO: 12967 - DNA, 20 bp, Artificial Sequence
  Target B2M Sequence complement
cacaagttaaataaatcata

SEQ ID NO: 12968 - DNA, 20 bp, Artificial Sequence
  Target B2M Sequence complement
acaagttaaataaatcataa

SEQ ID NO: 12969 - DNA, 20 bp, Artificial Sequence
  Target B2M Sequence complement
caagttaaataaatcataaa

SEQ ID NO: 12970 - DNA, 20 bp, Artificial Sequence
  Target B2M Sequence complement
aagttaaataaatcataaaa

SEQ ID NO: 12971 - DNA, 20 bp, Artificial Sequence
  Target B2M Sequence complement
agttaaataaatcataaaac

SEQ ID NO: 12972 - DNA, 20 bp, Artificial Sequence
  Target B2M Sequence complement
gttaaataaatcataaaact

SEQ ID NO: 12973 - DNA, 20 bp, Artificial Sequence
  Target B2M Sequence complement
ttaaataaatcataaaactt

SEQ ID NO: 12974 - DNA, 20 bp, Artificial Sequence
  Target B2M Sequence complement
taaataaatcataaaacttg

SEQ ID NO: 12975 - DNA, 20 bp, Artificial Sequence
  Target B2M Sequence complement
aaataaatcataaaacttga

SEQ ID NO: 12976 - DNA, 21 bp, Artificial Sequence
  Target B2M Sequence complement
gaagctgacagcattcgggcc

SEQ ID NO: 12977 - DNA, 21 bp, Artificial Sequence
  Target B2M Sequence complement
aagctgacagcattcgggccg

SEQ ID NO: 12978 - DNA, 21 bp, Artificial Sequence
  Target B2M Sequence complement
agctgacagcattcgggccga

SEQ ID NO: 12979 - DNA, 21 bp, Artificial Sequence
  Target B2M Sequence complement
gctgacagcattcgggccgag

SEQ ID NO: 12980 - DNA, 21 bp, Artificial Sequence
  Target B2M Sequence complement
ctgacagcattcgggccgaga

SEQ ID NO: 12981 - DNA, 21 bp, Artificial Sequence
  Target B2M Sequence complement
gacagcattcgggccgagatg

SEQ ID NO: 12982 - DNA, 21 bp, Artificial Sequence
  Target B2M Sequence complement
cagcattcgggccgagatgtc

SEQ ID NO: 12983 - DNA, 21 bp, Artificial Sequence
  Target B2M Sequence complement
gcattcgggccgagatgtctc

SEQ ID NO: 12984 - DNA, 21 bp, Artificial Sequence
  Target B2M Sequence complement
cattcgggccgagatgtctcg

SEQ ID NO: 12985 - DNA, 21 bp, Artificial Sequence
  Target B2M Sequence complement
attcgggccgagatgtctcgc

SEQ ID NO: 12986 - DNA, 21 bp, Artificial Sequence
  Target B2M Sequence complement
ttcgggccgagatgtctcgct

SEQ ID NO: 12987 - DNA, 21 bp, Artificial Sequence
  Target B2M Sequence complement
tcgggccgagatgtctcgctc

SEQ ID NO: 12988 - DNA, 21 bp, Artificial Sequence
  Target B2M Sequence complement
cgggccgagatgtctcgctcc

SEQ ID NO: 12989 - DNA, 21 bp, Artificial Sequence
  Target B2M Sequence complement
gggccgagatgtctcgctccg

SEQ ID NO: 12990 - DNA, 21 bp, Artificial Sequence
  Target B2M Sequence complement
ggccgagatgtctcgctccgt

SEQ ID NO: 12991 - DNA, 21 bp, Artificial Sequence
  Target B2M Sequence complement
gccgagatgtctcgctccgtg

SEQ ID NO: 12992 - DNA, 21 bp, Artificial Sequence
  Target B2M Sequence complement
ccgagatgtctcgctccgtgg

SEQ ID NO: 12993 - DNA, 21 bp, Artificial Sequence
  Target B2M Sequence complement
cgagatgtctcgctccgtggc

SEQ ID NO: 12994 - DNA, 21 bp, Artificial Sequence
  Target B2M Sequence complement
gagatgtctcgctccgtggcc

SEQ ID NO: 12995 - DNA, 21 bp, Artificial Sequence
  Target B2M Sequence complement
agatgtctcgctccgtggcct

SEQ ID NO: 12996 - DNA, 21 bp, Artificial Sequence
  Target B2M Sequence complement
gatgtctcgctccgtggcctt

SEQ ID NO: 12997 - DNA, 21 bp, Artificial Sequence
  Target B2M Sequence complement
tgtctcgctccgtggccttag

SEQ ID NO: 12998 - DNA, 21 bp, Artificial Sequence
  Target B2M Sequence complement
gtctcgctccgtggccttagc

SEQ ID NO: 12999 - DNA, 21 bp, Artificial Sequence
  Target B2M Sequence complement
tctcgctccgtggccttagct

SEQ ID NO: 13000 - DNA, 21 bp, Artificial Sequence
  Target B2M Sequence complement
ctcgctccgtggccttagctg

SEQ ID NO: 13001 - DNA, 21 bp, Artificial Sequence
  Target B2M Sequence complement
tcgctccgtggccttagctgt

SEQ ID NO: 13002 - DNA, 21 bp, Artificial Sequence
  Target B2M Sequence complement
cgctccgtggccttagctgtg

SEQ ID NO: 13003 - DNA, 21 bp, Artificial Sequence
  Target B2M Sequence complement
gctccgtggccttagctgtgc

SEQ ID NO: 13004 - DNA, 21 bp, Artificial Sequence
  Target B2M Sequence complement
ctccgtggccttagctgtgct

SEQ ID NO: 13005 - DNA, 21 bp, Artificial Sequence
  Target B2M Sequence complement
tccgtggccttagctgtgctc

SEQ ID NO: 13006 - DNA, 21 bp, Artificial Sequence
  Target B2M Sequence complement
ccgtggccttagctgtgctcg

SEQ ID NO: 13007 - DNA, 21 bp, Artificial Sequence
  Target B2M Sequence complement
cgtggccttagctgtgctcgc

SEQ ID NO: 13008 - DNA, 21 bp, Artificial Sequence
  Target B2M Sequence complement
gtggccttagctgtgctcgcg

SEQ ID NO: 13009 - DNA, 21 bp, Artificial Sequence
  Target B2M Sequence complement
tggccttagctgtgctcgcgc

SEQ ID NO: 13010 - DNA, 21 bp, Artificial Sequence
  Target B2M Sequence complement
ggccttagctgtgctcgcgct

SEQ ID NO: 13011 - DNA, 21 bp, Artificial Sequence
  Target B2M Sequence complement
gccttagctgtgctcgcgcta

SEQ ID NO: 13012 - DNA, 21 bp, Artificial Sequence
  Target B2M Sequence complement
ccttagctgtgctcgcgctac

SEQ ID NO: 13013 - DNA, 21 bp, Artificial Sequence
  Target B2M Sequence complement
agctgtgctcgcgctactctc

SEQ ID NO: 13014 - DNA, 21 bp, Artificial Sequence
  Target B2M Sequence complement
gctgtgctcgcgctactctct

SEQ ID NO: 13015 - DNA, 21 bp, Artificial Sequence
  Target B2M Sequence complement
ctgtgctcgcgctactctctc

SEQ ID NO: 13016 - DNA, 21 bp, Artificial Sequence
  Target B2M Sequence complement
ctctctttctggcctggaggc

SEQ ID NO: 13017 - DNA, 21 bp, Artificial Sequence
  Target B2M Sequence complement
tctggcctggaggctatccag

SEQ ID NO: 13018 - DNA, 21 bp, Artificial Sequence
  Target B2M Sequence complement
ctggcctggaggctatccagc

SEQ ID NO: 13019 - DNA, 21 bp, Artificial Sequence
  Target B2M Sequence complement
tggcctggaggctatccagcg

SEQ ID NO: 13020 - DNA, 21 bp, Artificial Sequence
  Target B2M Sequence complement
ggcctggaggctatccagcgt

SEQ ID NO: 13021 - DNA, 21 bp, Artificial Sequence
  Target B2M Sequence complement
gcctggaggctatccagcgta

SEQ ID NO: 13022 - DNA, 21 bp, Artificial Sequence
  Target B2M Sequence complement
cctggaggctatccagcgtac

SEQ ID NO: 13023 - DNA, 21 bp, Artificial Sequence
  Target B2M Sequence complement
ggaggctatccagcgtactcc

SEQ ID NO: 13024 - DNA, 21 bp, Artificial Sequence
  Target B2M Sequence complement
gcctgccgtgtgaaccatgtg

SEQ ID NO: 13025 - DNA, 21 bp, Artificial Sequence
  Target B2M Sequence complement
ttgcttgctttttaatattga

SEQ ID NO: 13026 - DNA, 21 bp, Artificial Sequence
  Target B2M Sequence complement
tgcttgctttttaatattgat

SEQ ID NO: 13027 - DNA, 21 bp, Artificial Sequence
  Target B2M Sequence complement
gcttgctttttaatattgata

SEQ ID NO: 13028 - DNA, 21 bp, Artificial Sequence
  Target B2M Sequence complement
cttgctttttaatattgatat

SEQ ID NO: 13029 - DNA, 21 bp, Artificial Sequence
  Target B2M Sequence complement
ttgctttttaatattgatatg

SEQ ID NO: 13030 - DNA, 21 bp, Artificial Sequence
  Target B2M Sequence complement
tgctttttaatattgatatgc

SEQ ID NO: 13031 - DNA, 21 bp, Artificial Sequence
  Target B2M Sequence complement
gctttttaatattgatatgct

SEQ ID NO: 13032 - DNA, 21 bp, Artificial Sequence
  Target B2M Sequence complement
ctttttaatattgatatgctt

SEQ ID NO: 13033 - DNA, 21 bp, Artificial Sequence
  Target B2M Sequence complement
tttttaatattgatatgctta

SEQ ID NO: 13034 - DNA, 21 bp, Artificial Sequence
  Target B2M Sequence complement
ttttaatattgatatgcttat

SEQ ID NO: 13035 - DNA, 21 bp, Artificial Sequence
  Target B2M Sequence complement
tttaatattgatatgcttata

SEQ ID NO: 13036 - DNA, 21 bp, Artificial Sequence
  Target B2M Sequence complement
ttaatattgatatgcttatac

SEQ ID NO: 13037 - DNA, 21 bp, Artificial Sequence
  Target B2M Sequence complement
taatattgatatgcttataca

SEQ ID NO: 13038 - DNA, 21 bp, Artificial Sequence
  Target B2M Sequence complement
aatattgatatgcttatacac

SEQ ID NO: 13039 - DNA, 21 bp, Artificial Sequence
  Target B2M Sequence complement
atattgatatgcttatacact

SEQ ID NO: 13040 - DNA, 21 bp, Artificial Sequence
  Target B2M Sequence complement
tattgatatgcttatacactt

SEQ ID NO: 13041 - DNA, 21 bp, Artificial Sequence
  Target B2M Sequence complement
attgatatgcttatacactta

SEQ ID NO: 13042 - DNA, 21 bp, Artificial Sequence
  Target B2M Sequence complement
acaaaatgtagggttataata

SEQ ID NO: 13043 - DNA, 21 bp, Artificial Sequence
  Target B2M Sequence complement
caaaatgtagggttataataa

SEQ ID NO: 13044 - DNA, 21 bp, Artificial Sequence
  Target B2M Sequence complement
aaaatgtagggttataataat

SEQ ID NO: 13045 - DNA, 21 bp, Artificial Sequence
  Target B2M Sequence complement
aaatgtagggttataataatg

SEQ ID NO: 13046 - DNA, 21 bp, Artificial Sequence
  Target B2M Sequence complement
aatgtagggttataataatgt

SEQ ID NO: 13047 - DNA, 21 bp, Artificial Sequence
  Target B2M Sequence complement
atgtagggttataataatgtt

SEQ ID NO: 13048 - DNA, 21 bp, Artificial Sequence
  Target B2M Sequence complement
tgtagggttataataatgtta

SEQ ID NO: 13049 - DNA, 21 bp, Artificial Sequence
  Target B2M Sequence complement
gtagggttataataatgttaa

SEQ ID NO: 13050 - DNA, 21 bp, Artificial Sequence
  Target B2M Sequence complement
tagggttataataatgttaac

SEQ ID NO: 13051 - DNA, 21 bp, Artificial Sequence
  Target B2M Sequence complement
agggttataataatgttaaca

SEQ ID NO: 13052 - DNA, 21 bp, Artificial Sequence
  Target B2M Sequence complement
gggttataataatgttaacat

SEQ ID NO: 13053 - DNA, 21 bp, Artificial Sequence
  Target B2M Sequence complement
ggttataataatgttaacatg

SEQ ID NO: 13054 - DNA, 21 bp, Artificial Sequence
  Target B2M Sequence complement
gttataataatgttaacatgg

SEQ ID NO: 13055 - DNA, 21 bp, Artificial Sequence
  Target B2M Sequence complement
ttataataatgttaacatgga

SEQ ID NO: 13056 - DNA, 21 bp, Artificial Sequence
  Target B2M Sequence complement
tataataatgttaacatggac

SEQ ID NO: 13057 - DNA, 21 bp, Artificial Sequence
  Target B2M Sequence complement
ataataatgttaacatggaca

SEQ ID NO: 13058 - DNA, 21 bp, Artificial Sequence
  Target B2M Sequence complement
taataatgttaacatggacat

SEQ ID NO: 13059 - DNA, 21 bp, Artificial Sequence
  Target B2M Sequence complement
gacatgatcttctttataatt

SEQ ID NO: 13060 - DNA, 21 bp, Artificial Sequence
  Target B2M Sequence complement
acatgatcttctttataattc

SEQ ID NO: 13061 - DNA, 21 bp, Artificial Sequence
  Target B2M Sequence complement
catgatcttctttataattct

SEQ ID NO: 13062 - DNA, 21 bp, Artificial Sequence
  Target B2M Sequence complement
atgatcttctttataattcta

SEQ ID NO: 13063 - DNA, 21 bp, Artificial Sequence
  Target B2M Sequence complement
tgatcttctttataattctac

SEQ ID NO: 13064 - DNA, 21 bp, Artificial Sequence
  Target B2M Sequence complement
gatcttctttataattctact

SEQ ID NO: 13065 - DNA, 21 bp, Artificial Sequence
  Target B2M Sequence complement
atcttctttataattctactt

SEQ ID NO: 13066 - DNA, 21 bp, Artificial Sequence
  Target B2M Sequence complement
tcttctttataattctacttt

SEQ ID NO: 13067 - DNA, 21 bp, Artificial Sequence
  Target B2M Sequence complement
cttctttataattctactttg

SEQ ID NO: 13068 - DNA, 21 bp, Artificial Sequence
  Target B2M Sequence complement
ttctttataattctactttga

SEQ ID NO: 13069 - DNA, 21 bp, Artificial Sequence
  Target B2M Sequence complement
tctttataattctactttgag

SEQ ID NO: 13070 - DNA, 21 bp, Artificial Sequence
  Target B2M Sequence complement
ctttataattctactttgagt

SEQ ID NO: 13071 - DNA, 21 bp, Artificial Sequence
  Target B2M Sequence complement
tttataattctactttgagtg

SEQ ID NO: 13072 - DNA, 21 bp, Artificial Sequence
  Target B2M Sequence complement
ctgagcaggttgctccacagg

SEQ ID NO: 13073 - DNA, 21 bp, Artificial Sequence
  Target B2M Sequence complement
gcaggttgctccacaggtagc

SEQ ID NO: 13074 - DNA, 21 bp, Artificial Sequence
  Target B2M Sequence complement
ccacaggtagctctaggaggg

SEQ ID NO: 13075 - DNA, 21 bp, Artificial Sequence
  Target B2M Sequence complement
cacaggtagctctaggagggc

SEQ ID NO: 13076 - DNA, 21 bp, Artificial Sequence
  Target B2M Sequence complement
caggtagctctaggagggctg

SEQ ID NO: 13077 - DNA, 21 bp, Artificial Sequence
  Target B2M Sequence complement
aggtagctctaggagggctgg

SEQ ID NO: 13078 - DNA, 21 bp, Artificial Sequence
  Target B2M Sequence complement
ggtagctctaggagggctggc

SEQ ID NO: 13079 - DNA, 21 bp, Artificial Sequence
  Target B2M Sequence complement
gtagctctaggagggctggca

SEQ ID NO: 13080 - DNA, 21 bp, Artificial Sequence
  Target B2M Sequence complement
agctctaggagggctggcaac

SEQ ID NO: 13081 - DNA, 21 bp, Artificial Sequence
  Target B2M Sequence complement
gctctaggagggctggcaact

SEQ ID NO: 13082 - DNA, 21 bp, Artificial Sequence
  Target B2M Sequence complement
ggagggctggcaacttagagg

SEQ ID NO: 13083 - DNA, 21 bp, Artificial Sequence
  Target B2M Sequence complement
gggctggcaacttagaggtgg

SEQ ID NO: 13084 - DNA, 21 bp, Artificial Sequence
  Target B2M Sequence complement
ggctggcaacttagaggtggg

SEQ ID NO: 13085 - DNA, 21 bp, Artificial Sequence
  Target B2M Sequence complement
gctggcaacttagaggtgggg

SEQ ID NO: 13086 - DNA, 21 bp, Artificial Sequence
  Target B2M Sequence complement
ggcaacttagaggtggggagc

SEQ ID NO: 13087 - DNA, 21 bp, Artificial Sequence
  Target B2M Sequence complement
aaagcttgttaagatagttaa

SEQ ID NO: 13088 - DNA, 21 bp, Artificial Sequence
  Target B2M Sequence complement
cataagttaacttccaattta

SEQ ID NO: 13089 - DNA, 21 bp, Artificial Sequence
  Target B2M Sequence complement
ataagttaacttccaatttac

SEQ ID NO: 13090 - DNA, 21 bp, Artificial Sequence
  Target B2M Sequence complement
taagttaacttccaatttaca

SEQ ID NO: 13091 - DNA, 21 bp, Artificial Sequence
  Target B2M Sequence complement
aagttaacttccaatttacat

SEQ ID NO: 13092 - DNA, 21 bp, Artificial Sequence
  Target B2M Sequence complement
agttaacttccaatttacata

SEQ ID NO: 13093 - DNA, 21 bp, Artificial Sequence
  Target B2M Sequence complement
ttaacttccaatttacatact

SEQ ID NO: 13094 - DNA, 21 bp, Artificial Sequence
  Target B2M Sequence complement
ggggaaaatttagaaatataa

SEQ ID NO: 13095 - DNA, 21 bp, Artificial Sequence
  Target B2M Sequence complement
gggaaaatttagaaatataat

SEQ ID NO: 13096 - DNA, 21 bp, Artificial Sequence
  Target B2M Sequence complement
ggaaaatttagaaatataatt

SEQ ID NO: 13097 - DNA, 21 bp, Artificial Sequence
  Target B2M Sequence complement
gaaaatttagaaatataattg

SEQ ID NO: 13098 - DNA, 21 bp, Artificial Sequence
  Target B2M Sequence complement
aaaatttagaaatataattga

SEQ ID NO: 13099 - DNA, 21 bp, Artificial Sequence
  Target B2M Sequence complement
aaatttagaaatataattgac

SEQ ID NO: 13100 - DNA, 21 bp, Artificial Sequence
  Target B2M Sequence complement
aatttagaaatataattgaca

SEQ ID NO: 13101 - DNA, 21 bp, Artificial Sequence
  Target B2M Sequence complement
atttagaaatataattgacag

SEQ ID NO: 13102 - DNA, 21 bp, Artificial Sequence
  Target B2M Sequence complement
tttagaaatataattgacagg

SEQ ID NO: 13103 - DNA, 21 bp, Artificial Sequence
  Target B2M Sequence complement
ttagaaatataattgacagga

SEQ ID NO: 13104 - DNA, 21 bp, Artificial Sequence
  Target B2M Sequence complement
tagaaatataattgacaggat

SEQ ID NO: 13105 - DNA, 21 bp, Artificial Sequence
  Target B2M Sequence complement
agaaatataattgacaggatt

SEQ ID NO: 13106 - DNA, 21 bp, Artificial Sequence
  Target B2M Sequence complement
gaaatataattgacaggatta

SEQ ID NO: 13107 - DNA, 21 bp, Artificial Sequence
  Target B2M Sequence complement
aaatataattgacaggattat

SEQ ID NO: 13108 - DNA, 21 bp, Artificial Sequence
  Target B2M Sequence complement
aatataattgacaggattatt

SEQ ID NO: 13109 - DNA, 21 bp, Artificial Sequence
  Target B2M Sequence complement
atataattgacaggattattg

SEQ ID NO: 13110 - DNA, 21 bp, Artificial Sequence
  Target B2M Sequence complement
aggattattggaaatttgtta

SEQ ID NO: 13111 - DNA, 21 bp, Artificial Sequence
  Target B2M Sequence complement
ggattattggaaatttgttat

SEQ ID NO: 13112 - DNA, 21 bp, Artificial Sequence
  Target B2M Sequence complement
gattattggaaatttgttata

SEQ ID NO: 13113 - DNA, 21 bp, Artificial Sequence
  Target B2M Sequence complement
attattggaaatttgttataa

SEQ ID NO: 13114 - DNA, 21 bp, Artificial Sequence
  Target B2M Sequence complement
ttattggaaatttgttataat

SEQ ID NO: 13115 - DNA, 21 bp, Artificial Sequence
  Target B2M Sequence complement
tattggaaatttgttataatg

SEQ ID NO: 13116 - DNA, 21 bp, Artificial Sequence
  Target B2M Sequence complement
attggaaatttgttataatga

SEQ ID NO: 13117 - DNA, 21 bp, Artificial Sequence
  Target B2M Sequence complement
ttggaaatttgttataatgaa

SEQ ID NO: 13118 - DNA, 21 bp, Artificial Sequence
  Target B2M Sequence complement
tggaaatttgttataatgaat

SEQ ID NO: 13119 - DNA, 21 bp, Artificial Sequence
  Target B2M Sequence complement
ggaaatttgttataatgaatg

SEQ ID NO: 13120 - DNA, 21 bp, Artificial Sequence
  Target B2M Sequence complement
gaaatttgttataatgaatga

SEQ ID NO: 13121 - DNA, 21 bp, Artificial Sequence
  Target B2M Sequence complement
aaatttgttataatgaatgaa

SEQ ID NO: 13122 - DNA, 21 bp, Artificial Sequence
  Target B2M Sequence complement
aatttgttataatgaatgaaa

SEQ ID NO: 13123 - DNA, 21 bp, Artificial Sequence
  Target B2M Sequence complement
atttgttataatgaatgaaac

SEQ ID NO: 13124 - DNA, 21 bp, Artificial Sequence
  Target B2M Sequence complement
tttgttataatgaatgaaaca

SEQ ID NO: 13125 - DNA, 21 bp, Artificial Sequence
  Target B2M Sequence complement
ttgttataatgaatgaaacat

SEQ ID NO: 13126 - DNA, 21 bp, Artificial Sequence
  Target B2M Sequence complement
tgttataatgaatgaaacatt

SEQ ID NO: 13127 - DNA, 21 bp, Artificial Sequence
  Target B2M Sequence complement
gttataatgaatgaaacattt

SEQ ID NO: 13128 - DNA, 21 bp, Artificial Sequence
  Target B2M Sequence complement
ttataatgaatgaaacatttt

SEQ ID NO: 13129 - DNA, 21 bp, Artificial Sequence
  Target B2M Sequence complement
tataatgaatgaaacattttg

SEQ ID NO: 13130 - DNA, 21 bp, Artificial Sequence
  Target B2M Sequence complement
ataatgaatgaaacattttgt

SEQ ID NO: 13131 - DNA, 21 bp, Artificial Sequence
  Target B2M Sequence complement
taatgaatgaaacattttgtc

SEQ ID NO: 13132 - DNA, 21 bp, Artificial Sequence
  Target B2M Sequence complement
aatgaatgaaacattttgtca

SEQ ID NO: 13133 - DNA, 21 bp, Artificial Sequence
  Target B2M Sequence complement
atgaatgaaacattttgtcat

SEQ ID NO: 13134 - DNA, 21 bp, Artificial Sequence
  Target B2M Sequence complement
tgaatgaaacattttgtcata

SEQ ID NO: 13135 - DNA, 21 bp, Artificial Sequence
  Target B2M Sequence complement
gaatgaaacattttgtcatat

SEQ ID NO: 13136 - DNA, 21 bp, Artificial Sequence
  Target B2M Sequence complement
aatgaaacattttgtcatata

SEQ ID NO: 13137 - DNA, 21 bp, Artificial Sequence
  Target B2M Sequence complement
atgaaacattttgtcatataa

SEQ ID NO: 13138 - DNA, 21 bp, Artificial Sequence
  Target B2M Sequence complement
tgaaacattttgtcatataag

SEQ ID NO: 13139 - DNA, 21 bp, Artificial Sequence
  Target B2M Sequence complement
gaaacattttgtcatataaga

SEQ ID NO: 13140 - DNA, 21 bp, Artificial Sequence
  Target B2M Sequence complement
aaacattttgtcatataagat

SEQ ID NO: 13141 - DNA, 21 bp, Artificial Sequence
  Target B2M Sequence complement
aacattttgtcatataagatt

SEQ ID NO: 13142 - DNA, 21 bp, Artificial Sequence
  Target B2M Sequence complement
acattttgtcatataagattc

SEQ ID NO: 13143 - DNA, 21 bp, Artificial Sequence
  Target B2M Sequence complement
cattttgtcatataagattca

SEQ ID NO: 13144 - DNA, 21 bp, Artificial Sequence
  Target B2M Sequence complement
attttgtcatataagattcat

SEQ ID NO: 13145 - DNA, 21 bp, Artificial Sequence
  Target B2M Sequence complement
ttttgtcatataagattcata

SEQ ID NO: 13146 - DNA, 21 bp, Artificial Sequence
  Target B2M Sequence complement
tttgtcatataagattcatat

SEQ ID NO: 13147 - DNA, 21 bp, Artificial Sequence
  Target B2M Sequence complement
ttgtcatataagattcatatt

SEQ ID NO: 13148 - DNA, 21 bp, Artificial Sequence
  Target B2M Sequence complement
tgtcatataagattcatattt

SEQ ID NO: 13149 - DNA, 21 bp, Artificial Sequence
  Target B2M Sequence complement
gtcatataagattcatattta

SEQ ID NO: 13150 - DNA, 21 bp, Artificial Sequence
  Target B2M Sequence complement
tcatataagattcatatttac

SEQ ID NO: 13151 - DNA, 21 bp, Artificial Sequence
  Target B2M Sequence complement
catataagattcatatttact

SEQ ID NO: 13152 - DNA, 21 bp, Artificial Sequence
  Target B2M Sequence complement
atataagattcatatttactt

SEQ ID NO: 13153 - DNA, 21 bp, Artificial Sequence
  Target B2M Sequence complement
tataagattcatatttacttc

SEQ ID NO: 13154 - DNA, 21 bp, Artificial Sequence
  Target B2M Sequence complement
ataagattcatatttacttct

SEQ ID NO: 13155 - DNA, 21 bp, Artificial Sequence
  Target B2M Sequence complement
taagattcatatttacttctt

SEQ ID NO: 13156 - DNA, 21 bp, Artificial Sequence
  Target B2M Sequence complement
aagattcatatttacttctta

SEQ ID NO: 13157 - DNA, 21 bp, Artificial Sequence
  Target B2M Sequence complement
agattcatatttacttcttat

SEQ ID NO: 13158 - DNA, 21 bp, Artificial Sequence
  Target B2M Sequence complement
gattcatatttacttcttata

SEQ ID NO: 13159 - DNA, 21 bp, Artificial Sequence
  Target B2M Sequence complement
attcatatttacttcttatac

SEQ ID NO: 13160 - DNA, 21 bp, Artificial Sequence
  Target B2M Sequence complement
ttcatatttacttcttataca

SEQ ID NO: 13161 - DNA, 21 bp, Artificial Sequence
  Target B2M Sequence complement
tcatatttacttcttatacat

SEQ ID NO: 13162 - DNA, 21 bp, Artificial Sequence
  Target B2M Sequence complement
catatttacttcttatacatt

SEQ ID NO: 13163 - DNA, 21 bp, Artificial Sequence
  Target B2M Sequence complement
atatttacttcttatacattt

SEQ ID NO: 13164 - DNA, 21 bp, Artificial Sequence
  Target B2M Sequence complement
tatttacttcttatacatttg

SEQ ID NO: 13165 - DNA, 21 bp, Artificial Sequence
  Target B2M Sequence complement
atttacttcttatacatttga

SEQ ID NO: 13166 - DNA, 21 bp, Artificial Sequence
  Target B2M Sequence complement
tttacttcttatacatttgat

SEQ ID NO: 13167 - DNA, 21 bp, Artificial Sequence
  Target B2M Sequence complement
ttacttcttatacatttgata

SEQ ID NO: 13168 - DNA, 21 bp, Artificial Sequence
  Target B2M Sequence complement
tacttcttatacatttgataa

SEQ ID NO: 13169 - DNA, 21 bp, Artificial Sequence
  Target B2M Sequence complement
acttcttatacatttgataaa

SEQ ID NO: 13170 - DNA, 21 bp, Artificial Sequence
  Target B2M Sequence complement
cttcttatacatttgataaag

SEQ ID NO: 13171 - DNA, 21 bp, Artificial Sequence
  Target B2M Sequence complement
ttcttatacatttgataaagt

SEQ ID NO: 13172 - DNA, 21 bp, Artificial Sequence
  Target B2M Sequence complement
tcttatacatttgataaagta

SEQ ID NO: 13173 - DNA, 21 bp, Artificial Sequence
  Target B2M Sequence complement
cttatacatttgataaagtaa

SEQ ID NO: 13174 - DNA, 21 bp, Artificial Sequence
  Target B2M Sequence complement
ttatacatttgataaagtaag

SEQ ID NO: 13175 - DNA, 21 bp, Artificial Sequence
  Target B2M Sequence complement
tatacatttgataaagtaagg

SEQ ID NO: 13176 - DNA, 21 bp, Artificial Sequence
  Target B2M Sequence complement
tggttaatctggtttattttt

SEQ ID NO: 13177 - DNA, 21 bp, Artificial Sequence
  Target B2M Sequence complement
gttaatctggtttatttttgt

SEQ ID NO: 13178 - DNA, 21 bp, Artificial Sequence
  Target B2M Sequence complement
ttaatctggtttatttttgtt

SEQ ID NO: 13179 - DNA, 21 bp, Artificial Sequence
  Target B2M Sequence complement
taatctggtttatttttgttc

SEQ ID NO: 13180 - DNA, 21 bp, Artificial Sequence
  Target B2M Sequence complement
tttatttttgttccacaagtt

SEQ ID NO: 13181 - DNA, 21 bp, Artificial Sequence
  Target B2M Sequence complement
ttatttttgttccacaagtta

SEQ ID NO: 13182 - DNA, 21 bp, Artificial Sequence
  Target B2M Sequence complement
tatttttgttccacaagttaa

SEQ ID NO: 13183 - DNA, 21 bp, Artificial Sequence
  Target B2M Sequence complement
atttttgttccacaagttaaa

SEQ ID NO: 13184 - DNA, 21 bp, Artificial Sequence
  Target B2M Sequence complement
tttttgttccacaagttaaat

SEQ ID NO: 13185 - DNA, 21 bp, Artificial Sequence
  Target B2M Sequence complement
ttttgttccacaagttaaata

SEQ ID NO: 13186 - DNA, 21 bp, Artificial Sequence
  Target B2M Sequence complement
tttgttccacaagttaaataa

SEQ ID NO: 13187 - DNA, 21 bp, Artificial Sequence
  Target B2M Sequence complement
ttgttccacaagttaaataaa

SEQ ID NO: 13188 - DNA, 21 bp, Artificial Sequence
  Target B2M Sequence complement
tgttccacaagttaaataaat

SEQ ID NO: 13189 - DNA, 21 bp, Artificial Sequence
  Target B2M Sequence complement
ttccacaagttaaataaatca

SEQ ID NO: 13190 - DNA, 21 bp, Artificial Sequence
  Target B2M Sequence complement
tccacaagttaaataaatcat

SEQ ID NO: 13191 - DNA, 21 bp, Artificial Sequence
  Target B2M Sequence complement
ccacaagttaaataaatcata

SEQ ID NO: 13192 - DNA, 21 bp, Artificial Sequence
  Target B2M Sequence complement
cacaagttaaataaatcataa

SEQ ID NO: 13193 - DNA, 21 bp, Artificial Sequence
  Target B2M Sequence complement
acaagttaaataaatcataaa

SEQ ID NO: 13194 - DNA, 21 bp, Artificial Sequence
  Target B2M Sequence complement
caagttaaataaatcataaaa

SEQ ID NO: 13195 - DNA, 21 bp, Artificial Sequence
  Target B2M Sequence complement
aagttaaataaatcataaaac

SEQ ID NO: 13196 - DNA, 21 bp, Artificial Sequence
  Target B2M Sequence complement
agttaaataaatcataaaact

SEQ ID NO: 13197 - DNA, 21 bp, Artificial Sequence
  Target B2M Sequence complement
gttaaataaatcataaaactt

SEQ ID NO: 13198 - DNA, 21 bp, Artificial Sequence
  Target B2M Sequence complement
ttaaataaatcataaaacttg

SEQ ID NO: 13199 - DNA, 21 bp, Artificial Sequence
  Target B2M Sequence complement
taaataaatcataaaacttga

SEQ ID NO: 13200 - DNA, 22 bp, Artificial Sequence
  Target B2M Sequence complement
gaagctgacagcattcgggccg

SEQ ID NO: 13201 - DNA, 22 bp, Artificial Sequence
  Target B2M Sequence complement
agctgacagcattcgggccgag

SEQ ID NO: 13202 - DNA, 22 bp, Artificial Sequence
  Target B2M Sequence complement
gctgacagcattcgggccgaga

SEQ ID NO: 13203 - DNA, 22 bp, Artificial Sequence
  Target B2M Sequence complement
gcattcgggccgagatgtctcg

SEQ ID NO: 13204 - DNA, 22 bp, Artificial Sequence
  Target B2M Sequence complement
cattcgggccgagatgtctcgc

SEQ ID NO: 13205 - DNA, 22 bp, Artificial Sequence
  Target B2M Sequence complement
ttcgggccgagatgtctcgctc

SEQ ID NO: 13206 - DNA, 22 bp, Artificial Sequence
  Target B2M Sequence complement
tcgggccgagatgtctcgctcc

SEQ ID NO: 13207 - DNA, 22 bp, Artificial Sequence
  Target B2M Sequence complement
cgggccgagatgtctcgctccg

SEQ ID NO: 13208 - DNA, 22 bp, Artificial Sequence
  Target B2M Sequence complement
gggccgagatgtctcgctccgt

SEQ ID NO: 13209 - DNA, 22 bp, Artificial Sequence
  Target B2M Sequence complement
ggccgagatgtctcgctccgtg

SEQ ID NO: 13210 - DNA, 22 bp, Artificial Sequence
  Target B2M Sequence complement
gccgagatgtctcgctccgtgg

SEQ ID NO: 13211 - DNA, 22 bp, Artificial Sequence
  Target B2M Sequence complement
ccgagatgtctcgctccgtggc

SEQ ID NO: 13212 - DNA, 22 bp, Artificial Sequence
  Target B2M Sequence complement
cgagatgtctcgctccgtggcc

SEQ ID NO: 13213 - DNA, 22 bp, Artificial Sequence
  Target B2M Sequence complement
gagatgtctcgctccgtggcct

SEQ ID NO: 13214 - DNA, 22 bp, Artificial Sequence
  Target B2M Sequence complement
tgtctcgctccgtggccttagc

SEQ ID NO: 13215 - DNA, 22 bp, Artificial Sequence
  Target B2M Sequence complement
gtctcgctccgtggccttagct

SEQ ID NO: 13216 - DNA, 22 bp, Artificial Sequence
  Target B2M Sequence complement
tctcgctccgtggccttagctg

SEQ ID NO: 13217 - DNA, 22 bp, Artificial Sequence
  Target B2M Sequence complement
ctcgctccgtggccttagctgt

SEQ ID NO: 13218 - DNA, 22 bp, Artificial Sequence
  Target B2M Sequence complement
tcgctccgtggccttagctgtg

SEQ ID NO: 13219 - DNA, 22 bp, Artificial Sequence
  Target B2M Sequence complement
cgctccgtggccttagctgtgc

SEQ ID NO: 13220 - DNA, 22 bp, Artificial Sequence
  Target B2M Sequence complement
gctccgtggccttagctgtgct

SEQ ID NO: 13221 - DNA, 22 bp, Artificial Sequence
  Target B2M Sequence complement
ctccgtggccttagctgtgctc

SEQ ID NO: 13222 - DNA, 22 bp, Artificial Sequence
  Target B2M Sequence complement
tccgtggccttagctgtgctcg

SEQ ID NO: 13223 - DNA, 22 bp, Artificial Sequence
  Target B2M Sequence complement
ccgtggccttagctgtgctcgc

SEQ ID NO: 13224 - DNA, 22 bp, Artificial Sequence
  Target B2M Sequence complement
cgtggccttagctgtgctcgcg

SEQ ID NO: 13225 - DNA, 22 bp, Artificial Sequence
  Target B2M Sequence complement
gtggccttagctgtgctcgcgc

SEQ ID NO: 13226 - DNA, 22 bp, Artificial Sequence
  Target B2M Sequence complement
tggccttagctgtgctcgcgct

SEQ ID NO: 13227 - DNA, 22 bp, Artificial Sequence
  Target B2M Sequence complement
ggccttagctgtgctcgcgcta

SEQ ID NO: 13228 - DNA, 22 bp, Artificial Sequence
  Target B2M Sequence complement
gccttagctgtgctcgcgctac

SEQ ID NO: 13229 - DNA, 22 bp, Artificial Sequence
  Target B2M Sequence complement
gctgtgctcgcgctactctctc

SEQ ID NO: 13230 - DNA, 22 bp, Artificial Sequence
  Target B2M Sequence complement
tctggcctggaggctatccagc

SEQ ID NO: 13231 - DNA, 22 bp, Artificial Sequence
  Target B2M Sequence complement
ctggcctggaggctatccagcg

SEQ ID NO: 13232 - DNA, 22 bp, Artificial Sequence
  Target B2M Sequence complement
tggcctggaggctatccagcgt

SEQ ID NO: 13233 - DNA, 22 bp, Artificial Sequence
  Target B2M Sequence complement
ggcctggaggctatccagcgta

SEQ ID NO: 13234 - DNA, 22 bp, Artificial Sequence
  Target B2M Sequence complement
gcctggaggctatccagcgtac

SEQ ID NO: 13235 - DNA, 22 bp, Artificial Sequence
  Target B2M Sequence complement
ttgcttgctttttaatattgat

SEQ ID NO: 13236 - DNA, 22 bp, Artificial Sequence
  Target B2M Sequence complement
tgcttgctttttaatattgata

SEQ ID NO: 13237 - DNA, 22 bp, Artificial Sequence
  Target B2M Sequence complement
gcttgctttttaatattgatat

SEQ ID NO: 13238 - DNA, 22 bp, Artificial Sequence
  Target B2M Sequence complement
cttgctttttaatattgatatg

SEQ ID NO: 13239 - DNA, 22 bp, Artificial Sequence
  Target B2M Sequence complement
ttgctttttaatattgatatgc

SEQ ID NO: 13240 - DNA, 22 bp, Artificial Sequence
  Target B2M Sequence complement
tgctttttaatattgatatgct

SEQ ID NO: 13241 - DNA, 22 bp, Artificial Sequence
  Target B2M Sequence complement
gctttttaatattgatatgctt

SEQ ID NO: 13242 - DNA, 22 bp, Artificial Sequence
  Target B2M Sequence complement
ctttttaatattgatatgctta

SEQ ID NO: 13243 - DNA, 22 bp, Artificial Sequence
  Target B2M Sequence complement
tttttaatattgatatgcttat

SEQ ID NO: 13244 - DNA, 22 bp, Artificial Sequence
  Target B2M Sequence complement
ttttaatattgatatgcttata

SEQ ID NO: 13245 - DNA, 22 bp, Artificial Sequence
  Target B2M Sequence complement
tttaatattgatatgcttatac

SEQ ID NO: 13246 - DNA, 22 bp, Artificial Sequence
  Target B2M Sequence complement
ttaatattgatatgcttataca

SEQ ID NO: 13247 - DNA, 22 bp, Artificial Sequence
  Target B2M Sequence complement
taatattgatatgcttatacac

SEQ ID NO: 13248 - DNA, 22 bp, Artificial Sequence
  Target B2M Sequence complement
aatattgatatgcttatacact

SEQ ID NO: 13249 - DNA, 22 bp, Artificial Sequence
  Target B2M Sequence complement
atattgatatgcttatacactt

SEQ ID NO: 13250 - DNA, 22 bp, Artificial Sequence
  Target B2M Sequence complement
tattgatatgcttatacactta

SEQ ID NO: 13251 - DNA, 22 bp, Artificial Sequence
  Target B2M Sequence complement
acaaaatgtagggttataataa

SEQ ID NO: 13252 - DNA, 22 bp, Artificial Sequence
  Target B2M Sequence complement
caaaatgtagggttataataat

SEQ ID NO: 13253 - DNA, 22 bp, Artificial Sequence
  Target B2M Sequence complement
aaaatgtagggttataataatg

SEQ ID NO: 13254 - DNA, 22 bp, Artificial Sequence
  Target B2M Sequence complement
aaatgtagggttataataatgt

SEQ ID NO: 13255 - DNA, 22 bp, Artificial Sequence
  Target B2M Sequence complement
aatgtagggttataataatgtt

SEQ ID NO: 13256 - DNA, 22 bp, Artificial Sequence
  Target B2M Sequence complement
atgtagggttataataatgtta

SEQ ID NO: 13257 - DNA, 22 bp, Artificial Sequence
  Target B2M Sequence complement
tgtagggttataataatgttaa

SEQ ID NO: 13258 - DNA, 22 bp, Artificial Sequence
  Target B2M Sequence complement
tagggttataataatgttaaca

SEQ ID NO: 13259 - DNA, 22 bp, Artificial Sequence
  Target B2M Sequence complement
agggttataataatgttaacat

SEQ ID NO: 13260 - DNA, 22 bp, Artificial Sequence
  Target B2M Sequence complement
gttataataatgttaacatgga

SEQ ID NO: 13261 - DNA, 22 bp, Artificial Sequence
  Target B2M Sequence complement
ttataataatgttaacatggac

SEQ ID NO: 13262 - DNA, 22 bp, Artificial Sequence
  Target B2M Sequence complement
tataataatgttaacatggaca

SEQ ID NO: 13263 - DNA, 22 bp, Artificial Sequence
  Target B2M Sequence complement
ataataatgttaacatggacat

SEQ ID NO: 13264 - DNA, 22 bp, Artificial Sequence
  Target B2M Sequence complement
acatgatcttctttataattct

SEQ ID NO: 13265 - DNA, 22 bp, Artificial Sequence
  Target B2M Sequence complement
catgatcttctttataattcta

SEQ ID NO: 13266 - DNA, 22 bp, Artificial Sequence
  Target B2M Sequence complement
atgatcttctttataattctac

SEQ ID NO: 13267 - DNA, 22 bp, Artificial Sequence
  Target B2M Sequence complement
tgatcttctttataattctact

SEQ ID NO: 13268 - DNA, 22 bp, Artificial Sequence
  Target B2M Sequence complement
gatcttctttataattctactt

SEQ ID NO: 13269 - DNA, 22 bp, Artificial Sequence
  Target B2M Sequence complement
atcttctttataattctacttt

SEQ ID NO: 13270 - DNA, 22 bp, Artificial Sequence
  Target B2M Sequence complement
tcttctttataattctactttg

SEQ ID NO: 13271 - DNA, 22 bp, Artificial Sequence
  Target B2M Sequence complement
cttctttataattctactttga

SEQ ID NO: 13272 - DNA, 22 bp, Artificial Sequence
  Target B2M Sequence complement
ttctttataattctactttgag

SEQ ID NO: 13273 - DNA, 22 bp, Artificial Sequence
  Target B2M Sequence complement
tctttataattctactttgagt

SEQ ID NO: 13274 - DNA, 22 bp, Artificial Sequence
  Target B2M Sequence complement
ccacaggtagctctaggagggc

SEQ ID NO: 13275 - DNA, 22 bp, Artificial Sequence
  Target B2M Sequence complement
caggtagctctaggagggctgg

SEQ ID NO: 13276 - DNA, 22 bp, Artificial Sequence
  Target B2M Sequence complement
aggtagctctaggagggctggc

SEQ ID NO: 13277 - DNA, 22 bp, Artificial Sequence
  Target B2M Sequence complement
ggtagctctaggagggctggca

SEQ ID NO: 13278 - DNA, 22 bp, Artificial Sequence
  Target B2M Sequence complement
gggctggcaacttagaggtggg

SEQ ID NO: 13279 - DNA, 22 bp, Artificial Sequence
  Target B2M Sequence complement
ggctggcaacttagaggtgggg

SEQ ID NO: 13280 - DNA, 22 bp, Artificial Sequence
  Target B2M Sequence complement
ataagttaacttccaatttaca

SEQ ID NO: 13281 - DNA, 22 bp, Artificial Sequence
  Target B2M Sequence complement
taagttaacttccaatttacat

SEQ ID NO: 13282 - DNA, 22 bp, Artificial Sequence
  Target B2M Sequence complement
aagttaacttccaatttacata

SEQ ID NO: 13283 - DNA, 22 bp, Artificial Sequence
  Target B2M Sequence complement
ggggaaaatttagaaatataat

SEQ ID NO: 13284 - DNA, 22 bp, Artificial Sequence
  Target B2M Sequence complement
gggaaaatttagaaatataatt

SEQ ID NO: 13285 - DNA, 22 bp, Artificial Sequence
  Target B2M Sequence complement
ggaaaatttagaaatataattg

SEQ ID NO: 13286 - DNA, 22 bp, Artificial Sequence
  Target B2M Sequence complement
gaaaatttagaaatataattga

SEQ ID NO: 13287 - DNA, 22 bp, Artificial Sequence
  Target B2M Sequence complement
aaaatttagaaatataattgac

SEQ ID NO: 13288 - DNA, 22 bp, Artificial Sequence
  Target B2M Sequence complement
aaatttagaaatataattgaca

SEQ ID NO: 13289 - DNA, 22 bp, Artificial Sequence
  Target B2M Sequence complement
aatttagaaatataattgacag

SEQ ID NO: 13290 - DNA, 22 bp, Artificial Sequence
  Target B2M Sequence complement
atttagaaatataattgacagg

SEQ ID NO: 13291 - DNA, 22 bp, Artificial Sequence
  Target B2M Sequence complement
tttagaaatataattgacagga

SEQ ID NO: 13292 - DNA, 22 bp, Artificial Sequence
  Target B2M Sequence complement
ttagaaatataattgacaggat

SEQ ID NO: 13293 - DNA, 22 bp, Artificial Sequence
  Target B2M Sequence complement
tagaaatataattgacaggatt

SEQ ID NO: 13294 - DNA, 22 bp, Artificial Sequence
  Target B2M Sequence complement
agaaatataattgacaggatta

SEQ ID NO: 13295 - DNA, 22 bp, Artificial Sequence
  Target B2M Sequence complement
gaaatataattgacaggattat

SEQ ID NO: 13296 - DNA, 22 bp, Artificial Sequence
  Target B2M Sequence complement
aaatataattgacaggattatt

SEQ ID NO: 13297 - DNA, 22 bp, Artificial Sequence
  Target B2M Sequence complement
aatataattgacaggattattg

SEQ ID NO: 13298 - DNA, 22 bp, Artificial Sequence
  Target B2M Sequence complement
aggattattggaaatttgttat

SEQ ID NO: 13299 - DNA, 22 bp, Artificial Sequence
  Target B2M Sequence complement
ggattattggaaatttgttata

SEQ ID NO: 13300 - DNA, 22 bp, Artificial Sequence
  Target B2M Sequence complement
gattattggaaatttgttataa

SEQ ID NO: 13301 - DNA, 22 bp, Artificial Sequence
  Target B2M Sequence complement
attattggaaatttgttataat

SEQ ID NO: 13302 - DNA, 22 bp, Artificial Sequence
  Target B2M Sequence complement
ttattggaaatttgttataatg

SEQ ID NO: 13303 - DNA, 22 bp, Artificial Sequence
  Target B2M Sequence complement
tattggaaatttgttataatga

SEQ ID NO: 13304 - DNA, 22 bp, Artificial Sequence
  Target B2M Sequence complement
attggaaatttgttataatgaa

SEQ ID NO: 13305 - DNA, 22 bp, Artificial Sequence
  Target B2M Sequence complement
ttggaaatttgttataatgaat

SEQ ID NO: 13306 - DNA, 22 bp, Artificial Sequence
  Target B2M Sequence complement
tggaaatttgttataatgaatg

SEQ ID NO: 13307 - DNA, 22 bp, Artificial Sequence
  Target B2M Sequence complement
ggaaatttgttataatgaatga

SEQ ID NO: 13308 - DNA, 22 bp, Artificial Sequence
  Target B2M Sequence complement
gaaatttgttataatgaatgaa

SEQ ID NO: 13309 - DNA, 22 bp, Artificial Sequence
  Target B2M Sequence complement
aaatttgttataatgaatgaaa

SEQ ID NO: 13310 - DNA, 22 bp, Artificial Sequence
  Target B2M Sequence complement
aatttgttataatgaatgaaac

SEQ ID NO: 13311 - DNA, 22 bp, Artificial Sequence
  Target B2M Sequence complement
atttgttataatgaatgaaaca

SEQ ID NO: 13312 - DNA, 22 bp, Artificial Sequence
  Target B2M Sequence complement
tttgttataatgaatgaaacat

SEQ ID NO: 13313 - DNA, 22 bp, Artificial Sequence
  Target B2M Sequence complement
ttgttataatgaatgaaacatt

SEQ ID NO: 13314 - DNA, 22 bp, Artificial Sequence
  Target B2M Sequence complement
tgttataatgaatgaaacattt

SEQ ID NO: 13315 - DNA, 22 bp, Artificial Sequence
  Target B2M Sequence complement
gttataatgaatgaaacatttt

SEQ ID NO: 13316 - DNA, 22 bp, Artificial Sequence
  Target B2M Sequence complement
ttataatgaatgaaacattttg

SEQ ID NO: 13317 - DNA, 22 bp, Artificial Sequence
  Target B2M Sequence complement
tataatgaatgaaacattttgt

SEQ ID NO: 13318 - DNA, 22 bp, Artificial Sequence
  Target B2M Sequence complement
ataatgaatgaaacattttgtc

SEQ ID NO: 13319 - DNA, 22 bp, Artificial Sequence
  Target B2M Sequence complement
taatgaatgaaacattttgtca

SEQ ID NO: 13320 - DNA, 22 bp, Artificial Sequence
  Target B2M Sequence complement
aatgaatgaaacattttgtcat

SEQ ID NO: 13321 - DNA, 22 bp, Artificial Sequence
  Target B2M Sequence complement
atgaatgaaacattttgtcata

SEQ ID NO: 13322 - DNA, 22 bp, Artificial Sequence
  Target B2M Sequence complement
tgaatgaaacattttgtcatat

SEQ ID NO: 13323 - DNA, 22 bp, Artificial Sequence
  Target B2M Sequence complement
gaatgaaacattttgtcatata

SEQ ID NO: 13324 - DNA, 22 bp, Artificial Sequence
  Target B2M Sequence complement
aatgaaacattttgtcatataa

SEQ ID NO: 13325 - DNA, 22 bp, Artificial Sequence
  Target B2M Sequence complement
atgaaacattttgtcatataag

SEQ ID NO: 13326 - DNA, 22 bp, Artificial Sequence
  Target B2M Sequence complement
tgaaacattttgtcatataaga

SEQ ID NO: 13327 - DNA, 22 bp, Artificial Sequence
  Target B2M Sequence complement
gaaacattttgtcatataagat

SEQ ID NO: 13328 - DNA, 22 bp, Artificial Sequence
  Target B2M Sequence complement
aaacattttgtcatataagatt

SEQ ID NO: 13329 - DNA, 22 bp, Artificial Sequence
  Target B2M Sequence complement
aacattttgtcatataagattc

SEQ ID NO: 13330 - DNA, 22 bp, Artificial Sequence
  Target B2M Sequence complement
acattttgtcatataagattca

SEQ ID NO: 13331 - DNA, 22 bp, Artificial Sequence
  Target B2M Sequence complement
cattttgtcatataagattcat

SEQ ID NO: 13332 - DNA, 22 bp, Artificial Sequence
  Target B2M Sequence complement
attttgtcatataagattcata

SEQ ID NO: 13333 - DNA, 22 bp, Artificial Sequence
  Target B2M Sequence complement
ttttgtcatataagattcatat

SEQ ID NO: 13334 - DNA, 22 bp, Artificial Sequence
  Target B2M Sequence complement
tttgtcatataagattcatatt

SEQ ID NO: 13335 - DNA, 22 bp, Artificial Sequence
  Target B2M Sequence complement
ttgtcatataagattcatattt

SEQ ID NO: 13336 - DNA, 22 bp, Artificial Sequence
  Target B2M Sequence complement
tgtcatataagattcatattta

SEQ ID NO: 13337 - DNA, 22 bp, Artificial Sequence
  Target B2M Sequence complement
gtcatataagattcatatttac

SEQ ID NO: 13338 - DNA, 22 bp, Artificial Sequence
  Target B2M Sequence complement
tcatataagattcatatttact

SEQ ID NO: 13339 - DNA, 22 bp, Artificial Sequence
  Target B2M Sequence complement
catataagattcatatttactt

SEQ ID NO: 13340 - DNA, 22 bp, Artificial Sequence
  Target B2M Sequence complement
atataagattcatatttacttc

SEQ ID NO: 13341 - DNA, 22 bp, Artificial Sequence
  Target B2M Sequence complement
tataagattcatatttacttct

SEQ ID NO: 13342 - DNA, 22 bp, Artificial Sequence
  Target B2M Sequence complement
ataagattcatatttacttctt

SEQ ID NO: 13343 - DNA, 22 bp, Artificial Sequence
  Target B2M Sequence complement
taagattcatatttacttctta

SEQ ID NO: 13344 - DNA, 22 bp, Artificial Sequence
  Target B2M Sequence complement
aagattcatatttacttcttat

SEQ ID NO: 13345 - DNA, 22 bp, Artificial Sequence
  Target B2M Sequence complement
agattcatatttacttcttata

SEQ ID NO: 13346 - DNA, 22 bp, Artificial Sequence
  Target B2M Sequence complement
gattcatatttacttcttatac

SEQ ID NO: 13347 - DNA, 22 bp, Artificial Sequence
  Target B2M Sequence complement
attcatatttacttcttataca

SEQ ID NO: 13348 - DNA, 22 bp, Artificial Sequence
  Target B2M Sequence complement
ttcatatttacttcttatacat

SEQ ID NO: 13349 - DNA, 22 bp, Artificial Sequence
  Target B2M Sequence complement
tcatatttacttcttatacatt

SEQ ID NO: 13350 - DNA, 22 bp, Artificial Sequence
  Target B2M Sequence complement
catatttacttcttatacattt

SEQ ID NO: 13351 - DNA, 22 bp, Artificial Sequence
  Target B2M Sequence complement
atatttacttcttatacatttg

SEQ ID NO: 13352 - DNA, 22 bp, Artificial Sequence
  Target B2M Sequence complement
tatttacttcttatacatttga

SEQ ID NO: 13353 - DNA, 22 bp, Artificial Sequence
  Target B2M Sequence complement
atttacttcttatacatttgat

SEQ ID NO: 13354 - DNA, 22 bp, Artificial Sequence
  Target B2M Sequence complement
tttacttcttatacatttgata

SEQ ID NO: 13355 - DNA, 22 bp, Artificial Sequence
  Target B2M Sequence complement
ttacttcttatacatttgataa

SEQ ID NO: 13356 - DNA, 22 bp, Artificial Sequence
  Target B2M Sequence complement
tacttcttatacatttgataaa

SEQ ID NO: 13357 - DNA, 22 bp, Artificial Sequence
  Target B2M Sequence complement
acttcttatacatttgataaag

SEQ ID NO: 13358 - DNA, 22 bp, Artificial Sequence
  Target B2M Sequence complement
cttcttatacatttgataaagt

SEQ ID NO: 13359 - DNA, 22 bp, Artificial Sequence
  Target B2M Sequence complement
ttcttatacatttgataaagta

SEQ ID NO: 13360 - DNA, 22 bp, Artificial Sequence
  Target B2M Sequence complement
tcttatacatttgataaagtaa

SEQ ID NO: 13361 - DNA, 22 bp, Artificial Sequence
  Target B2M Sequence complement
cttatacatttgataaagtaag

SEQ ID NO: 13362 - DNA, 22 bp, Artificial Sequence
  Target B2M Sequence complement
ttatacatttgataaagtaagg

SEQ ID NO: 13363 - DNA, 22 bp, Artificial Sequence
  Target B2M Sequence complement
gttaatctggtttatttttgtt

SEQ ID NO: 13364 - DNA, 22 bp, Artificial Sequence
  Target B2M Sequence complement
ttaatctggtttatttttgttc

SEQ ID NO: 13365 - DNA, 22 bp, Artificial Sequence
  Target B2M Sequence complement
tttatttttgttccacaagtta

SEQ ID NO: 13366 - DNA, 22 bp, Artificial Sequence
  Target B2M Sequence complement
ttatttttgttccacaagttaa

SEQ ID NO: 13367 - DNA, 22 bp, Artificial Sequence
  Target B2M Sequence complement
tatttttgttccacaagttaaa

SEQ ID NO: 13368 - DNA, 22 bp, Artificial Sequence
  Target B2M Sequence complement
atttttgttccacaagttaaat

SEQ ID NO: 13369 - DNA, 22 bp, Artificial Sequence
  Target B2M Sequence complement
tttttgttccacaagttaaata

SEQ ID NO: 13370 - DNA, 22 bp, Artificial Sequence
  Target B2M Sequence complement
ttttgttccacaagttaaataa

SEQ ID NO: 13371 - DNA, 22 bp, Artificial Sequence
  Target B2M Sequence complement
tttgttccacaagttaaataaa

SEQ ID NO: 13372 - DNA, 22 bp, Artificial Sequence
  Target B2M Sequence complement
ttgttccacaagttaaataaat

SEQ ID NO: 13373 - DNA, 22 bp, Artificial Sequence
  Target B2M Sequence complement
ttccacaagttaaataaatcat

SEQ ID NO: 13374 - DNA, 22 bp, Artificial Sequence
  Target B2M Sequence complement
tccacaagttaaataaatcata

SEQ ID NO: 13375 - DNA, 22 bp, Artificial Sequence
  Target B2M Sequence complement
ccacaagttaaataaatcataa

SEQ ID NO: 13376 - DNA, 22 bp, Artificial Sequence
  Target B2M Sequence complement
cacaagttaaataaatcataaa

SEQ ID NO: 13377 - DNA, 22 bp, Artificial Sequence
  Target B2M Sequence complement
acaagttaaataaatcataaaa

SEQ ID NO: 13378 - DNA, 22 bp, Artificial Sequence
  Target B2M Sequence complement
caagttaaataaatcataaaac

SEQ ID NO: 13379 - DNA, 22 bp, Artificial Sequence
  Target B2M Sequence complement
aagttaaataaatcataaaact

SEQ ID NO: 13380 - DNA, 22 bp, Artificial Sequence
  Target B2M Sequence complement
agttaaataaatcataaaactt

SEQ ID NO: 13381 - DNA, 22 bp, Artificial Sequence
  Target B2M Sequence complement
gttaaataaatcataaaacttg

SEQ ID NO: 13382 - DNA, 22 bp, Artificial Sequence
  Target B2M Sequence complement
ttaaataaatcataaaacttga

SEQ ID NO: 13383 - DNA, 46 bp, Artificial Sequence
  B2M targeting shRNA
gcactcaaagcttgttaagatcgaaatcttaacaagctttgagtgc

SEQ ID NO: 13384 - DNA, 46 bp, Artificial Sequence
  B2M targeting shRNA
gttaacttccaatttacataccgaagtatgtaaattggaagttaac

SEQ ID NO: 13385 - DNA, 21 bp, Artificial Sequence
  Target HLA Sequence complement
cttcttccttccctattaaaa

SEQ ID NO: 13386 - DNA, 21 bp, Artificial Sequence
  Target HLA Sequence complement
tctcactccatgaggtatttc

SEQ ID NO: 13387 - DNA, 21 bp, Artificial Sequence
  Target HLA Sequence complement
ctctcactccatgaggtattt

SEQ ID NO: 13388 - DNA, 21 bp, Artificial Sequence
  Target HLA Sequence complement
gaggaggaagagctcagatag

SEQ ID NO: 13389 - DNA, 21 bp, Artificial Sequence
  Target HLA Sequence complement
gctctcactccatgaggtatt

SEQ ID NO: 13390 - DNA, 21 bp, Artificial Sequence
  Target HLA Sequence complement
aggattacatcgccctgaaag

SEQ ID NO: 13391 - DNA, 21 bp, Artificial Sequence
  Target HLA Sequence complement
acaccgtccagaggatgtatg

SEQ ID NO: 13392 - DNA, 21 bp, Artificial Sequence
  Target HLA Sequence complement
agggtccttcttcctggatac

SEQ ID NO: 13393 - DNA, 21 bp, Artificial Sequence
  Target HLA Sequence complement
cctacgacggcaaggattaca

SEQ ID NO: 13394 - DNA, 21 bp, Artificial Sequence
  Target HLA Sequence complement
tcactccatgaggtatttctt

SEQ ID NO: 13395 - DNA, 21 bp, Artificial Sequence
  Target HLA Sequence complement
ctacgacggcaaggattacat

SEQ ID NO: 13396 - DNA, 21 bp, Artificial Sequence
  Target HLA Sequence complement
ctcactccatgaggtatttct

SEQ ID NO: 13397 - DNA, 21 bp, Artificial Sequence
  Target HLA Sequence complement
ggaggaagagctcagatagaa

SEQ ID NO: 13398 - DNA, 21 bp, Artificial Sequence
  Target HLA Sequence complement
cacaccgtccagaggatgtat

SEQ ID NO: 13399 - DNA, 21 bp, Artificial Sequence
  Target HLA Sequence complement
cacgctgtctctgaccatgaa

SEQ ID NO: 13400 - DNA, 21 bp, Artificial Sequence
  Target HLA Sequence complement
ctggacaggagcagagataca

SEQ ID NO: 13401 - DNA, 21 bp, Artificial Sequence
  Target HLA Sequence complement
tggaggaggaagagctcagat

SEQ ID NO: 13402 - DNA, 21 bp, Artificial Sequence
  Target HLA Sequence complement
ggctctcactccatgaggtat

SEQ ID NO: 13403 - DNA, 21 bp, Artificial Sequence
  Target HLA Sequence complement
catctctgtctcaacttcatg

SEQ ID NO: 13404 - DNA, 21 bp, Artificial Sequence
  Target HLA Sequence complement
tacgacggcaaggattacatc

SEQ ID NO: 13405 - DNA, 21 bp, Artificial Sequence
  Target HLA Sequence complement
ggattacatcgccctgaaaga

SEQ ID NO: 13406 - DNA, 21 bp, Artificial Sequence
  Target HLA Sequence complement
gattacatcgccctgaaagag

SEQ ID NO: 13407 - DNA, 21 bp, Artificial Sequence
  Target HLA Sequence complement
ctcagaccaccaagcacaagt

SEQ ID NO: 13408 - DNA, 21 bp, Artificial Sequence
  Target HLA Sequence complement
tcacaccgtccagaggatgta

SEQ ID NO: 13409 - DNA, 21 bp, Artificial Sequence
  Target HLA Sequence complement
actccatgaggtatttcttca

SEQ ID NO: 13410 - DNA, 21 bp, Artificial Sequence
  Target HLA Sequence complement
cactccatgaggtatttcttc

SEQ ID NO: 13411 - DNA, 21 bp, Artificial Sequence
  Target HLA Sequence complement
ccatgaggtatttcttcacat

SEQ ID NO: 13412 - DNA, 21 bp, Artificial Sequence
  Target HLA Sequence complement
acttcttccttccctattaaa

SEQ ID NO: 13413 - DNA, 21 bp, Artificial Sequence
  Target HLA Sequence complement
gtgtctctcacagcttgtaaa

SEQ ID NO: 13414 - DNA, 21 bp, Artificial Sequence
  Target HLA Sequence complement
ctgtgttcgtgtaggcataat

SEQ ID NO: 13415 - DNA, 21 bp, Artificial Sequence
  Target HLA Sequence complement
tgtgttcgtgtaggcataatg

SEQ ID NO: 13416 - DNA, 21 bp, Artificial Sequence
  Target HLA Sequence complement
taacttcttccttccctatta

SEQ ID NO: 13417 - DNA, 21 bp, Artificial Sequence
  Target HLA Sequence complement
tctggacaggagcagagatac

SEQ ID NO: 13418 - DNA, 21 bp, Artificial Sequence
  Target HLA Sequence complement
ttgctggcctggttctctttg

SEQ ID NO: 13419 - DNA, 21 bp, Artificial Sequence
  Target HLA Sequence complement
tgtctctcacagcttgtaaag

SEQ ID NO: 13420 - DNA, 21 bp, Artificial Sequence
  Target HLA Sequence complement
acttgaagaaccctgactttg

SEQ ID NO: 13421 - DNA, 21 bp, Artificial Sequence
  Target HLA Sequence complement
gaagaaccctgactttgtttc

SEQ ID NO: 13422 - DNA, 21 bp, Artificial Sequence
  Target HLA Sequence complement
tctgtgttcgtgtaggcataa

SEQ ID NO: 13423 - DNA, 21 bp, Artificial Sequence
  Target HLA Sequence complement
catggtgcactgagctgtaac

SEQ ID NO: 13424 - DNA, 21 bp, Artificial Sequence
  Target HLA Sequence complement
gtaacttcttccttccctatt

SEQ ID NO: 13425 - DNA, 21 bp, Artificial Sequence
  Target HLA Sequence complement
catgtgcagcatgagggtttg

SEQ ID NO: 13426 - DNA, 21 bp, Artificial Sequence
  Target HLA Sequence complement
ttgttcctgcccttccctttg

SEQ ID NO: 13427 - DNA, 21 bp, Artificial Sequence
  Target HLA Sequence complement
acccagttctcactcccattg

SEQ ID NO: 13428 - DNA, 21 bp, Artificial Sequence
  Target HLA Sequence complement
gggtttccagagaagccaatc

SEQ ID NO: 13429 - DNA, 21 bp, Artificial Sequence
  Target HLA Sequence complement
ttctccctctcccaacctatg

SEQ ID NO: 13430 - DNA, 21 bp, Artificial Sequence
  Target HLA Sequence complement
gtctctcacagcttgtaaagt

SEQ ID NO: 13431 - DNA, 21 bp, Artificial Sequence
  Target HLA Sequence complement
tgtgtctctcacagcttgtaa

SEQ ID NO: 13432 - DNA, 21 bp, Artificial Sequence
  Target HLA Sequence complement
gaggaagagctcagatagaaa

SEQ ID NO: 13433 - DNA, 21 bp, Artificial Sequence
  Target HLA Sequence complement
tgaagaaccctgactttgttt

SEQ ID NO: 13434 - DNA, 21 bp, Artificial Sequence
  Target HLA Sequence complement
ttgaagaaccctgactttgtt

SEQ ID NO: 13435 - DNA, 21 bp, Artificial Sequence
  Target HLA Sequence complement
gtgttcgtgtaggcataatgt

SEQ ID NO: 13436 - DNA, 21 bp, Artificial Sequence
  Target HLA Sequence complement
tggtgcactgagctgtaactt

SEQ ID NO: 13437 - DNA, 21 bp, Artificial Sequence
  Target HLA Sequence complement
ctccctctcccaacctatgta

SEQ ID NO: 13438 - DNA, 21 bp, Artificial Sequence
  Target HLA Sequence complement
aggaggaagagctcagataga

SEQ ID NO: 13439 - DNA, 21 bp, Artificial Sequence
  Target HLA Sequence complement
acctatgtagggtccttcttc

SEQ ID NO: 13440 - DNA, 21 bp, Artificial Sequence
  Target HLA Sequence complement
gggtccttcttcctggatact

SEQ ID NO: 13441 - DNA, 21 bp, Artificial Sequence
  Target HLA Sequence complement
ggtccttcttcctggatactc

SEQ ID NO: 13442 - DNA, 21 bp, Artificial Sequence
  Target HLA Sequence complement
gtccttcttcctggatactca

SEQ ID NO: 13443 - DNA, 21 bp, Artificial Sequence
  Target HLA Sequence complement
aagccaatcagtgtcgtcgcg

SEQ ID NO: 13444 - DNA, 21 bp, Artificial Sequence
  Target HLA Sequence complement
aagaggacctgcgctcttgga

SEQ ID NO: 13445 - DNA, 21 bp, Artificial Sequence
  Target HLA Sequence complement
aagtgtgagacagctgccttg

SEQ ID NO: 13446 - DNA, 21 bp, Artificial Sequence
  Target HLA Sequence complement
aaggcacctgcatgtgtctgt

SEQ ID NO: 13447 - DNA, 21 bp, Artificial Sequence
  Target HLA Sequence complement
aatcatctttcctgttccaga

SEQ ID NO: 13448 - DNA, 21 bp, Artificial Sequence
  Target HLA Sequence complement
aaaggcacctgcatgtgtctg

SEQ ID NO: 13449 - DNA, 21 bp, Artificial Sequence
  Target HLA Sequence complement
aaagaggacctgcgctcttgg

SEQ ID NO: 13450 - DNA, 21 bp, Artificial Sequence
  Target HLA Sequence complement
aaacgcatatgactcaccacg

SEQ ID NO: 13451 - DNA, 19 bp, Artificial Sequence
  Target HLA Sequence complement
ggaagagctcagatagaaa

SEQ ID NO: 13452 - DNA, 19 bp, Artificial Sequence
  Target HLA Sequence complement
gggagacacggaaagtgaa

SEQ ID NO: 13453 - DNA, 21 bp, Artificial Sequence
  Target HLA Sequence complement
cacctgccatgtgcagcatga

SEQ ID NO: 13454 - DNA, 21 bp, Artificial Sequence
  Target HLA Sequence complement
ggagatcacactgacctggca

SEQ ID NO: 13455 - DNA, 20 bp, Artificial Sequence
  Target HLA Sequence complement
ggattacatcgccctgaaag

SEQ ID NO: 13456 - DNA, 20 bp, Artificial Sequence
  Target HLA Sequence complement
gcaggagggtccggagtatt

SEQ ID NO: 13457 - DNA, 20 bp, Artificial Sequence
  Target HLA Sequence complement
ggacggggagacacggaaag

SEQ ID NO: 13458 - DNA, 19 bp, Artificial Sequence
  Target HLA Sequence complement
gaaagtgaaggcccactca

SEQ ID NO: 13459 - DNA, 20 bp, Artificial Sequence
  Target HLA Sequence complement
gatacctggagaacgggaag

SEQ ID NO: 13460 - DNA, 20 bp, Artificial Sequence
  Target HLA Sequence complement
gctgtggtggtgccttctgg

SEQ ID NO: 13461 - DNA, 20 bp, Artificial Sequence
  Target HLA Sequence complement
gctactacaaccagagcgag

SEQ ID NO: 13462 - DNA, 19 bp, Artificial Sequence
  Target HLA Sequence complement
gtggctccgcagatacctg

SEQ ID NO: 13463 - DNA, 19 bp, Artificial Sequence
  Target HLA Sequence complement
gccaatcagtgtcgtcgcg

SEQ ID NO: 13464 - DNA, 19 bp, Artificial Sequence
  Target HLA Sequence complement
gaggacctgcgctcttgga

SEQ ID NO: 13465 - DNA, 19 bp, Artificial Sequence
  Target HLA Sequence complement
gtgtgagacagctgccttg

SEQ ID NO: 13466 - DNA, 19 bp, Artificial Sequence
  Target HLA Sequence complement
ggcacctgcatgtgtctgt

SEQ ID NO: 13467 - DNA, 19 bp, Artificial Sequence
  Target HLA Sequence complement
tcatctttcctgttccaga

SEQ ID NO: 13468 - DNA, 19 bp, Artificial Sequence
  Target HLA Sequence complement
aggcacctgcatgtgtctg

SEQ ID NO: 13469 - DNA, 19 bp, Artificial Sequence
  Target HLA Sequence complement
agaggacctgcgctcttgg

SEQ ID NO: 13470 - DNA, 19 bp, Artificial Sequence
  Target HLA Sequence complement
acgcatatgactcaccacg

SEQ ID NO: 13471 - DNA, 21 bp, Artificial Sequence
  Artificial sequence related to HLA knockouts in cell therapy
cttctggacaggagcagagat

SEQ ID NO: 13472 - DNA, 21 bp, Artificial Sequence
  Artificial sequence related to HLA knockouts in cell therapy
gggatggaaccttccagaagt

SEQ ID NO: 13473 - DNA, 21 bp, Artificial Sequence
  Artificial sequence related to HLA knockouts in cell therapy
tggacaggagcagagatacac

SEQ ID NO: 13474 - DNA, 21 bp, Artificial Sequence
  Artificial sequence related to HLA knockouts in cell therapy
acgctgtctctgaccatgaag

SEQ ID NO: 13475 - DNA, 21 bp, Artificial Sequence
  Artificial sequence related to HLA knockouts in cell therapy
ttctggacaggagcagagata

SEQ ID NO: 13476 - DNA, 21 bp, Artificial Sequence
  Artificial sequence related to HLA knockouts in cell therapy
ggttctctttggagctgtgat

SEQ ID NO: 13477 - DNA, 21 bp, Artificial Sequence
  Artificial sequence related to HLA knockouts in cell therapy
cattgctggcctggttctctt

SEQ ID NO: 13478 - DNA, 21 bp, Artificial Sequence
  Artificial sequence related to HLA knockouts in cell therapy
ttctctttggagctgtgatca

SEQ ID NO: 13479 - DNA, 21 bp, Artificial Sequence
  Artificial sequence related to HLA knockouts in cell therapy
attgctggcctggttctcttt

SEQ ID NO: 13480 - DNA, 21 bp, Artificial Sequence
  Artificial sequence related to HLA knockouts in cell therapy
atgtgtctctcacagcttgta

SEQ ID NO: 13481 - DNA, 21 bp, Artificial Sequence
  Artificial sequence related to HLA knockouts in cell therapy
ccctgactttgtttctgcaaa

SEQ ID NO: 13482 - DNA, 21 bp, Artificial Sequence
  Artificial sequence related to HLA knockouts in cell therapy
gcacctgcatgtgtctgtgtt

SEQ ID NO: 13483 - DNA, 21 bp, Artificial Sequence
  Artificial sequence related to HLA knockouts in cell therapy
gcccttccctttgtgacttga

SEQ ID NO: 13484 - DNA, 21 bp, Artificial Sequence
  Artificial sequence related to HLA knockouts in cell therapy
agaaccctgactttgtttctg

SEQ ID NO: 13485 - DNA, 21 bp, Artificial Sequence
  Artificial sequence related to HLA knockouts in cell therapy
tccatctctgtctcaacttca

SEQ ID NO: 13486 - DNA, 21 bp, Artificial Sequence
  Artificial sequence related to HLA knockouts in cell therapy
gtgcactgagctgtaacttct

SEQ ID NO: 13487 - DNA, 21 bp, Artificial Sequence
  Artificial sequence related to HLA knockouts in cell therapy
ctgcccttccctttgtgactt

SEQ ID NO: 13488 - DNA, 21 bp, Artificial Sequence
  Artificial sequence related to HLA knockouts in cell therapy
tgacttgaagaaccctgactt

SEQ ID NO: 13489 - DNA, 21 bp, Artificial Sequence
  Artificial sequence related to HLA knockouts in cell therapy
gtgtctccatctctgtctcaa

SEQ ID NO: 13490 - DNA, 21 bp, Artificial Sequence
  Artificial sequence related to HLA knockouts in cell therapy
tgcactgagctgtaacttctt

SEQ ID NO: 13491 - DNA, 21 bp, Artificial Sequence
  Artificial sequence related to HLA knockouts in cell therapy
tgttcctgcccttccctttgt

SEQ ID NO: 13492 - DNA, 21 bp, Artificial Sequence
  Artificial sequence related to HLA knockouts in cell therapy
gacttgaagaaccctgacttt

SEQ ID NO: 13493 - DNA, 21 bp, Artificial Sequence
  Artificial sequence related to HLA knockouts in cell therapy
tctctcacagcttgtaaagtg

SEQ ID NO: 13494 - DNA, 21 bp, Artificial Sequence
  Artificial sequence related to HLA knockouts in cell therapy
ggaggaggaagagctcagata

SEQ ID NO: 13495 - DNA, 21 bp, Artificial Sequence
  Artificial sequence related to HLA knockouts in cell therapy
ggactgagaggcaagagttgt

SEQ ID NO: 13496 - DNA, 21 bp, Artificial Sequence
  Artificial sequence related to HLA knockouts in cell therapy
actgagaggcaagagttgttc

SEQ ID NO: 13497 - DNA, 21 bp, Artificial Sequence
  Artificial sequence related to HLA knockouts in cell therapy
tgggactgagaggcaagagtt

SEQ ID NO: 13498 - DNA, 21 bp, Artificial Sequence
  Artificial sequence related to HLA knockouts in cell therapy
gactgagaggcaagagttgtt

SEQ ID NO: 13499 - DNA, 21 bp, Artificial Sequence
  Artificial sequence related to HLA knockouts in cell therapy
cccttccctttgtgacttgaa

SEQ ID NO: 13500 - DNA, 21 bp, Artificial Sequence
  Artificial sequence related to HLA knockouts in cell therapy
gtttccagagaagccaatcag

SEQ ID NO: 13501 - DNA, 21 bp, Artificial Sequence
  Artificial sequence related to HLA knockouts in cell therapy
ggtttccagagaagccaatca

SEQ ID NO: 13502 - DNA, 21 bp, Artificial Sequence
  Artificial sequence related to HLA knockouts in cell therapy
ccttccctttgtgacttgaag

SEQ ID NO: 13503 - DNA, 21 bp, Artificial Sequence
  Artificial sequence related to HLA knockouts in cell therapy
tccctttgtgacttgaagaac

SEQ ID NO: 13504 - DNA, 21 bp, Artificial Sequence
  Artificial sequence related to HLA knockouts in cell therapy
ttccctttgtgacttgaagaa

SEQ ID NO: 13505 - DNA, 21 bp, Artificial Sequence
  Artificial sequence related to HLA knockouts in cell therapy
cttccctttgtgacttgaaga

SEQ ID NO: 13506 - DNA, 21 bp, Artificial Sequence
  Artificial sequence related to HLA knockouts in cell therapy
cttgaagaaccctgactttgt

SEQ ID NO: 13507 - DNA, 21 bp, Artificial Sequence
  Artificial sequence related to HLA knockouts in cell therapy
gcactgagctgtaacttcttc

SEQ ID NO: 13508 - DNA, 21 bp, Artificial Sequence
  Artificial sequence related to HLA knockouts in cell therapy
tgttcgtgtaggcataatgtg

SEQ ID NO: 13509 - DNA, 21 bp, Artificial Sequence
  Artificial sequence related to HLA knockouts in cell therapy
ccatctctgtctcaacttcat

SEQ ID NO: 13510 - DNA, 21 bp, Artificial Sequence
  Artificial sequence related to HLA knockouts in cell therapy
tcatggtgcactgagctgtaa

SEQ ID NO: 13511 - DNA, 21 bp, Artificial Sequence
  Artificial sequence related to HLA knockouts in cell therapy
gtctccatctctgtctcaact

SEQ ID NO: 13512 - DNA, 21 bp, Artificial Sequence
  Artificial sequence related to HLA knockouts in cell therapy
tctccatctctgtctcaactt

SEQ ID NO: 13513 - DNA, 21 bp, Artificial Sequence
  Artificial sequence related to HLA knockouts in cell therapy
ctccatctctgtctcaacttc

SEQ ID NO: 13514 - DNA, 21 bp, Artificial Sequence
  Artificial sequence related to HLA knockouts in cell therapy
atggtgcactgagctgtaact

SEQ ID NO: 13515 - DNA, 21 bp, Artificial Sequence
  Artificial sequence related to HLA knockouts in cell therapy
ggtgcactgagctgtaacttc

SEQ ID NO: 13516 - DNA, 21 bp, Artificial Sequence
  Artificial sequence related to HLA knockouts in cell therapy
tagggtccttcttcctggata

SEQ ID NO: 13517 - DNA, 21 bp, Artificial Sequence
  Artificial sequence related to HLA knockouts in cell therapy
tctccctctcccaacctatgt

SEQ ID NO: 13518 - DNA, 21 bp, Artificial Sequence
  Artificial sequence related to HLA knockouts in cell therapy
tccctctcccaacctatgtag

SEQ ID NO: 13519 - DNA, 21 bp, Artificial Sequence
  Artificial sequence related to HLA knockouts in cell therapy
tttctccctctcccaacctat

SEQ ID NO: 13520 - DNA, 21 bp, Artificial Sequence
  Artificial sequence related to HLA knockouts in cell therapy
agcaggagggtccggagtatt

SEQ ID NO: 13521 - DNA, 21 bp, Artificial Sequence
  Artificial sequence related to HLA knockouts in cell therapy
gctctgatgtgtctctcacag

SEQ ID NO: 13522 - DNA, 21 bp, Artificial Sequence
  Artificial sequence related to HLA knockouts in cell therapy
caaggattacatcgccctgaa

SEQ ID NO: 13523 - DNA, 21 bp, Artificial Sequence
  Artificial sequence related to HLA knockouts in cell therapy
agcttgtaaagtgtgagacag

SEQ ID NO: 13524 - DNA, 21 bp, Artificial Sequence
  Artificial sequence related to HLA knockouts in cell therapy
acgacggcaaggattacatcg

SEQ ID NO: 13525 - DNA, 21 bp, Artificial Sequence
  Artificial sequence related to HLA knockouts in cell therapy
tcagaccaccaagcacaagtg

SEQ ID NO: 13526 - DNA, 21 bp, Artificial Sequence
  Artificial sequence related to HLA knockouts in cell therapy
agctcagaccaccaagcacaa

SEQ ID NO: 13527 - DNA, 21 bp, Artificial Sequence
  Artificial sequence related to HLA knockouts in cell therapy
cagagatacacctgccatgtg

SEQ ID NO: 13528 - DNA, 21 bp, Artificial Sequence
  Artificial sequence related to HLA knockouts in cell therapy
atgaggtatttcttcacatcc

SEQ ID NO: 13529 - DNA, 21 bp, Artificial Sequence
  Artificial sequence related to HLA knockouts in cell therapy
ctccatgaggtatttcttcac

SEQ ID NO: 13530 - DNA, 21 bp, Artificial Sequence
  Artificial sequence related to HLA knockouts in cell therapy
cactgagctgtaacttcttcc

SEQ ID NO: 13531 - DNA, 21 bp, Artificial Sequence
  Artificial sequence related to HLA knockouts in cell therapy
cctatgtagggtccttcttcc

SEQ ID NO: 13532 - DNA, 21 bp, Artificial Sequence
  Artificial sequence related to HLA knockouts in cell therapy
catgaggtatttcttcacatc

SEQ ID NO: 13533 - DNA, 21 bp, Artificial Sequence
  Artificial sequence related to HLA knockouts in cell therapy
catctttcctgttccagagag

SEQ ID NO: 13534 - DNA, 21 bp, Artificial Sequence
  Artificial sequence related to HLA knockouts in cell therapy
tcaacttcatggtgcactgag

SEQ ID NO: 13535 - DNA, 21 bp, Artificial Sequence
  Artificial sequence related to HLA knockouts in cell therapy
ggatggaaccttccagaagtg

SEQ ID NO: 13536 - DNA, 21 bp, Artificial Sequence
  Artificial sequence related to HLA knockouts in cell therapy
gcagagatacacctgccatgt

SEQ ID NO: 13537 - DNA, 21 bp, Artificial Sequence
  Artificial sequence related to HLA knockouts in cell therapy
ccatgtgcagcatgagggttt

SEQ ID NO: 13538 - DNA, 21 bp, Artificial Sequence
  Artificial sequence related to HLA knockouts in cell therapy
tatgactcaccacgctgtctc

SEQ ID NO: 13539 - DNA, 21 bp, Artificial Sequence
  Artificial sequence related to HLA knockouts in cell therapy
aggtgtctccatctctgtctc

SEQ ID NO: 13540 - DNA, 21 bp, Artificial Sequence
  Artificial sequence related to HLA knockouts in cell therapy
atgtgcagcatgagggtttgc

SEQ ID NO: 13541 - DNA, 21 bp, Artificial Sequence
  Artificial sequence related to HLA knockouts in cell therapy
tgtgatgtggaggaggaagag

SEQ ID NO: 13542 - DNA, 21 bp, Artificial Sequence
  Artificial sequence related to HLA knockouts in cell therapy
catcattgctggcctggttct

SEQ ID NO: 13543 - DNA, 21 bp, Artificial Sequence
  Artificial sequence related to HLA knockouts in cell therapy
atcattgctggcctggttctc

SEQ ID NO: 13544 - DNA, 21 bp, Artificial Sequence
  Artificial sequence related to HLA knockouts in cell therapy
ttcatggtgcactgagctgta

SEQ ID NO: 13545 - DNA, 21 bp, Artificial Sequence
  Artificial sequence related to HLA knockouts in cell therapy
ctgtgatgtggaggaggaaga

SEQ ID NO: 13546 - DNA, 21 bp, Artificial Sequence
  Artificial sequence related to HLA knockouts in cell therapy
tctctttggagctgtgatcac

SEQ ID NO: 13547 - DNA, 21 bp, Artificial Sequence
  Artificial sequence related to HLA knockouts in cell therapy
gttctctttggagctgtgatc

SEQ ID NO: 13548 - DNA, 21 bp, Artificial Sequence
  Artificial sequence related to HLA knockouts in cell therapy
tctttggagctgtgatcactg

SEQ ID NO: 13549 - DNA, 21 bp, Artificial Sequence
  Artificial sequence related to HLA knockouts in cell therapy
tgatgtgtctctcacagcttg

SEQ ID NO: 13550 - DNA, 21 bp, Artificial Sequence
  Artificial sequence related to HLA knockouts in cell therapy
gatgtgtctctcacagcttgt

SEQ ID NO: 13551 - DNA, 21 bp, Artificial Sequence
  Artificial sequence related to HLA knockouts in cell therapy
acagcttgtaaagtgtgagac

SEQ ID NO: 13552 - DNA, 21 bp, Artificial Sequence
  Artificial sequence related to HLA knockouts in cell therapy
agtgtgagacagctgccttgt

SEQ ID NO: 13553 - DNA, 21 bp, Artificial Sequence
  Artificial sequence related to HLA knockouts in cell therapy
atctctgtctcaacttcatgg

SEQ ID NO: 13554 - DNA, 21 bp, Artificial Sequence
  Artificial sequence related to HLA knockouts in cell therapy
catgtccaccatgaccctctt

SEQ ID NO: 13555 - DNA, 21 bp, Artificial Sequence
  Artificial sequence related to HLA knockouts in cell therapy
cccaatcatctttcctgttcc

SEQ ID NO: 13556 - DNA, 21 bp, Artificial Sequence
  Artificial sequence related to HLA knockouts in cell therapy
gttgttcctgcccttcccttt

SEQ ID NO: 13557 - DNA, 21 bp, Artificial Sequence
  Artificial sequence related to HLA knockouts in cell therapy
atgtccaccatgaccctcttc

SEQ ID NO: 13558 - DNA, 21 bp, Artificial Sequence
  Artificial sequence related to HLA knockouts in cell therapy
tctcacagcttgtaaagtgtg

SEQ ID NO: 13559 - DNA, 21 bp, Artificial Sequence
  Artificial sequence related to HLA knockouts in cell therapy
ctgagaggcaagagttgttcc

SEQ ID NO: 13560 - DNA, 21 bp, Artificial Sequence
  Artificial sequence related to HLA knockouts in cell therapy
tgcccttccctttgtgacttg

SEQ ID NO: 13561 - DNA, 21 bp, Artificial Sequence
  Artificial sequence related to HLA knockouts in cell therapy
gacccagttctcactcccatt

SEQ ID NO: 13562 - DNA, 21 bp, Artificial Sequence
  Artificial sequence related to HLA knockouts in cell therapy
cacctgcatgtgtctgtgttc

SEQ ID NO: 13563 - DNA, 21 bp, Artificial Sequence
  Artificial sequence related to HLA knockouts in cell therapy
tgaggtgtctccatctctgtc

SEQ ID NO: 13564 - DNA, 21 bp, Artificial Sequence
  Artificial sequence related to HLA knockouts in cell therapy
tgtctccatctctgtctcaac

SEQ ID NO: 13565 - DNA, 21 bp, Artificial Sequence
  Artificial sequence related to HLA knockouts in cell therapy
ccaacctatgtagggtccttc

SEQ ID NO: 13566 - DNA, 21 bp, Artificial Sequence
  Artificial sequence related to HLA knockouts in cell therapy
caacctatgtagggtccttct

SEQ ID NO: 13567 - DNA, 21 bp, Artificial Sequence
  Artificial sequence related to HLA knockouts in cell therapy
ttccagagaagccaatcagtg

SEQ ID NO: 13568 - DNA, 21 bp, Artificial Sequence
  Artificial sequence related to HLA knockouts in cell therapy
ccagagaagccaatcagtgtc

SEQ ID NO: 13569 - DNA, 21 bp, Artificial Sequence
  Artificial sequence related to HLA knockouts in cell therapy
cgggtttccagagaagccaat

SEQ ID NO: 13570 - DNA, 21 bp, Artificial Sequence
  Artificial sequence related to HLA knockouts in cell therapy
ccctttgtgacttgaagaacc

SEQ ID NO: 13571 - DNA, 21 bp, Artificial Sequence
  Artificial sequence related to HLA knockouts in cell therapy
tctgcaaaggcacctgcatgt

SEQ ID NO: 13572 - DNA, 21 bp, Artificial Sequence
  Artificial sequence related to HLA knockouts in cell therapy
ttcgtgtaggcataatgtgag

SEQ ID NO: 13573 - DNA, 21 bp, Artificial Sequence
  Artificial sequence related to HLA knockouts in cell therapy
ttctgcaaaggcacctgcatg

SEQ ID NO: 13574 - DNA, 21 bp, Artificial Sequence
  Artificial sequence related to HLA knockouts in cell therapy
acctgcatgtgtctgtgttcg

SEQ ID NO: 13575 - DNA, 21 bp, Artificial Sequence
  Artificial sequence related to HLA knockouts in cell therapy
gtctgtgttcgtgtaggcata

SEQ ID NO: 13576 - DNA, 21 bp, Artificial Sequence
  Artificial sequence related to HLA knockouts in cell therapy
gcatgtgtctgtgttcgtgta

SEQ ID NO: 13577 - DNA, 21 bp, Artificial Sequence
  Artificial sequence related to HLA knockouts in cell therapy
catgtgtctgtgttcgtgtag

SEQ ID NO: 13578 - DNA, 21 bp, Artificial Sequence
  Artificial sequence related to HLA knockouts in cell therapy
atgtgtctgtgttcgtgtagg

SEQ ID NO: 13579 - DNA, 21 bp, Artificial Sequence
  Artificial sequence related to HLA knockouts in cell therapy
tgtaacttcttccttccctat

SEQ ID NO: 13580 - DNA, 21 bp, Artificial Sequence
  Artificial sequence related to HLA knockouts in cell therapy
tgagctgtaacttcttccttc

SEQ ID NO: 13581 - DNA, 21 bp, Artificial Sequence
  Artificial sequence related to HLA knockouts in cell therapy
tccttcttcctggatactcac

SEQ ID NO: 13582 - DNA, 21 bp, Artificial Sequence
  Artificial sequence related to HLA knockouts in cell therapy
gcctacgacggcaaggattac

SEQ ID NO: 13583 - DNA, 21 bp, Artificial Sequence
  Artificial sequence related to HLA knockouts in cell therapy
cgcctacgacggcaaggatta

SEQ ID NO: 13584 - DNA, 21 bp, Artificial Sequence
  Artificial sequence related to HLA knockouts in cell therapy
tcattgctggcctggttctct

SEQ ID NO: 13585 - DNA, 21 bp, Artificial Sequence
  Artificial sequence related to HLA knockouts in cell therapy
ctgagctgtaacttcttcctt

SEQ ID NO: 13586 - DNA, 21 bp, Artificial Sequence
  Artificial sequence related to HLA knockouts in cell therapy
ctctcacagcttgtaaagtgt

SEQ ID NO: 13587 - DNA, 21 bp, Artificial Sequence
  Artificial sequence related to HLA knockouts in cell therapy
tgcaaaggcacctgcatgtgt

SEQ ID NO: 13588 - DNA, 21 bp, Artificial Sequence
  Artificial sequence related to HLA knockouts in cell therapy
tccatgaggtatttcttcaca

SEQ ID NO: 13589 - DNA, 21 bp, Artificial Sequence
  Artificial sequence related to HLA knockouts in cell therapy
ttctaccctgcggagatcaca

SEQ ID NO: 13590 - DNA, 21 bp, Artificial Sequence
  Artificial sequence related to HLA knockouts in cell therapy
ctctttggagctgtgatcact

SEQ ID NO: 13591 - DNA, 21 bp, Artificial Sequence
  Artificial sequence related to HLA knockouts in cell therapy
gttcgtgtaggcataatgtga

SEQ ID NO: 13592 - DNA, 21 bp, Artificial Sequence
  Artificial sequence related to HLA knockouts in cell therapy
tgtgagacagctgccttgtgt

SEQ ID NO: 13593 - DNA, 21 bp, Artificial Sequence
  Artificial sequence related to HLA knockouts in cell therapy
ttcctgcccttccctttgtga

SEQ ID NO: 13594 - DNA, 21 bp, Artificial Sequence
  Artificial sequence related to HLA knockouts in cell therapy
tttccagagaagccaatcagt

SEQ ID NO: 13595 - DNA, 21 bp, Artificial Sequence
  Artificial sequence related to HLA knockouts in cell therapy
ttctcacaccgtccagaggat

SEQ ID NO: 13596 - DNA, 21 bp, Artificial Sequence
  Artificial sequence related to HLA knockouts in cell therapy
ggctctgatgtgtctctcaca

SEQ ID NO: 13597 - DNA, 21 bp, Artificial Sequence
  Artificial sequence related to HLA knockouts in cell therapy
tcatctttcctgttccagaga

SEQ ID NO: 13598 - DNA, 21 bp, Artificial Sequence
  Artificial sequence related to HLA knockouts in cell therapy
gtagggtccttcttcctggat

SEQ ID NO: 13599 - DNA, 21 bp, Artificial Sequence
  Artificial sequence related to HLA knockouts in cell therapy
gaaagtgaaggcccactcaca

SEQ ID NO: 13600 - DNA, 21 bp, Artificial Sequence
  Artificial sequence related to HLA knockouts in cell therapy
atacctggagaacgggaagga

SEQ ID NO: 13601 - DNA, 21 bp, Artificial Sequence
  Artificial sequence related to HLA knockouts in cell therapy
tgcatgtgtctgtgttcgtgt

SEQ ID NO: 13602 - DNA, 21 bp, Artificial Sequence
  Artificial sequence related to HLA knockouts in cell therapy
ctgcatgtgtctgtgttcgtg

SEQ ID NO: 13603 - DNA, 21 bp, Artificial Sequence
  Artificial sequence related to HLA knockouts in cell therapy
cttgtaaagtgtgagacagct

SEQ ID NO: 13604 - DNA, 21 bp, Artificial Sequence
  Artificial sequence related to HLA knockouts in cell therapy
tatgtagggtccttcttcctg

SEQ ID NO: 13605 - DNA, 21 bp, Artificial Sequence
  Artificial sequence related to HLA knockouts in cell therapy
ttacatcgccctgaaagagga

SEQ ID NO: 13606 - DNA, 21 bp, Artificial Sequence
  Artificial sequence related to HLA knockouts in cell therapy
attacatcgccctgaaagagg

SEQ ID NO: 13607 - DNA, 21 bp, Artificial Sequence
  Artificial sequence related to HLA knockouts in cell therapy
agagatacacctgccatgtgc

SEQ ID NO: 13608 - DNA, 21 bp, Artificial Sequence
  Artificial sequence related to HLA knockouts in cell therapy
gacaggagcagagatacacct

SEQ ID NO: 13609 - DNA, 21 bp, Artificial Sequence
  Artificial sequence related to HLA knockouts in cell therapy
tgctgtgatgtggaggaggaa

SEQ ID NO: 13610 - DNA, 21 bp, Artificial Sequence
  Artificial sequence related to HLA knockouts in cell therapy
tacacctgccatgtgcagcat

SEQ ID NO: 13611 - DNA, 21 bp, Artificial Sequence
  Artificial sequence related to HLA knockouts in cell therapy
atgtggaggaggaagagctca

SEQ ID NO: 13612 - DNA, 21 bp, Artificial Sequence
  Artificial sequence related to HLA knockouts in cell therapy
gatggaaccttccagaagtgg

SEQ ID NO: 13613 - DNA, 21 bp, Artificial Sequence
  Artificial sequence related to HLA knockouts in cell therapy
gagatacacctgccatgtgca

SEQ ID NO: 13614 - DNA, 21 bp, Artificial Sequence
  Artificial sequence related to HLA knockouts in cell therapy
attgggtgtcgggtttccaga

SEQ ID NO: 13615 - DNA, 21 bp, Artificial Sequence
  Artificial sequence related to HLA knockouts in cell therapy
tgtgatcactggagctgtggt

SEQ ID NO: 13616 - DNA, 21 bp, Artificial Sequence
  Artificial sequence related to HLA knockouts in cell therapy
atgactcaccacgctgtctct

SEQ ID NO: 13617 - DNA, 21 bp, Artificial Sequence
  Artificial sequence related to HLA knockouts in cell therapy
ggtgtctccatctctgtctca

SEQ ID NO: 13618 - DNA, 21 bp, Artificial Sequence
  Artificial sequence related to HLA knockouts in cell therapy
tggttctctttggagctgtga

SEQ ID NO: 13619 - DNA, 21 bp, Artificial Sequence
  Artificial sequence related to HLA knockouts in cell therapy
tcgggtttccagagaagccaa

SEQ ID NO: 13620 - DNA, 21 bp, Artificial Sequence
  Artificial sequence related to HLA knockouts in cell therapy
tttctgcaaaggcacctgcat

SEQ ID NO: 13621 - DNA, 21 bp, Artificial Sequence
  Artificial sequence related to HLA knockouts in cell therapy
ctgaggtgtctccatctctgt

SEQ ID NO: 13622 - DNA, 21 bp, Artificial Sequence
  Artificial sequence related to HLA knockouts in cell therapy
gagcagagatacacctgccat

SEQ ID NO: 13623 - DNA, 21 bp, Artificial Sequence
  Artificial sequence related to HLA knockouts in cell therapy
atatgactcaccacgctgtct

SEQ ID NO: 13624 - DNA, 21 bp, Artificial Sequence
  Artificial sequence related to HLA knockouts in cell therapy
gtgacttgaagaaccctgact

SEQ ID NO: 13625 - DNA, 21 bp, Artificial Sequence
  Artificial sequence related to HLA knockouts in cell therapy
actgagctgtaacttcttcct

SEQ ID NO: 13626 - DNA, 21 bp, Artificial Sequence
  Artificial sequence related to HLA knockouts in cell therapy
ctatgtagggtccttcttcct

SEQ ID NO: 13627 - DNA, 21 bp, Artificial Sequence
  Artificial sequence related to HLA knockouts in cell therapy
tctctgtctcaacttcatggt

SEQ ID NO: 13628 - DNA, 21 bp, Artificial Sequence
  Artificial sequence related to HLA knockouts in cell therapy
agctgtgatcactggagctgt

SEQ ID NO: 13629 - DNA, 21 bp, Artificial Sequence
  Artificial sequence related to HLA knockouts in cell therapy
cctggttctctttggagctgt

SEQ ID NO: 13630 - DNA, 21 bp, Artificial Sequence
  Artificial sequence related to HLA knockouts in cell therapy
cttcatggtgcactgagctgt

SEQ ID NO: 13631 - DNA, 21 bp, Artificial Sequence
  Artificial sequence related to HLA knockouts in cell therapy
tgatgtggaggaggaagagct

SEQ ID NO: 13632 - DNA, 21 bp, Artificial Sequence
  Artificial sequence related to HLA knockouts in cell therapy
tttggagctgtgatcactgga

SEQ ID NO: 13633 - DNA, 21 bp, Artificial Sequence
  Artificial sequence related to HLA knockouts in cell therapy
tctgatgtgtctctcacagct

SEQ ID NO: 13634 - DNA, 21 bp, Artificial Sequence
  Artificial sequence related to HLA knockouts in cell therapy
ctgatgtgtctctcacagctt

SEQ ID NO: 13635 - DNA, 21 bp, Artificial Sequence
  Artificial sequence related to HLA knockouts in cell therapy
caaaggcacctgcatgtgtct

SEQ ID NO: 13636 - DNA, 21 bp, Artificial Sequence
  Artificial sequence related to HLA knockouts in cell therapy
agggctctgatgtgtctctca

SEQ ID NO: 13637 - DNA, 21 bp, Artificial Sequence
  Artificial sequence related to HLA knockouts in cell therapy
tctttcctgttccagagaggt

SEQ ID NO: 13638 - DNA, 21 bp, Artificial Sequence
  Artificial sequence related to HLA knockouts in cell therapy
gaaccctgactttgtttctgc

SEQ ID NO: 13639 - DNA, 21 bp, Artificial Sequence
  Artificial sequence related to HLA knockouts in cell therapy
gagaggcaagagttgttcctg

SEQ ID NO: 13640 - DNA, 21 bp, Artificial Sequence
  Artificial sequence related to HLA knockouts in cell therapy
caatcatctttcctgttccag

SEQ ID NO: 13641 - DNA, 21 bp, Artificial Sequence
  Artificial sequence related to HLA knockouts in cell therapy
cccaacctatgtagggtcctt

SEQ ID NO: 13642 - DNA, 21 bp, Artificial Sequence
  Artificial sequence related to HLA knockouts in cell therapy
tgagaggcaagagttgttcct

SEQ ID NO: 13643 - DNA, 21 bp, Artificial Sequence
  Artificial sequence related to HLA knockouts in cell therapy
agttgttcctgcccttccctt

SEQ ID NO: 13644 - DNA, 21 bp, Artificial Sequence
  Artificial sequence related to HLA knockouts in cell therapy
accctgactttgtttctgcaa

SEQ ID NO: 13645 - DNA, 21 bp, Artificial Sequence
  Artificial sequence related to HLA knockouts in cell therapy
ccaatcatctttcctgttcca

SEQ ID NO: 13646 - DNA, 21 bp, Artificial Sequence
  Artificial sequence related to HLA knockouts in cell therapy
ctgtaacttcttccttcccta

SEQ ID NO: 13647 - DNA, 21 bp, Artificial Sequence
  Artificial sequence related to HLA knockouts in cell therapy
tactctcaggctgcaagcagt

SEQ ID NO: 13648 - DNA, 21 bp, Artificial Sequence
  Artificial sequence related to HLA knockouts in cell therapy
cagcttgtaaagtgtgagaca

SEQ ID NO: 13649 - DNA, 21 bp, Artificial Sequence
  Artificial sequence related to HLA knockouts in cell therapy
cacagcttgtaaagtgtgaga

SEQ ID NO: 13650 - DNA, 21 bp, Artificial Sequence
  Artificial sequence related to HLA knockouts in cell therapy
ttgtgtgggactgagaggcaa

SEQ ID NO: 13651 - DNA, 21 bp, Artificial Sequence
  Artificial sequence related to HLA knockouts in cell therapy
tccagagaagccaatcagtgt

SEQ ID NO: 13652 - DNA, 21 bp, Artificial Sequence
  Artificial sequence related to HLA knockouts in cell therapy
agagaagccaatcagtgtcgt

SEQ ID NO: 13653 - DNA, 21 bp, Artificial Sequence
  Artificial sequence related to HLA knockouts in cell therapy
cgtgtaggcataatgtgagga

SEQ ID NO: 13654 - DNA, 21 bp, Artificial Sequence
  Artificial sequence related to HLA knockouts in cell therapy
cctgcatgtgtctgtgttcgt

SEQ ID NO: 13655 - DNA, 21 bp, Artificial Sequence
  Artificial sequence related to HLA knockouts in cell therapy
tgtctgtgttcgtgtaggcat

SEQ ID NO: 13656 - DNA, 21 bp, Artificial Sequence
  Artificial sequence related to HLA knockouts in cell therapy
ctcaacttcatggtgcactga

SEQ ID NO: 13657 - DNA, 21 bp, Artificial Sequence
  Artificial sequence related to HLA knockouts in cell therapy
ctctgtctcaacttcatggtg

SEQ ID NO: 13658 - DNA, 21 bp, Artificial Sequence
  Artificial sequence related to HLA knockouts in cell therapy
gtctcaacttcatggtgcact

SEQ ID NO: 13659 - DNA, 21 bp, Artificial Sequence
  Artificial sequence related to HLA knockouts in cell therapy
gaggtgtctccatctctgtct

SEQ ID NO: 13660 - DNA, 21 bp, Artificial Sequence
  Artificial sequence related to HLA knockouts in cell therapy
cttcttcctggatactcacga

SEQ ID NO: 13661 - DNA, 21 bp, Artificial Sequence
  Artificial sequence related to HLA knockouts in cell therapy
agatacctggagaacgggaag

SEQ ID NO: 13662 - DNA, 21 bp, Artificial Sequence
  Artificial sequence related to HLA knockouts in cell therapy
gtatttcttcacatccgtgtc

SEQ ID NO: 13663 - DNA, 21 bp, Artificial Sequence
  Artificial sequence related to HLA knockouts in cell therapy
ttctcactcccattgggtgtc

SEQ ID NO: 13664 - DNA, 18 bp, Artificial Sequence
  Artificial sequence related to HLA knockouts in cell therapy
cgaaggcggtgtatggat

SEQ ID NO: 13665 - DNA, 18 bp, Artificial Sequence
  Artificial sequence related to HLA knockouts in cell therapy
gaaggcggtgtatggatt

SEQ ID NO: 13666 - DNA, 18 bp, Artificial Sequence
  Artificial sequence related to HLA knockouts in cell therapy
aaggcggtgtatggattg

SEQ ID NO: 13667 - DNA, 18 bp, Artificial Sequence
  Artificial sequence related to HLA knockouts in cell therapy
aggcggtgtatggattgg

SEQ ID NO: 13668 - DNA, 18 bp, Artificial Sequence
  Artificial sequence related to HLA knockouts in cell therapy
cccaactccgcagtttct

SEQ ID NO: 13669 - DNA, 18 bp, Artificial Sequence
  Artificial sequence related to HLA knockouts in cell therapy
ccaactccgcagtttctt

SEQ ID NO: 13670 - DNA, 18 bp, Artificial Sequence
  Artificial sequence related to HLA knockouts in cell therapy
caactccgcagtttcttt

SEQ ID NO: 13671 - DNA, 18 bp, Artificial Sequence
  Artificial sequence related to HLA knockouts in cell therapy
tttctccctctcccaacc

SEQ ID NO: 13672 - DNA, 18 bp, Artificial Sequence
  Artificial sequence related to HLA knockouts in cell therapy
ttctccctctcccaacct

SEQ ID NO: 13673 - DNA, 18 bp, Artificial Sequence
  Artificial sequence related to HLA knockouts in cell therapy
tctccctctcccaaccta

SEQ ID NO: 13674 - DNA, 18 bp, Artificial Sequence
  Artificial sequence related to HLA knockouts in cell therapy
ctccctctcccaacctat

SEQ ID NO: 13675 - DNA, 18 bp, Artificial Sequence
  Artificial sequence related to HLA knockouts in cell therapy
tccctctcccaacctatg

SEQ ID NO: 13676 - DNA, 18 bp, Artificial Sequence
  Artificial sequence related to HLA knockouts in cell therapy
ccctctcccaacctatgt

SEQ ID NO: 13677 - DNA, 18 bp, Artificial Sequence
  Artificial sequence related to HLA knockouts in cell therapy
cctctcccaacctatgta

SEQ ID NO: 13678 - DNA, 18 bp, Artificial Sequence
  Artificial sequence related to HLA knockouts in cell therapy
ctctcccaacctatgtag

SEQ ID NO: 13679 - DNA, 18 bp, Artificial Sequence
  Artificial sequence related to HLA knockouts in cell therapy
tctcccaacctatgtagg

SEQ ID NO: 13680 - DNA, 18 bp, Artificial Sequence
  Artificial sequence related to HLA knockouts in cell therapy
ctcccaacctatgtaggg

SEQ ID NO: 13681 - DNA, 18 bp, Artificial Sequence
  Artificial sequence related to HLA knockouts in cell therapy
tcccaacctatgtagggt

SEQ ID NO: 13682 - DNA, 18 bp, Artificial Sequence
  Artificial sequence related to HLA knockouts in cell therapy
cccaacctatgtagggtc

SEQ ID NO: 13683 - DNA, 18 bp, Artificial Sequence
  Artificial sequence related to HLA knockouts in cell therapy
ccaacctatgtagggtcc

SEQ ID NO: 13684 - DNA, 18 bp, Artificial Sequence
  Artificial sequence related to HLA knockouts in cell therapy
caacctatgtagggtcct

SEQ ID NO: 13685 - DNA, 18 bp, Artificial Sequence
  Artificial sequence related to HLA knockouts in cell therapy
aacctatgtagggtcctt

SEQ ID NO: 13686 - DNA, 18 bp, Artificial Sequence
  Artificial sequence related to HLA knockouts in cell therapy
acctatgtagggtccttc

SEQ ID NO: 13687 - DNA, 18 bp, Artificial Sequence
  Artificial sequence related to HLA knockouts in cell therapy
cctatgtagggtccttct

SEQ ID NO: 13688 - DNA, 18 bp, Artificial Sequence
  Artificial sequence related to HLA knockouts in cell therapy
ctatgtagggtccttctt

SEQ ID NO: 13689 - DNA, 18 bp, Artificial Sequence
  Artificial sequence related to HLA knockouts in cell therapy
tatgtagggtccttcttc

SEQ ID NO: 13690 - DNA, 18 bp, Artificial Sequence
  Artificial sequence related to HLA knockouts in cell therapy
atgtagggtccttcttcc

SEQ ID NO: 13691 - DNA, 18 bp, Artificial Sequence
  Artificial sequence related to HLA knockouts in cell therapy
tgtagggtccttcttcct

SEQ ID NO: 13692 - DNA, 18 bp, Artificial Sequence
  Artificial sequence related to HLA knockouts in cell therapy
gtagggtccttcttcctg

SEQ ID NO: 13693 - DNA, 18 bp, Artificial Sequence
  Artificial sequence related to HLA knockouts in cell therapy
tagggtccttcttcctgg

SEQ ID NO: 13694 - DNA, 18 bp, Artificial Sequence
  Artificial sequence related to HLA knockouts in cell therapy
agggtccttcttcctgga

SEQ ID NO: 13695 - DNA, 18 bp, Artificial Sequence
  Artificial sequence related to HLA knockouts in cell therapy
gggtccttcttcctggat

SEQ ID NO: 13696 - DNA, 18 bp, Artificial Sequence
  Artificial sequence related to HLA knockouts in cell therapy
ggtccttcttcctggata

SEQ ID NO: 13697 - DNA, 18 bp, Artificial Sequence
  Artificial sequence related to HLA knockouts in cell therapy
gtccttcttcctggatac

SEQ ID NO: 13698 - DNA, 18 bp, Artificial Sequence
  Artificial sequence related to HLA knockouts in cell therapy
tccttcttcctggatact

SEQ ID NO: 13699 - DNA, 18 bp, Artificial Sequence
  Artificial sequence related to HLA knockouts in cell therapy
ccttcttcctggatactc

SEQ ID NO: 13700 - DNA, 18 bp, Artificial Sequence
  Artificial sequence related to HLA knockouts in cell therapy
cttcttcctggatactca

SEQ ID NO: 13701 - DNA, 18 bp, Artificial Sequence
  Artificial sequence related to HLA knockouts in cell therapy
ttcttcctggatactcac

SEQ ID NO: 13702 - DNA, 18 bp, Artificial Sequence
  Artificial sequence related to HLA knockouts in cell therapy
tcttcctggatactcacg

SEQ ID NO: 13703 - DNA, 18 bp, Artificial Sequence
  Artificial sequence related to HLA knockouts in cell therapy
cttcctggatactcacga

SEQ ID NO: 13704 - DNA, 18 bp, Artificial Sequence
  Artificial sequence related to HLA knockouts in cell therapy
ttcctggatactcacgac

SEQ ID NO: 13705 - DNA, 18 bp, Artificial Sequence
  Artificial sequence related to HLA knockouts in cell therapy
tcctggatactcacgacg

SEQ ID NO: 13706 - DNA, 18 bp, Artificial Sequence
  Artificial sequence related to HLA knockouts in cell therapy
acccagttctcactccca

SEQ ID NO: 13707 - DNA, 18 bp, Artificial Sequence
  Artificial sequence related to HLA knockouts in cell therapy
cccagttctcactcccat

SEQ ID NO: 13708 - DNA, 18 bp, Artificial Sequence
  Artificial sequence related to HLA knockouts in cell therapy
ccagttctcactcccatt

SEQ ID NO: 13709 - DNA, 18 bp, Artificial Sequence
  Artificial sequence related to HLA knockouts in cell therapy
cagttctcactcccattg

SEQ ID NO: 13710 - DNA, 18 bp, Artificial Sequence
  Artificial sequence related to HLA knockouts in cell therapy
agttctcactcccattgg

SEQ ID NO: 13711 - DNA, 18 bp, Artificial Sequence
  Artificial sequence related to HLA knockouts in cell therapy
gttctcactcccattggg

SEQ ID NO: 13712 - DNA, 18 bp, Artificial Sequence
  Artificial sequence related to HLA knockouts in cell therapy
ttctcactcccattgggt

SEQ ID NO: 13713 - DNA, 18 bp, Artificial Sequence
  Artificial sequence related to HLA knockouts in cell therapy
tctcactcccattgggtg

SEQ ID NO: 13714 - DNA, 18 bp, Artificial Sequence
  Artificial sequence related to HLA knockouts in cell therapy
ctcactcccattgggtgt

SEQ ID NO: 13715 - DNA, 18 bp, Artificial Sequence
  Artificial sequence related to HLA knockouts in cell therapy
tcactcccattgggtgtc

SEQ ID NO: 13716 - DNA, 18 bp, Artificial Sequence
  Artificial sequence related to HLA knockouts in cell therapy
ccattgggtgtcgggttt

SEQ ID NO: 13717 - DNA, 18 bp, Artificial Sequence
  Artificial sequence related to HLA knockouts in cell therapy
cattgggtgtcgggtttc

SEQ ID NO: 13718 - DNA, 18 bp, Artificial Sequence
  Artificial sequence related to HLA knockouts in cell therapy
attgggtgtcgggtttcc

SEQ ID NO: 13719 - DNA, 18 bp, Artificial Sequence
  Artificial sequence related to HLA knockouts in cell therapy
ttgggtgtcgggtttcca

SEQ ID NO: 13720 - DNA, 18 bp, Artificial Sequence
  Artificial sequence related to HLA knockouts in cell therapy
gtgtcgggtttccagaga

SEQ ID NO: 13721 - DNA, 18 bp, Artificial Sequence
  Artificial sequence related to HLA knockouts in cell therapy
tgtcgggtttccagagaa

SEQ ID NO: 13722 - DNA, 18 bp, Artificial Sequence
  Artificial sequence related to HLA knockouts in cell therapy
gtcgggtttccagagaag

SEQ ID NO: 13723 - DNA, 18 bp, Artificial Sequence
  Artificial sequence related to HLA knockouts in cell therapy
tcgggtttccagagaagc

SEQ ID NO: 13724 - DNA, 18 bp, Artificial Sequence
  Artificial sequence related to HLA knockouts in cell therapy
gggtttccagagaagcca

SEQ ID NO: 13725 - DNA, 18 bp, Artificial Sequence
  Artificial sequence related to HLA knockouts in cell therapy
ggtttccagagaagccaa

SEQ ID NO: 13726 - DNA, 18 bp, Artificial Sequence
  Artificial sequence related to HLA knockouts in cell therapy
gtttccagagaagccaat

SEQ ID NO: 13727 - DNA, 18 bp, Artificial Sequence
  Artificial sequence related to HLA knockouts in cell therapy
tttccagagaagccaatc

SEQ ID NO: 13728 - DNA, 18 bp, Artificial Sequence
  Artificial sequence related to HLA knockouts in cell therapy
ttccagagaagccaatca

SEQ ID NO: 13729 - DNA, 18 bp, Artificial Sequence
  Artificial sequence related to HLA knockouts in cell therapy
tccagagaagccaatcag

SEQ ID NO: 13730 - DNA, 18 bp, Artificial Sequence
  Artificial sequence related to HLA knockouts in cell therapy
ccagagaagccaatcagt

SEQ ID NO: 13731 - DNA, 18 bp, Artificial Sequence
  Artificial sequence related to HLA knockouts in cell therapy
cagagaagccaatcagtg

SEQ ID NO: 13732 - DNA, 18 bp, Artificial Sequence
  Artificial sequence related to HLA knockouts in cell therapy
agagaagccaatcagtgt

SEQ ID NO: 13733 - DNA, 18 bp, Artificial Sequence
  Artificial sequence related to HLA knockouts in cell therapy
gagaagccaatcagtgtc

SEQ ID NO: 13734 - DNA, 18 bp, Artificial Sequence
  Artificial sequence related to HLA knockouts in cell therapy
agaagccaatcagtgtcg

SEQ ID NO: 13735 - DNA, 18 bp, Artificial Sequence
  Artificial sequence related to HLA knockouts in cell therapy
gaagccaatcagtgtcgt

SEQ ID NO: 13736 - DNA, 18 bp, Artificial Sequence
  Artificial sequence related to HLA knockouts in cell therapy
aagccaatcagtgtcgtc

SEQ ID NO: 13737 - DNA, 18 bp, Artificial Sequence
  Artificial sequence related to HLA knockouts in cell therapy
agccaatcagtgtcgtcg

SEQ ID NO: 13738 - DNA, 18 bp, Artificial Sequence
  Artificial sequence related to HLA knockouts in cell therapy
aatcagtgtcgtcgcggt

SEQ ID NO: 13739 - DNA, 18 bp, Artificial Sequence
  Artificial sequence related to HLA knockouts in cell therapy
cggtcgcggttctaaagt

SEQ ID NO: 13740 - DNA, 18 bp, Artificial Sequence
  Artificial sequence related to HLA knockouts in cell therapy
ggtcgcggttctaaagtc

SEQ ID NO: 13741 - DNA, 18 bp, Artificial Sequence
  Artificial sequence related to HLA knockouts in cell therapy
gtcgcggttctaaagtcc

SEQ ID NO: 13742 - DNA, 18 bp, Artificial Sequence
  Artificial sequence related to HLA knockouts in cell therapy
tcgcggttctaaagtccg

SEQ ID NO: 13743 - DNA, 18 bp, Artificial Sequence
  Artificial sequence related to HLA knockouts in cell therapy
gcggttctaaagtccgca

SEQ ID NO: 13744 - DNA, 18 bp, Artificial Sequence
  Artificial sequence related to HLA knockouts in cell therapy
cggttctaaagtccgcac

SEQ ID NO: 13745 - DNA, 18 bp, Artificial Sequence
  Artificial sequence related to HLA knockouts in cell therapy
ggttctaaagtccgcacg

SEQ ID NO: 13746 - DNA, 18 bp, Artificial Sequence
  Artificial sequence related to HLA knockouts in cell therapy
gttctaaagtccgcacgc

SEQ ID NO: 13747 - DNA, 18 bp, Artificial Sequence
  Artificial sequence related to HLA knockouts in cell therapy
ttctaaagtccgcacgca

SEQ ID NO: 13748 - DNA, 18 bp, Artificial Sequence
  Artificial sequence related to HLA knockouts in cell therapy
tctaaagtccgcacgcac

SEQ ID NO: 13749 - DNA, 18 bp, Artificial Sequence
  Artificial sequence related to HLA knockouts in cell therapy
caccgggactcagattct

SEQ ID NO: 13750 - DNA, 18 bp, Artificial Sequence
  Artificial sequence related to HLA knockouts in cell therapy
accgggactcagattctc

SEQ ID NO: 13751 - DNA, 18 bp, Artificial Sequence
  Artificial sequence related to HLA knockouts in cell therapy
aaccctcgtcctgctact

SEQ ID NO: 13752 - DNA, 18 bp, Artificial Sequence
  Artificial sequence related to HLA knockouts in cell therapy
gctctcactccatgaggt

SEQ ID NO: 13753 - DNA, 18 bp, Artificial Sequence
  Artificial sequence related to HLA knockouts in cell therapy
ctctcactccatgaggta

SEQ ID NO: 13754 - DNA, 18 bp, Artificial Sequence
  Artificial sequence related to HLA knockouts in cell therapy
tctcactccatgaggtat

SEQ ID NO: 13755 - DNA, 18 bp, Artificial Sequence
  Artificial sequence related to HLA knockouts in cell therapy
ctcactccatgaggtatt

SEQ ID NO: 13756 - DNA, 18 bp, Artificial Sequence
  Artificial sequence related to HLA knockouts in cell therapy
tcactccatgaggtattt

SEQ ID NO: 13757 - DNA, 18 bp, Artificial Sequence
  Artificial sequence related to HLA knockouts in cell therapy
cactccatgaggtatttc

SEQ ID NO: 13758 - DNA, 18 bp, Artificial Sequence
  Artificial sequence related to HLA knockouts in cell therapy
actccatgaggtatttct

SEQ ID NO: 13759 - DNA, 18 bp, Artificial Sequence
  Artificial sequence related to HLA knockouts in cell therapy
ctccatgaggtatttctt

SEQ ID NO: 13760 - DNA, 18 bp, Artificial Sequence
  Artificial sequence related to HLA knockouts in cell therapy
tccatgaggtatttcttc

SEQ ID NO: 13761 - DNA, 18 bp, Artificial Sequence
  Artificial sequence related to HLA knockouts in cell therapy
ccatgaggtatttcttca

SEQ ID NO: 13762 - DNA, 18 bp, Artificial Sequence
  Artificial sequence related to HLA knockouts in cell therapy
catgaggtatttcttcac

SEQ ID NO: 13763 - DNA, 18 bp, Artificial Sequence
  Artificial sequence related to HLA knockouts in cell therapy
atgaggtatttcttcaca

SEQ ID NO: 13764 - DNA, 18 bp, Artificial Sequence
  Artificial sequence related to HLA knockouts in cell therapy
tgaggtatttcttcacat

SEQ ID NO: 13765 - DNA, 18 bp, Artificial Sequence
  Artificial sequence related to HLA knockouts in cell therapy
gaggtatttcttcacatc

SEQ ID NO: 13766 - DNA, 18 bp, Artificial Sequence
  Artificial sequence related to HLA knockouts in cell therapy
aggtatttcttcacatcc

SEQ ID NO: 13767 - DNA, 18 bp, Artificial Sequence
  Artificial sequence related to HLA knockouts in cell therapy
ggtatttcttcacatccg

SEQ ID NO: 13768 - DNA, 18 bp, Artificial Sequence
  Artificial sequence related to HLA knockouts in cell therapy
gtatttcttcacatccgt

SEQ ID NO: 13769 - DNA, 18 bp, Artificial Sequence
  Artificial sequence related to HLA knockouts in cell therapy
tatttcttcacatccgtg

SEQ ID NO: 13770 - DNA, 18 bp, Artificial Sequence
  Artificial sequence related to HLA knockouts in cell therapy
atttcttcacatccgtgt

SEQ ID NO: 13771 - DNA, 18 bp, Artificial Sequence
  Artificial sequence related to HLA knockouts in cell therapy
tttcttcacatccgtgtc

SEQ ID NO: 13772 - DNA, 18 bp, Artificial Sequence
  Artificial sequence related to HLA knockouts in cell therapy
ttcttcacatccgtgtcc

SEQ ID NO: 13773 - DNA, 18 bp, Artificial Sequence
  Artificial sequence related to HLA knockouts in cell therapy
tcttcacatccgtgtccc

SEQ ID NO: 13774 - DNA, 18 bp, Artificial Sequence
  Artificial sequence related to HLA knockouts in cell therapy
cttcatcgcagtgggcta

SEQ ID NO: 13775 - DNA, 18 bp, Artificial Sequence
  Artificial sequence related to HLA knockouts in cell therapy
ttcatcgcagtgggctac

SEQ ID NO: 13776 - DNA, 18 bp, Artificial Sequence
  Artificial sequence related to HLA knockouts in cell therapy
agttcgtgcggttcgaca

SEQ ID NO: 13777 - DNA, 18 bp, Artificial Sequence
  Artificial sequence related to HLA knockouts in cell therapy
tggatagagcaggagggt

SEQ ID NO: 13778 - DNA, 18 bp, Artificial Sequence
  Artificial sequence related to HLA knockouts in cell therapy
aggagggtccggagtatt

SEQ ID NO: 13779 - DNA, 18 bp, Artificial Sequence
  Artificial sequence related to HLA knockouts in cell therapy
gggagacacggaaagtga

SEQ ID NO: 13780 - DNA, 18 bp, Artificial Sequence
  Artificial sequence related to HLA knockouts in cell therapy
ggagacacggaaagtgaa

SEQ ID NO: 13781 - DNA, 18 bp, Artificial Sequence
  Artificial sequence related to HLA knockouts in cell therapy
gagacacggaaagtgaag

SEQ ID NO: 13782 - DNA, 18 bp, Artificial Sequence
  Artificial sequence related to HLA knockouts in cell therapy
agacacggaaagtgaagg

SEQ ID NO: 13783 - DNA, 18 bp, Artificial Sequence
  Artificial sequence related to HLA knockouts in cell therapy
gacacggaaagtgaaggc

SEQ ID NO: 13784 - DNA, 18 bp, Artificial Sequence
  Artificial sequence related to HLA knockouts in cell therapy
acacggaaagtgaaggcc

SEQ ID NO: 13785 - DNA, 18 bp, Artificial Sequence
  Artificial sequence related to HLA knockouts in cell therapy
acggaaagtgaaggccca

SEQ ID NO: 13786 - DNA, 18 bp, Artificial Sequence
  Artificial sequence related to HLA knockouts in cell therapy
ggaaagtgaaggcccact

SEQ ID NO: 13787 - DNA, 18 bp, Artificial Sequence
  Artificial sequence related to HLA knockouts in cell therapy
gaaagtgaaggcccactc

SEQ ID NO: 13788 - DNA, 18 bp, Artificial Sequence
  Artificial sequence related to HLA knockouts in cell therapy
aaagtgaaggcccactca

SEQ ID NO: 13789 - DNA, 18 bp, Artificial Sequence
  Artificial sequence related to HLA knockouts in cell therapy
aagtgaaggcccactcac

SEQ ID NO: 13790 - DNA, 18 bp, Artificial Sequence
  Artificial sequence related to HLA knockouts in cell therapy
agtgaaggcccactcaca

SEQ ID NO: 13791 - DNA, 18 bp, Artificial Sequence
  Artificial sequence related to HLA knockouts in cell therapy
tgaaggcccactcacaga

SEQ ID NO: 13792 - DNA, 18 bp, Artificial Sequence
  Artificial sequence related to HLA knockouts in cell therapy
aaggcccactcacagact

SEQ ID NO: 13793 - DNA, 18 bp, Artificial Sequence
  Artificial sequence related to HLA knockouts in cell therapy
cactcacagactcaccga

SEQ ID NO: 13794 - DNA, 18 bp, Artificial Sequence
  Artificial sequence related to HLA knockouts in cell therapy
actcacagactcaccgag

SEQ ID NO: 13795 - DNA, 18 bp, Artificial Sequence
  Artificial sequence related to HLA knockouts in cell therapy
ctcacagactcaccgagt

SEQ ID NO: 13796 - DNA, 18 bp, Artificial Sequence
  Artificial sequence related to HLA knockouts in cell therapy
tcacagactcaccgagtg

SEQ ID NO: 13797 - DNA, 18 bp, Artificial Sequence
  Artificial sequence related to HLA knockouts in cell therapy
acagactcaccgagtgga

SEQ ID NO: 13798 - DNA, 18 bp, Artificial Sequence
  Artificial sequence related to HLA knockouts in cell therapy
gcggctactacaaccaga

SEQ ID NO: 13799 - DNA, 18 bp, Artificial Sequence
  Artificial sequence related to HLA knockouts in cell therapy
cggctactacaaccagag

SEQ ID NO: 13800 - DNA, 18 bp, Artificial Sequence
  Artificial sequence related to HLA knockouts in cell therapy
ggctactacaaccagagc

SEQ ID NO: 13801 - DNA, 18 bp, Artificial Sequence
  Artificial sequence related to HLA knockouts in cell therapy
gctactacaaccagagcg

SEQ ID NO: 13802 - DNA, 18 bp, Artificial Sequence
  Artificial sequence related to HLA knockouts in cell therapy
ctactacaaccagagcga

SEQ ID NO: 13803 - DNA, 18 bp, Artificial Sequence
  Artificial sequence related to HLA knockouts in cell therapy
tactacaaccagagcgag

SEQ ID NO: 13804 - DNA, 18 bp, Artificial Sequence
  Artificial sequence related to HLA knockouts in cell therapy
actacaaccagagcgagg

SEQ ID NO: 13805 - DNA, 18 bp, Artificial Sequence
  Artificial sequence related to HLA knockouts in cell therapy
gttctcacaccgtccaga

SEQ ID NO: 13806 - DNA, 18 bp, Artificial Sequence
  Artificial sequence related to HLA knockouts in cell therapy
ttctcacaccgtccagag

SEQ ID NO: 13807 - DNA, 18 bp, Artificial Sequence
  Artificial sequence related to HLA knockouts in cell therapy
tcacaccgtccagaggat

SEQ ID NO: 13808 - DNA, 18 bp, Artificial Sequence
  Artificial sequence related to HLA knockouts in cell therapy
acaccgtccagaggatgt

SEQ ID NO: 13809 - DNA, 18 bp, Artificial Sequence
  Artificial sequence related to HLA knockouts in cell therapy
caccgtccagaggatgta

SEQ ID NO: 13810 - DNA, 18 bp, Artificial Sequence
  Artificial sequence related to HLA knockouts in cell therapy
accgtccagaggatgtat

SEQ ID NO: 13811 - DNA, 18 bp, Artificial Sequence
  Artificial sequence related to HLA knockouts in cell therapy
ccgtccagaggatgtatg

SEQ ID NO: 13812 - DNA, 18 bp, Artificial Sequence
  Artificial sequence related to HLA knockouts in cell therapy
cgtccagaggatgtatgg

SEQ ID NO: 13813 - DNA, 18 bp, Artificial Sequence
  Artificial sequence related to HLA knockouts in cell therapy
gtccagaggatgtatggc

SEQ ID NO: 13814 - DNA, 18 bp, Artificial Sequence
  Artificial sequence related to HLA knockouts in cell therapy
tccagaggatgtatggct

SEQ ID NO: 13815 - DNA, 18 bp, Artificial Sequence
  Artificial sequence related to HLA knockouts in cell therapy
ccagaggatgtatggctg

SEQ ID NO: 13816 - DNA, 18 bp, Artificial Sequence
  Artificial sequence related to HLA knockouts in cell therapy
cagaggatgtatggctgc

SEQ ID NO: 13817 - DNA, 18 bp, Artificial Sequence
  Artificial sequence related to HLA knockouts in cell therapy
agaggatgtatggctgcg

SEQ ID NO: 13818 - DNA, 18 bp, Artificial Sequence
  Artificial sequence related to HLA knockouts in cell therapy
gaggatgtatggctgcga

SEQ ID NO: 13819 - DNA, 18 bp, Artificial Sequence
  Artificial sequence related to HLA knockouts in cell therapy
aggatgtatggctgcgac

SEQ ID NO: 13820 - DNA, 18 bp, Artificial Sequence
  Artificial sequence related to HLA knockouts in cell therapy
gatgtatggctgcgacgt

SEQ ID NO: 13821 - DNA, 18 bp, Artificial Sequence
  Artificial sequence related to HLA knockouts in cell therapy
atgtatggctgcgacgtg

SEQ ID NO: 13822 - DNA, 18 bp, Artificial Sequence
  Artificial sequence related to HLA knockouts in cell therapy
gtaccaccagtacgccta

SEQ ID NO: 13823 - DNA, 18 bp, Artificial Sequence
  Artificial sequence related to HLA knockouts in cell therapy
taccaccagtacgcctac

SEQ ID NO: 13824 - DNA, 18 bp, Artificial Sequence
  Artificial sequence related to HLA knockouts in cell therapy
cctacgacggcaaggatt

SEQ ID NO: 13825 - DNA, 18 bp, Artificial Sequence
  Artificial sequence related to HLA knockouts in cell therapy
ctacgacggcaaggatta

SEQ ID NO: 13826 - DNA, 18 bp, Artificial Sequence
  Artificial sequence related to HLA knockouts in cell therapy
tacgacggcaaggattac

SEQ ID NO: 13827 - DNA, 18 bp, Artificial Sequence
  Artificial sequence related to HLA knockouts in cell therapy
acgacggcaaggattaca

SEQ ID NO: 13828 - DNA, 18 bp, Artificial Sequence
  Artificial sequence related to HLA knockouts in cell therapy
cgacggcaaggattacat

SEQ ID NO: 13829 - DNA, 18 bp, Artificial Sequence
  Artificial sequence related to HLA knockouts in cell therapy
gacggcaaggattacatc

SEQ ID NO: 13830 - DNA, 18 bp, Artificial Sequence
  Artificial sequence related to HLA knockouts in cell therapy
acggcaaggattacatcg

SEQ ID NO: 13831 - DNA, 18 bp, Artificial Sequence
  Artificial sequence related to HLA knockouts in cell therapy
cggcaaggattacatcgc

SEQ ID NO: 13832 - DNA, 18 bp, Artificial Sequence
  Artificial sequence related to HLA knockouts in cell therapy
ggcaaggattacatcgcc

SEQ ID NO: 13833 - DNA, 18 bp, Artificial Sequence
  Artificial sequence related to HLA knockouts in cell therapy
gcaaggattacatcgccc

SEQ ID NO: 13834 - DNA, 18 bp, Artificial Sequence
  Artificial sequence related to HLA knockouts in cell therapy
caaggattacatcgccct

SEQ ID NO: 13835 - DNA, 18 bp, Artificial Sequence
  Artificial sequence related to HLA knockouts in cell therapy
aaggattacatcgccctg

SEQ ID NO: 13836 - DNA, 18 bp, Artificial Sequence
  Artificial sequence related to HLA knockouts in cell therapy
aggattacatcgccctga

SEQ ID NO: 13837 - DNA, 18 bp, Artificial Sequence
  Artificial sequence related to HLA knockouts in cell therapy
ggattacatcgccctgaa

SEQ ID NO: 13838 - DNA, 18 bp, Artificial Sequence
  Artificial sequence related to HLA knockouts in cell therapy
gattacatcgccctgaaa

SEQ ID NO: 13839 - DNA, 18 bp, Artificial Sequence
  Artificial sequence related to HLA knockouts in cell therapy
attacatcgccctgaaag

SEQ ID NO: 13840 - DNA, 18 bp, Artificial Sequence
  Artificial sequence related to HLA knockouts in cell therapy
ttacatcgccctgaaaga

SEQ ID NO: 13841 - DNA, 18 bp, Artificial Sequence
  Artificial sequence related to HLA knockouts in cell therapy
tacatcgccctgaaagag

SEQ ID NO: 13842 - DNA, 18 bp, Artificial Sequence
  Artificial sequence related to HLA knockouts in cell therapy
acatcgccctgaaagagg

SEQ ID NO: 13843 - DNA, 18 bp, Artificial Sequence
  Artificial sequence related to HLA knockouts in cell therapy
catcgccctgaaagagga

SEQ ID NO: 13844 - DNA, 18 bp, Artificial Sequence
  Artificial sequence related to HLA knockouts in cell therapy
atcgccctgaaagaggac

SEQ ID NO: 13845 - DNA, 18 bp, Artificial Sequence
  Artificial sequence related to HLA knockouts in cell therapy
tgaaagaggacctgcgct

SEQ ID NO: 13846 - DNA, 18 bp, Artificial Sequence
  Artificial sequence related to HLA knockouts in cell therapy
aaagaggacctgcgctct

SEQ ID NO: 13847 - DNA, 18 bp, Artificial Sequence
  Artificial sequence related to HLA knockouts in cell therapy
aagaggacctgcgctctt

SEQ ID NO: 13848 - DNA, 18 bp, Artificial Sequence
  Artificial sequence related to HLA knockouts in cell therapy
acatggcagctcagacca

SEQ ID NO: 13849 - DNA, 18 bp, Artificial Sequence
  Artificial sequence related to HLA knockouts in cell therapy
agctcagaccaccaagca

SEQ ID NO: 13850 - DNA, 18 bp, Artificial Sequence
  Artificial sequence related to HLA knockouts in cell therapy
ctcagaccaccaagcaca

SEQ ID NO: 13851 - DNA, 18 bp, Artificial Sequence
  Artificial sequence related to HLA knockouts in cell therapy
tcagaccaccaagcacaa

SEQ ID NO: 13852 - DNA, 18 bp, Artificial Sequence
  Artificial sequence related to HLA knockouts in cell therapy
cagaccaccaagcacaag

SEQ ID NO: 13853 - DNA, 18 bp, Artificial Sequence
  Artificial sequence related to HLA knockouts in cell therapy
agaccaccaagcacaagt

SEQ ID NO: 13854 - DNA, 18 bp, Artificial Sequence
  Artificial sequence related to HLA knockouts in cell therapy
gaccaccaagcacaagtg

SEQ ID NO: 13855 - DNA, 18 bp, Artificial Sequence
  Artificial sequence related to HLA knockouts in cell therapy
accaccaagcacaagtgg

SEQ ID NO: 13856 - DNA, 18 bp, Artificial Sequence
  Artificial sequence related to HLA knockouts in cell therapy
caccaagcacaagtggga

SEQ ID NO: 13857 - DNA, 18 bp, Artificial Sequence
  Artificial sequence related to HLA knockouts in cell therapy
accaagcacaagtgggag

SEQ ID NO: 13858 - DNA, 18 bp, Artificial Sequence
  Artificial sequence related to HLA knockouts in cell therapy
atgtggcggagcagttga

SEQ ID NO: 13859 - DNA, 18 bp, Artificial Sequence
  Artificial sequence related to HLA knockouts in cell therapy
ggagcagttgagagccta

SEQ ID NO: 13860 - DNA, 18 bp, Artificial Sequence
  Artificial sequence related to HLA knockouts in cell therapy
gagcagttgagagcctac

SEQ ID NO: 13861 - DNA, 18 bp, Artificial Sequence
  Artificial sequence related to HLA knockouts in cell therapy
agcagttgagagcctacc

SEQ ID NO: 13862 - DNA, 18 bp, Artificial Sequence
  Artificial sequence related to HLA knockouts in cell therapy
gcagttgagagcctacct

SEQ ID NO: 13863 - DNA, 18 bp, Artificial Sequence
  Artificial sequence related to HLA knockouts in cell therapy
cagttgagagcctacctg

SEQ ID NO: 13864 - DNA, 18 bp, Artificial Sequence
  Artificial sequence related to HLA knockouts in cell therapy
agttgagagcctacctgg

SEQ ID NO: 13865 - DNA, 18 bp, Artificial Sequence
  Artificial sequence related to HLA knockouts in cell therapy
gttgagagcctacctgga

SEQ ID NO: 13866 - DNA, 18 bp, Artificial Sequence
  Artificial sequence related to HLA knockouts in cell therapy
ttgagagcctacctggag

SEQ ID NO: 13867 - DNA, 18 bp, Artificial Sequence
  Artificial sequence related to HLA knockouts in cell therapy
tccgcagatacctggaga

SEQ ID NO: 13868 - DNA, 18 bp, Artificial Sequence
  Artificial sequence related to HLA knockouts in cell therapy
ccgcagatacctggagaa

SEQ ID NO: 13869 - DNA, 18 bp, Artificial Sequence
  Artificial sequence related to HLA knockouts in cell therapy
cgcagatacctggagaac

SEQ ID NO: 13870 - DNA, 18 bp, Artificial Sequence
  Artificial sequence related to HLA knockouts in cell therapy
gcagatacctggagaacg

SEQ ID NO: 13871 - DNA, 18 bp, Artificial Sequence
  Artificial sequence related to HLA knockouts in cell therapy
cagatacctggagaacgg

SEQ ID NO: 13872 - DNA, 18 bp, Artificial Sequence
  Artificial sequence related to HLA knockouts in cell therapy
agatacctggagaacggg

SEQ ID NO: 13873 - DNA, 18 bp, Artificial Sequence
  Artificial sequence related to HLA knockouts in cell therapy
gatacctggagaacggga

SEQ ID NO: 13874 - DNA, 18 bp, Artificial Sequence
  Artificial sequence related to HLA knockouts in cell therapy
atacctggagaacgggaa

SEQ ID NO: 13875 - DNA, 18 bp, Artificial Sequence
  Artificial sequence related to HLA knockouts in cell therapy
tacctggagaacgggaag

SEQ ID NO: 13876 - DNA, 18 bp, Artificial Sequence
  Artificial sequence related to HLA knockouts in cell therapy
tggagaacgggaaggaga

SEQ ID NO: 13877 - DNA, 18 bp, Artificial Sequence
  Artificial sequence related to HLA knockouts in cell therapy
aaacgcatatgactcacc

SEQ ID NO: 13878 - DNA, 18 bp, Artificial Sequence
  Artificial sequence related to HLA knockouts in cell therapy
aacgcatatgactcacca

SEQ ID NO: 13879 - DNA, 18 bp, Artificial Sequence
  Artificial sequence related to HLA knockouts in cell therapy
acgcatatgactcaccac

SEQ ID NO: 13880 - DNA, 18 bp, Artificial Sequence
  Artificial sequence related to HLA knockouts in cell therapy
cgcatatgactcaccacg

SEQ ID NO: 13881 - DNA, 18 bp, Artificial Sequence
  Artificial sequence related to HLA knockouts in cell therapy
gcatatgactcaccacgc

SEQ ID NO: 13882 - DNA, 18 bp, Artificial Sequence
  Artificial sequence related to HLA knockouts in cell therapy
catatgactcaccacgct

SEQ ID NO: 13883 - DNA, 18 bp, Artificial Sequence
  Artificial sequence related to HLA knockouts in cell therapy
atatgactcaccacgctg

SEQ ID NO: 13884 - DNA, 18 bp, Artificial Sequence
  Artificial sequence related to HLA knockouts in cell therapy
tatgactcaccacgctgt

SEQ ID NO: 13885 - DNA, 18 bp, Artificial Sequence
  Artificial sequence related to HLA knockouts in cell therapy
atgactcaccacgctgtc

SEQ ID NO: 13886 - DNA, 18 bp, Artificial Sequence
  Artificial sequence related to HLA knockouts in cell therapy
tgactcaccacgctgtct

SEQ ID NO: 13887 - DNA, 18 bp, Artificial Sequence
  Artificial sequence related to HLA knockouts in cell therapy
actcaccacgctgtctct

SEQ ID NO: 13888 - DNA, 18 bp, Artificial Sequence
  Artificial sequence related to HLA knockouts in cell therapy
tcaccacgctgtctctga

SEQ ID NO: 13889 - DNA, 18 bp, Artificial Sequence
  Artificial sequence related to HLA knockouts in cell therapy
cacgctgtctctgaccat

SEQ ID NO: 13890 - DNA, 18 bp, Artificial Sequence
  Artificial sequence related to HLA knockouts in cell therapy
acgctgtctctgaccatg

SEQ ID NO: 13891 - DNA, 18 bp, Artificial Sequence
  Artificial sequence related to HLA knockouts in cell therapy
cgctgtctctgaccatga

SEQ ID NO: 13892 - DNA, 18 bp, Artificial Sequence
  Artificial sequence related to HLA knockouts in cell therapy
gctgtctctgaccatgaa

SEQ ID NO: 13893 - DNA, 18 bp, Artificial Sequence
  Artificial sequence related to HLA knockouts in cell therapy
ctgtctctgaccatgaag

SEQ ID NO: 13894 - DNA, 18 bp, Artificial Sequence
  Artificial sequence related to HLA knockouts in cell therapy
tgtctctgaccatgaagc

SEQ ID NO: 13895 - DNA, 18 bp, Artificial Sequence
  Artificial sequence related to HLA knockouts in cell therapy
gtctctgaccatgaagcc

SEQ ID NO: 13896 - DNA, 18 bp, Artificial Sequence
  Artificial sequence related to HLA knockouts in cell therapy
tctctgaccatgaagcca

SEQ ID NO: 13897 - DNA, 18 bp, Artificial Sequence
  Artificial sequence related to HLA knockouts in cell therapy
ctctgaccatgaagccac

SEQ ID NO: 13898 - DNA, 18 bp, Artificial Sequence
  Artificial sequence related to HLA knockouts in cell therapy
tctgaccatgaagccacc

SEQ ID NO: 13899 - DNA, 18 bp, Artificial Sequence
  Artificial sequence related to HLA knockouts in cell therapy
tgaccatgaagccaccct

SEQ ID NO: 13900 - DNA, 18 bp, Artificial Sequence
  Artificial sequence related to HLA knockouts in cell therapy
accatgaagccaccctga

SEQ ID NO: 13901 - DNA, 18 bp, Artificial Sequence
  Artificial sequence related to HLA knockouts in cell therapy
atgaagccaccctgaggt

SEQ ID NO: 13902 - DNA, 18 bp, Artificial Sequence
  Artificial sequence related to HLA knockouts in cell therapy
cttctaccctgcggagat

SEQ ID NO: 13903 - DNA, 18 bp, Artificial Sequence
  Artificial sequence related to HLA knockouts in cell therapy
ttctaccctgcggagatc

SEQ ID NO: 13904 - DNA, 18 bp, Artificial Sequence
  Artificial sequence related to HLA knockouts in cell therapy
tctaccctgcggagatca

SEQ ID NO: 13905 - DNA, 18 bp, Artificial Sequence
  Artificial sequence related to HLA knockouts in cell therapy
taccctgcggagatcaca

SEQ ID NO: 13906 - DNA, 18 bp, Artificial Sequence
  Artificial sequence related to HLA knockouts in cell therapy
ctgcggagatcacactga

SEQ ID NO: 13907 - DNA, 18 bp, Artificial Sequence
  Artificial sequence related to HLA knockouts in cell therapy
tgcggagatcacactgac

SEQ ID NO: 13908 - DNA, 18 bp, Artificial Sequence
  Artificial sequence related to HLA knockouts in cell therapy
cggagatcacactgacct

SEQ ID NO: 13909 - DNA, 18 bp, Artificial Sequence
  Artificial sequence related to HLA knockouts in cell therapy
ggagatcacactgacctg

SEQ ID NO: 13910 - DNA, 18 bp, Artificial Sequence
  Artificial sequence related to HLA knockouts in cell therapy
gagatcacactgacctgg

SEQ ID NO: 13911 - DNA, 18 bp, Artificial Sequence
  Artificial sequence related to HLA knockouts in cell therapy
agatcacactgacctggc

SEQ ID NO: 13912 - DNA, 18 bp, Artificial Sequence
  Artificial sequence related to HLA knockouts in cell therapy
gatcacactgacctggca

SEQ ID NO: 13913 - DNA, 18 bp, Artificial Sequence
  Artificial sequence related to HLA knockouts in cell therapy
atcacactgacctggcag

SEQ ID NO: 13914 - DNA, 18 bp, Artificial Sequence
  Artificial sequence related to HLA knockouts in cell therapy
gggatggaaccttccaga

SEQ ID NO: 13915 - DNA, 18 bp, Artificial Sequence
  Artificial sequence related to HLA knockouts in cell therapy
ggatggaaccttccagaa

SEQ ID NO: 13916 - DNA, 18 bp, Artificial Sequence
  Artificial sequence related to HLA knockouts in cell therapy
gatggaaccttccagaag

SEQ ID NO: 13917 - DNA, 18 bp, Artificial Sequence
  Artificial sequence related to HLA knockouts in cell therapy
atggaaccttccagaagt

SEQ ID NO: 13918 - DNA, 18 bp, Artificial Sequence
  Artificial sequence related to HLA knockouts in cell therapy
tggaaccttccagaagtg

SEQ ID NO: 13919 - DNA, 18 bp, Artificial Sequence
  Artificial sequence related to HLA knockouts in cell therapy
ggaaccttccagaagtgg

SEQ ID NO: 13920 - DNA, 18 bp, Artificial Sequence
  Artificial sequence related to HLA knockouts in cell therapy
gaaccttccagaagtggg

SEQ ID NO: 13921 - DNA, 18 bp, Artificial Sequence
  Artificial sequence related to HLA knockouts in cell therapy
aaccttccagaagtgggc

SEQ ID NO: 13922 - DNA, 18 bp, Artificial Sequence
  Artificial sequence related to HLA knockouts in cell therapy
cttctggacaggagcaga

SEQ ID NO: 13923 - DNA, 18 bp, Artificial Sequence
  Artificial sequence related to HLA knockouts in cell therapy
ttctggacaggagcagag

SEQ ID NO: 13924 - DNA, 18 bp, Artificial Sequence
  Artificial sequence related to HLA knockouts in cell therapy
tctggacaggagcagaga

SEQ ID NO: 13925 - DNA, 18 bp, Artificial Sequence
  Artificial sequence related to HLA knockouts in cell therapy
ctggacaggagcagagat

SEQ ID NO: 13926 - DNA, 18 bp, Artificial Sequence
  Artificial sequence related to HLA knockouts in cell therapy
tggacaggagcagagata

SEQ ID NO: 13927 - DNA, 18 bp, Artificial Sequence
  Artificial sequence related to HLA knockouts in cell therapy
ggacaggagcagagatac

SEQ ID NO: 13928 - DNA, 18 bp, Artificial Sequence
  Artificial sequence related to HLA knockouts in cell therapy
gacaggagcagagataca

SEQ ID NO: 13929 - DNA, 18 bp, Artificial Sequence
  Artificial sequence related to HLA knockouts in cell therapy
acaggagcagagatacac

SEQ ID NO: 13930 - DNA, 18 bp, Artificial Sequence
  Artificial sequence related to HLA knockouts in cell therapy
caggagcagagatacacc

SEQ ID NO: 13931 - DNA, 18 bp, Artificial Sequence
  Artificial sequence related to HLA knockouts in cell therapy
aggagcagagatacacct

SEQ ID NO: 13932 - DNA, 18 bp, Artificial Sequence
  Artificial sequence related to HLA knockouts in cell therapy
ggagcagagatacacctg

SEQ ID NO: 13933 - DNA, 18 bp, Artificial Sequence
  Artificial sequence related to HLA knockouts in cell therapy
gagcagagatacacctgc

SEQ ID NO: 13934 - DNA, 18 bp, Artificial Sequence
  Artificial sequence related to HLA knockouts in cell therapy
agcagagatacacctgcc

SEQ ID NO: 13935 - DNA, 18 bp, Artificial Sequence
  Artificial sequence related to HLA knockouts in cell therapy
gcagagatacacctgcca

SEQ ID NO: 13936 - DNA, 18 bp, Artificial Sequence
  Artificial sequence related to HLA knockouts in cell therapy
cagagatacacctgccat

SEQ ID NO: 13937 - DNA, 18 bp, Artificial Sequence
  Artificial sequence related to HLA knockouts in cell therapy
agagatacacctgccatg

SEQ ID NO: 13938 - DNA, 18 bp, Artificial Sequence
  Artificial sequence related to HLA knockouts in cell therapy
gagatacacctgccatgt

SEQ ID NO: 13939 - DNA, 18 bp, Artificial Sequence
  Artificial sequence related to HLA knockouts in cell therapy
agatacacctgccatgtg

SEQ ID NO: 13940 - DNA, 18 bp, Artificial Sequence
  Artificial sequence related to HLA knockouts in cell therapy
gatacacctgccatgtgc

SEQ ID NO: 13941 - DNA, 18 bp, Artificial Sequence
  Artificial sequence related to HLA knockouts in cell therapy
atacacctgccatgtgca

SEQ ID NO: 13942 - DNA, 18 bp, Artificial Sequence
  Artificial sequence related to HLA knockouts in cell therapy
tacacctgccatgtgcag

SEQ ID NO: 13943 - DNA, 18 bp, Artificial Sequence
  Artificial sequence related to HLA knockouts in cell therapy
acctgccatgtgcagcat

SEQ ID NO: 13944 - DNA, 18 bp, Artificial Sequence
  Artificial sequence related to HLA knockouts in cell therapy
ctgccatgtgcagcatga

SEQ ID NO: 13945 - DNA, 18 bp, Artificial Sequence
  Artificial sequence related to HLA knockouts in cell therapy
tgccatgtgcagcatgag

SEQ ID NO: 13946 - DNA, 18 bp, Artificial Sequence
  Artificial sequence related to HLA knockouts in cell therapy
catgtgcagcatgagggt

SEQ ID NO: 13947 - DNA, 18 bp, Artificial Sequence
  Artificial sequence related to HLA knockouts in cell therapy
atgtgcagcatgagggtt

SEQ ID NO: 13948 - DNA, 18 bp, Artificial Sequence
  Artificial sequence related to HLA knockouts in cell therapy
tgtgcagcatgagggttt

SEQ ID NO: 13949 - DNA, 18 bp, Artificial Sequence
  Artificial sequence related to HLA knockouts in cell therapy
gtgcagcatgagggtttg

SEQ ID NO: 13950 - DNA, 18 bp, Artificial Sequence
  Artificial sequence related to HLA knockouts in cell therapy
tgcagcatgagggtttgc

SEQ ID NO: 13951 - DNA, 18 bp, Artificial Sequence
  Artificial sequence related to HLA knockouts in cell therapy
agcatgagggtttgccca

SEQ ID NO: 13952 - DNA, 18 bp, Artificial Sequence
  Artificial sequence related to HLA knockouts in cell therapy
gcatgagggtttgcccaa

SEQ ID NO: 13953 - DNA, 18 bp, Artificial Sequence
  Artificial sequence related to HLA knockouts in cell therapy
catgagggtttgcccaag

SEQ ID NO: 13954 - DNA, 18 bp, Artificial Sequence
  Artificial sequence related to HLA knockouts in cell therapy
atgagggtttgcccaagc

SEQ ID NO: 13955 - DNA, 18 bp, Artificial Sequence
  Artificial sequence related to HLA knockouts in cell therapy
tgagatgggagccgtctt

SEQ ID NO: 13956 - DNA, 18 bp, Artificial Sequence
  Artificial sequence related to HLA knockouts in cell therapy
cccatcgtgggcatcatt

SEQ ID NO: 13957 - DNA, 18 bp, Artificial Sequence
  Artificial sequence related to HLA knockouts in cell therapy
ccatcgtgggcatcattg

SEQ ID NO: 13958 - DNA, 18 bp, Artificial Sequence
  Artificial sequence related to HLA knockouts in cell therapy
catcgtgggcatcattgc

SEQ ID NO: 13959 - DNA, 18 bp, Artificial Sequence
  Artificial sequence related to HLA knockouts in cell therapy
atcgtgggcatcattgct

SEQ ID NO: 13960 - DNA, 18 bp, Artificial Sequence
  Artificial sequence related to HLA knockouts in cell therapy
tcgtgggcatcattgctg

SEQ ID NO: 13961 - DNA, 18 bp, Artificial Sequence
  Artificial sequence related to HLA knockouts in cell therapy
catcattgctggcctggt

SEQ ID NO: 13962 - DNA, 18 bp, Artificial Sequence
  Artificial sequence related to HLA knockouts in cell therapy
atcattgctggcctggtt

SEQ ID NO: 13963 - DNA, 18 bp, Artificial Sequence
  Artificial sequence related to HLA knockouts in cell therapy
tcattgctggcctggttc

SEQ ID NO: 13964 - DNA, 18 bp, Artificial Sequence
  Artificial sequence related to HLA knockouts in cell therapy
cattgctggcctggttct

SEQ ID NO: 13965 - DNA, 18 bp, Artificial Sequence
  Artificial sequence related to HLA knockouts in cell therapy
attgctggcctggttctc

SEQ ID NO: 13966 - DNA, 18 bp, Artificial Sequence
  Artificial sequence related to HLA knockouts in cell therapy
ttgctggcctggttctct

SEQ ID NO: 13967 - DNA, 18 bp, Artificial Sequence
  Artificial sequence related to HLA knockouts in cell therapy
tgctggcctggttctctt

SEQ ID NO: 13968 - DNA, 18 bp, Artificial Sequence
  Artificial sequence related to HLA knockouts in cell therapy
gctggcctggttctcttt

SEQ ID NO: 13969 - DNA, 18 bp, Artificial Sequence
  Artificial sequence related to HLA knockouts in cell therapy
ctggcctggttctctttg

SEQ ID NO: 13970 - DNA, 18 bp, Artificial Sequence
  Artificial sequence related to HLA knockouts in cell therapy
tggcctggttctctttgg

SEQ ID NO: 13971 - DNA, 18 bp, Artificial Sequence
  Artificial sequence related to HLA knockouts in cell therapy
ggcctggttctctttgga

SEQ ID NO: 13972 - DNA, 18 bp, Artificial Sequence
  Artificial sequence related to HLA knockouts in cell therapy
gcctggttctctttggag

SEQ ID NO: 13973 - DNA, 18 bp, Artificial Sequence
  Artificial sequence related to HLA knockouts in cell therapy
cctggttctctttggagc

SEQ ID NO: 13974 - DNA, 18 bp, Artificial Sequence
  Artificial sequence related to HLA knockouts in cell therapy
ctggttctctttggagct

SEQ ID NO: 13975 - DNA, 18 bp, Artificial Sequence
  Artificial sequence related to HLA knockouts in cell therapy
tggttctctttggagctg

SEQ ID NO: 13976 - DNA, 18 bp, Artificial Sequence
  Artificial sequence related to HLA knockouts in cell therapy
ggttctctttggagctgt

SEQ ID NO: 13977 - DNA, 18 bp, Artificial Sequence
  Artificial sequence related to HLA knockouts in cell therapy
gttctctttggagctgtg

SEQ ID NO: 13978 - DNA, 18 bp, Artificial Sequence
  Artificial sequence related to HLA knockouts in cell therapy
ttctctttggagctgtga

SEQ ID NO: 13979 - DNA, 18 bp, Artificial Sequence
  Artificial sequence related to HLA knockouts in cell therapy
tctctttggagctgtgat

SEQ ID NO: 13980 - DNA, 18 bp, Artificial Sequence
  Artificial sequence related to HLA knockouts in cell therapy
ctctttggagctgtgatc

SEQ ID NO: 13981 - DNA, 18 bp, Artificial Sequence
  Artificial sequence related to HLA knockouts in cell therapy
tctttggagctgtgatca

SEQ ID NO: 13982 - DNA, 18 bp, Artificial Sequence
  Artificial sequence related to HLA knockouts in cell therapy
ctttggagctgtgatcac

SEQ ID NO: 13983 - DNA, 18 bp, Artificial Sequence
  Artificial sequence related to HLA knockouts in cell therapy
tttggagctgtgatcact

SEQ ID NO: 13984 - DNA, 18 bp, Artificial Sequence
  Artificial sequence related to HLA knockouts in cell therapy
ttggagctgtgatcactg

SEQ ID NO: 13985 - DNA, 18 bp, Artificial Sequence
  Artificial sequence related to HLA knockouts in cell therapy
tggagctgtgatcactgg

SEQ ID NO: 13986 - DNA, 18 bp, Artificial Sequence
  Artificial sequence related to HLA knockouts in cell therapy
ggagctgtgatcactgga

SEQ ID NO: 13987 - DNA, 18 bp, Artificial Sequence
  Artificial sequence related to HLA knockouts in cell therapy
gagctgtgatcactggag

SEQ ID NO: 13988 - DNA, 18 bp, Artificial Sequence
  Artificial sequence related to HLA knockouts in cell therapy
agctgtgatcactggagc

SEQ ID NO: 13989 - DNA, 18 bp, Artificial Sequence
  Artificial sequence related to HLA knockouts in cell therapy
gctgtgatcactggagct

SEQ ID NO: 13990 - DNA, 18 bp, Artificial Sequence
  Artificial sequence related to HLA knockouts in cell therapy
ctgtgatcactggagctg

SEQ ID NO: 13991 - DNA, 18 bp, Artificial Sequence
  Artificial sequence related to HLA knockouts in cell therapy
tgtgatcactggagctgt

SEQ ID NO: 13992 - DNA, 18 bp, Artificial Sequence
  Artificial sequence related to HLA knockouts in cell therapy
gtgatcactggagctgtg

SEQ ID NO: 13993 - DNA, 18 bp, Artificial Sequence
  Artificial sequence related to HLA knockouts in cell therapy
tgatcactggagctgtgg

SEQ ID NO: 13994 - DNA, 18 bp, Artificial Sequence
  Artificial sequence related to HLA knockouts in cell therapy
gatcactggagctgtggt

SEQ ID NO: 13995 - DNA, 18 bp, Artificial Sequence
  Artificial sequence related to HLA knockouts in cell therapy
atcactggagctgtggtc

SEQ ID NO: 13996 - DNA, 18 bp, Artificial Sequence
  Artificial sequence related to HLA knockouts in cell therapy
tgtggtcgctgctgtgat

SEQ ID NO: 13997 - DNA, 18 bp, Artificial Sequence
  Artificial sequence related to HLA knockouts in cell therapy
tggtcgctgctgtgatgt

SEQ ID NO: 13998 - DNA, 18 bp, Artificial Sequence
  Artificial sequence related to HLA knockouts in cell therapy
tcgctgctgtgatgtgga

SEQ ID NO: 13999 - DNA, 18 bp, Artificial Sequence
  Artificial sequence related to HLA knockouts in cell therapy
ctgctgtgatgtggagga

SEQ ID NO: 14000 - DNA, 18 bp, Artificial Sequence
  Artificial sequence related to HLA knockouts in cell therapy
tgctgtgatgtggaggag

SEQ ID NO: 14001 - DNA, 18 bp, Artificial Sequence
  Artificial sequence related to HLA knockouts in cell therapy
ctgtgatgtggaggagga

SEQ ID NO: 14002 - DNA, 18 bp, Artificial Sequence
  Artificial sequence related to HLA knockouts in cell therapy
tgtgatgtggaggaggaa

SEQ ID NO: 14003 - DNA, 18 bp, Artificial Sequence
  Artificial sequence related to HLA knockouts in cell therapy
gtgatgtggaggaggaag

SEQ ID NO: 14004 - DNA, 18 bp, Artificial Sequence
  Artificial sequence related to HLA knockouts in cell therapy
tgatgtggaggaggaaga

SEQ ID NO: 14005 - DNA, 18 bp, Artificial Sequence
  Artificial sequence related to HLA knockouts in cell therapy
gatgtggaggaggaagag

SEQ ID NO: 14006 - DNA, 18 bp, Artificial Sequence
  Artificial sequence related to HLA knockouts in cell therapy
atgtggaggaggaagagc

SEQ ID NO: 14007 - DNA, 18 bp, Artificial Sequence
  Artificial sequence related to HLA knockouts in cell therapy
tgtggaggaggaagagct

SEQ ID NO: 14008 - DNA, 18 bp, Artificial Sequence
  Artificial sequence related to HLA knockouts in cell therapy
tggaggaggaagagctca

SEQ ID NO: 14009 - DNA, 18 bp, Artificial Sequence
  Artificial sequence related to HLA knockouts in cell therapy
gaggaggaagagctcaga

SEQ ID NO: 14010 - DNA, 18 bp, Artificial Sequence
  Artificial sequence related to HLA knockouts in cell therapy
aggaggaagagctcagat

SEQ ID NO: 14011 - DNA, 18 bp, Artificial Sequence
  Artificial sequence related to HLA knockouts in cell therapy
ggaggaagagctcagata

SEQ ID NO: 14012 - DNA, 18 bp, Artificial Sequence
  Artificial sequence related to HLA knockouts in cell therapy
gaggaagagctcagatag

SEQ ID NO: 14013 - DNA, 18 bp, Artificial Sequence
  Artificial sequence related to HLA knockouts in cell therapy
aggaagagctcagataga

SEQ ID NO: 14014 - DNA, 18 bp, Artificial Sequence
  Artificial sequence related to HLA knockouts in cell therapy
ggaagagctcagatagaa

SEQ ID NO: 14015 - DNA, 18 bp, Artificial Sequence
  Artificial sequence related to HLA knockouts in cell therapy
gaagagctcagatagaaa

SEQ ID NO: 14016 - DNA, 18 bp, Artificial Sequence
  Artificial sequence related to HLA knockouts in cell therapy
aaaggagggagctactct

SEQ ID NO: 14017 - DNA, 18 bp, Artificial Sequence
  Artificial sequence related to HLA knockouts in cell therapy
aaggagggagctactctc

SEQ ID NO: 14018 - DNA, 18 bp, Artificial Sequence
  Artificial sequence related to HLA knockouts in cell therapy
aggagggagctactctca

SEQ ID NO: 14019 - DNA, 18 bp, Artificial Sequence
  Artificial sequence related to HLA knockouts in cell therapy
agctactctcaggctgca

SEQ ID NO: 14020 - DNA, 18 bp, Artificial Sequence
  Artificial sequence related to HLA knockouts in cell therapy
gctactctcaggctgcaa

SEQ ID NO: 14021 - DNA, 18 bp, Artificial Sequence
  Artificial sequence related to HLA knockouts in cell therapy
ctactctcaggctgcaag

SEQ ID NO: 14022 - DNA, 18 bp, Artificial Sequence
  Artificial sequence related to HLA knockouts in cell therapy
tactctcaggctgcaagc

SEQ ID NO: 14023 - DNA, 18 bp, Artificial Sequence
  Artificial sequence related to HLA knockouts in cell therapy
actctcaggctgcaagca

SEQ ID NO: 14024 - DNA, 18 bp, Artificial Sequence
  Artificial sequence related to HLA knockouts in cell therapy
tctcaggctgcaagcagt

SEQ ID NO: 14025 - DNA, 18 bp, Artificial Sequence
  Artificial sequence related to HLA knockouts in cell therapy
tcaggctgcaagcagtga

SEQ ID NO: 14026 - DNA, 18 bp, Artificial Sequence
  Artificial sequence related to HLA knockouts in cell therapy
aggctgcaagcagtgaca

SEQ ID NO: 14027 - DNA, 18 bp, Artificial Sequence
  Artificial sequence related to HLA knockouts in cell therapy
gctgcaagcagtgacagt

SEQ ID NO: 14028 - DNA, 18 bp, Artificial Sequence
  Artificial sequence related to HLA knockouts in cell therapy
ctgcaagcagtgacagtg

SEQ ID NO: 14029 - DNA, 18 bp, Artificial Sequence
  Artificial sequence related to HLA knockouts in cell therapy
tgcaagcagtgacagtgc

SEQ ID NO: 14030 - DNA, 18 bp, Artificial Sequence
  Artificial sequence related to HLA knockouts in cell therapy
aagcagtgacagtgccca

SEQ ID NO: 14031 - DNA, 18 bp, Artificial Sequence
  Artificial sequence related to HLA knockouts in cell therapy
cagggctctgatgtgtct

SEQ ID NO: 14032 - DNA, 18 bp, Artificial Sequence
  Artificial sequence related to HLA knockouts in cell therapy
agggctctgatgtgtctc

SEQ ID NO: 14033 - DNA, 18 bp, Artificial Sequence
  Artificial sequence related to HLA knockouts in cell therapy
gggctctgatgtgtctct

SEQ ID NO: 14034 - DNA, 18 bp, Artificial Sequence
  Artificial sequence related to HLA knockouts in cell therapy
ggctctgatgtgtctctc

SEQ ID NO: 14035 - DNA, 18 bp, Artificial Sequence
  Artificial sequence related to HLA knockouts in cell therapy
gctctgatgtgtctctca

SEQ ID NO: 14036 - DNA, 18 bp, Artificial Sequence
  Artificial sequence related to HLA knockouts in cell therapy
ctctgatgtgtctctcac

SEQ ID NO: 14037 - DNA, 18 bp, Artificial Sequence
  Artificial sequence related to HLA knockouts in cell therapy
tctgatgtgtctctcaca

SEQ ID NO: 14038 - DNA, 18 bp, Artificial Sequence
  Artificial sequence related to HLA knockouts in cell therapy
ctgatgtgtctctcacag

SEQ ID NO: 14039 - DNA, 18 bp, Artificial Sequence
  Artificial sequence related to HLA knockouts in cell therapy
tgatgtgtctctcacagc

SEQ ID NO: 14040 - DNA, 18 bp, Artificial Sequence
  Artificial sequence related to HLA knockouts in cell therapy
gatgtgtctctcacagct

SEQ ID NO: 14041 - DNA, 18 bp, Artificial Sequence
  Artificial sequence related to HLA knockouts in cell therapy
atgtgtctctcacagctt

SEQ ID NO: 14042 - DNA, 18 bp, Artificial Sequence
  Artificial sequence related to HLA knockouts in cell therapy
tgtgtctctcacagcttg

SEQ ID NO: 14043 - DNA, 18 bp, Artificial Sequence
  Artificial sequence related to HLA knockouts in cell therapy
gtgtctctcacagcttgt

SEQ ID NO: 14044 - DNA, 18 bp, Artificial Sequence
  Artificial sequence related to HLA knockouts in cell therapy
tgtctctcacagcttgta

SEQ ID NO: 14045 - DNA, 18 bp, Artificial Sequence
  Artificial sequence related to HLA knockouts in cell therapy
gtctctcacagcttgtaa

SEQ ID NO: 14046 - DNA, 18 bp, Artificial Sequence
  Artificial sequence related to HLA knockouts in cell therapy
tctctcacagcttgtaaa

SEQ ID NO: 14047 - DNA, 18 bp, Artificial Sequence
  Artificial sequence related to HLA knockouts in cell therapy
ctctcacagcttgtaaag

SEQ ID NO: 14048 - DNA, 18 bp, Artificial Sequence
  Artificial sequence related to HLA knockouts in cell therapy
tctcacagcttgtaaagt

SEQ ID NO: 14049 - DNA, 18 bp, Artificial Sequence
  Artificial sequence related to HLA knockouts in cell therapy
ctcacagcttgtaaagtg

SEQ ID NO: 14050 - DNA, 18 bp, Artificial Sequence
  Artificial sequence related to HLA knockouts in cell therapy
tcacagcttgtaaagtgt

SEQ ID NO: 14051 - DNA, 18 bp, Artificial Sequence
  Artificial sequence related to HLA knockouts in cell therapy
cacagcttgtaaagtgtg

SEQ ID NO: 14052 - DNA, 18 bp, Artificial Sequence
  Artificial sequence related to HLA knockouts in cell therapy
acagcttgtaaagtgtga

SEQ ID NO: 14053 - DNA, 18 bp, Artificial Sequence
  Artificial sequence related to HLA knockouts in cell therapy
cagcttgtaaagtgtgag

SEQ ID NO: 14054 - DNA, 18 bp, Artificial Sequence
  Artificial sequence related to HLA knockouts in cell therapy
agcttgtaaagtgtgaga

SEQ ID NO: 14055 - DNA, 18 bp, Artificial Sequence
  Artificial sequence related to HLA knockouts in cell therapy
gcttgtaaagtgtgagac

SEQ ID NO: 14056 - DNA, 18 bp, Artificial Sequence
  Artificial sequence related to HLA knockouts in cell therapy
cttgtaaagtgtgagaca

SEQ ID NO: 14057 - DNA, 18 bp, Artificial Sequence
  Artificial sequence related to HLA knockouts in cell therapy
ttgtaaagtgtgagacag

SEQ ID NO: 14058 - DNA, 18 bp, Artificial Sequence
  Artificial sequence related to HLA knockouts in cell therapy
tgtaaagtgtgagacagc

SEQ ID NO: 14059 - DNA, 18 bp, Artificial Sequence
  Artificial sequence related to HLA knockouts in cell therapy
gtaaagtgtgagacagct

SEQ ID NO: 14060 - DNA, 18 bp, Artificial Sequence
  Artificial sequence related to HLA knockouts in cell therapy
taaagtgtgagacagctg

SEQ ID NO: 14061 - DNA, 18 bp, Artificial Sequence
  Artificial sequence related to HLA knockouts in cell therapy
aaagtgtgagacagctgc

SEQ ID NO: 14062 - DNA, 18 bp, Artificial Sequence
  Artificial sequence related to HLA knockouts in cell therapy
aagtgtgagacagctgcc

SEQ ID NO: 14063 - DNA, 18 bp, Artificial Sequence
  Artificial sequence related to HLA knockouts in cell therapy
agtgtgagacagctgcct

SEQ ID NO: 14064 - DNA, 18 bp, Artificial Sequence
  Artificial sequence related to HLA knockouts in cell therapy
gtgtgagacagctgcctt

SEQ ID NO: 14065 - DNA, 18 bp, Artificial Sequence
  Artificial sequence related to HLA knockouts in cell therapy
tgtgagacagctgccttg

SEQ ID NO: 14066 - DNA, 18 bp, Artificial Sequence
  Artificial sequence related to HLA knockouts in cell therapy
gtgagacagctgccttgt

SEQ ID NO: 14067 - DNA, 18 bp, Artificial Sequence
  Artificial sequence related to HLA knockouts in cell therapy
tgagacagctgccttgtg

SEQ ID NO: 14068 - DNA, 18 bp, Artificial Sequence
  Artificial sequence related to HLA knockouts in cell therapy
gagacagctgccttgtgt

SEQ ID NO: 14069 - DNA, 18 bp, Artificial Sequence
  Artificial sequence related to HLA knockouts in cell therapy
agacagctgccttgtgtg

SEQ ID NO: 14070 - DNA, 18 bp, Artificial Sequence
  Artificial sequence related to HLA knockouts in cell therapy
tgccttgtgtgggactga

SEQ ID NO: 14071 - DNA, 18 bp, Artificial Sequence
  Artificial sequence related to HLA knockouts in cell therapy
ccttgtgtgggactgaga

SEQ ID NO: 14072 - DNA, 18 bp, Artificial Sequence
  Artificial sequence related to HLA knockouts in cell therapy
cttgtgtgggactgagag

SEQ ID NO: 14073 - DNA, 18 bp, Artificial Sequence
  Artificial sequence related to HLA knockouts in cell therapy
ttgtgtgggactgagagg

SEQ ID NO: 14074 - DNA, 18 bp, Artificial Sequence
  Artificial sequence related to HLA knockouts in cell therapy
tgtgggactgagaggcaa

SEQ ID NO: 14075 - DNA, 18 bp, Artificial Sequence
  Artificial sequence related to HLA knockouts in cell therapy
tgggactgagaggcaaga

SEQ ID NO: 14076 - DNA, 18 bp, Artificial Sequence
  Artificial sequence related to HLA knockouts in cell therapy
ggactgagaggcaagagt

SEQ ID NO: 14077 - DNA, 18 bp, Artificial Sequence
  Artificial sequence related to HLA knockouts in cell therapy
gactgagaggcaagagtt

SEQ ID NO: 14078 - DNA, 18 bp, Artificial Sequence
  Artificial sequence related to HLA knockouts in cell therapy
actgagaggcaagagttg

SEQ ID NO: 14079 - DNA, 18 bp, Artificial Sequence
  Artificial sequence related to HLA knockouts in cell therapy
ctgagaggcaagagttgt

SEQ ID NO: 14080 - DNA, 18 bp, Artificial Sequence
  Artificial sequence related to HLA knockouts in cell therapy
tgagaggcaagagttgtt

SEQ ID NO: 14081 - DNA, 18 bp, Artificial Sequence
  Artificial sequence related to HLA knockouts in cell therapy
gagaggcaagagttgttc

SEQ ID NO: 14082 - DNA, 18 bp, Artificial Sequence
  Artificial sequence related to HLA knockouts in cell therapy
agaggcaagagttgttcc

SEQ ID NO: 14083 - DNA, 18 bp, Artificial Sequence
  Artificial sequence related to HLA knockouts in cell therapy
gaggcaagagttgttcct

SEQ ID NO: 14084 - DNA, 18 bp, Artificial Sequence
  Artificial sequence related to HLA knockouts in cell therapy
aggcaagagttgttcctg

SEQ ID NO: 14085 - DNA, 18 bp, Artificial Sequence
  Artificial sequence related to HLA knockouts in cell therapy
ggcaagagttgttcctgc

SEQ ID NO: 14086 - DNA, 18 bp, Artificial Sequence
  Artificial sequence related to HLA knockouts in cell therapy
gcaagagttgttcctgcc

SEQ ID NO: 14087 - DNA, 18 bp, Artificial Sequence
  Artificial sequence related to HLA knockouts in cell therapy
caagagttgttcctgccc

SEQ ID NO: 14088 - DNA, 18 bp, Artificial Sequence
  Artificial sequence related to HLA knockouts in cell therapy
aagagttgttcctgccct

SEQ ID NO: 14089 - DNA, 18 bp, Artificial Sequence
  Artificial sequence related to HLA knockouts in cell therapy
agagttgttcctgccctt

SEQ ID NO: 14090 - DNA, 18 bp, Artificial Sequence
  Artificial sequence related to HLA knockouts in cell therapy
gagttgttcctgcccttc

SEQ ID NO: 14091 - DNA, 18 bp, Artificial Sequence
  Artificial sequence related to HLA knockouts in cell therapy
agttgttcctgcccttcc

SEQ ID NO: 14092 - DNA, 18 bp, Artificial Sequence
  Artificial sequence related to HLA knockouts in cell therapy
ttgttcctgcccttccct

SEQ ID NO: 14093 - DNA, 18 bp, Artificial Sequence
  Artificial sequence related to HLA knockouts in cell therapy
tgttcctgcccttccctt

SEQ ID NO: 14094 - DNA, 18 bp, Artificial Sequence
  Artificial sequence related to HLA knockouts in cell therapy
gttcctgcccttcccttt

SEQ ID NO: 14095 - DNA, 18 bp, Artificial Sequence
  Artificial sequence related to HLA knockouts in cell therapy
ttcctgcccttccctttg

SEQ ID NO: 14096 - DNA, 18 bp, Artificial Sequence
  Artificial sequence related to HLA knockouts in cell therapy
tcctgcccttccctttgt

SEQ ID NO: 14097 - DNA, 18 bp, Artificial Sequence
  Artificial sequence related to HLA knockouts in cell therapy
ctgcccttccctttgtga

SEQ ID NO: 14098 - DNA, 18 bp, Artificial Sequence
  Artificial sequence related to HLA knockouts in cell therapy
tgcccttccctttgtgac

SEQ ID NO: 14099 - DNA, 18 bp, Artificial Sequence
  Artificial sequence related to HLA knockouts in cell therapy
gcccttccctttgtgact

SEQ ID NO: 14100 - DNA, 18 bp, Artificial Sequence
  Artificial sequence related to HLA knockouts in cell therapy
cccttccctttgtgactt

SEQ ID NO: 14101 - DNA, 18 bp, Artificial Sequence
  Artificial sequence related to HLA knockouts in cell therapy
ccttccctttgtgacttg

SEQ ID NO: 14102 - DNA, 18 bp, Artificial Sequence
  Artificial sequence related to HLA knockouts in cell therapy
cttccctttgtgacttga

SEQ ID NO: 14103 - DNA, 18 bp, Artificial Sequence
  Artificial sequence related to HLA knockouts in cell therapy
ttccctttgtgacttgaa

SEQ ID NO: 14104 - DNA, 18 bp, Artificial Sequence
  Artificial sequence related to HLA knockouts in cell therapy
tccctttgtgacttgaag

SEQ ID NO: 14105 - DNA, 18 bp, Artificial Sequence
  Artificial sequence related to HLA knockouts in cell therapy
ccctttgtgacttgaaga

SEQ ID NO: 14106 - DNA, 18 bp, Artificial Sequence
  Artificial sequence related to HLA knockouts in cell therapy
cctttgtgacttgaagaa

SEQ ID NO: 14107 - DNA, 18 bp, Artificial Sequence
  Artificial sequence related to HLA knockouts in cell therapy
ctttgtgacttgaagaac

SEQ ID NO: 14108 - DNA, 18 bp, Artificial Sequence
  Artificial sequence related to HLA knockouts in cell therapy
tttgtgacttgaagaacc

SEQ ID NO: 14109 - DNA, 18 bp, Artificial Sequence
  Artificial sequence related to HLA knockouts in cell therapy
ttgtgacttgaagaaccc

SEQ ID NO: 14110 - DNA, 18 bp, Artificial Sequence
  Artificial sequence related to HLA knockouts in cell therapy
tgtgacttgaagaaccct

SEQ ID NO: 14111 - DNA, 18 bp, Artificial Sequence
  Artificial sequence related to HLA knockouts in cell therapy
gtgacttgaagaaccctg

SEQ ID NO: 14112 - DNA, 18 bp, Artificial Sequence
  Artificial sequence related to HLA knockouts in cell therapy
tgacttgaagaaccctga

SEQ ID NO: 14113 - DNA, 18 bp, Artificial Sequence
  Artificial sequence related to HLA knockouts in cell therapy
gacttgaagaaccctgac

SEQ ID NO: 14114 - DNA, 18 bp, Artificial Sequence
  Artificial sequence related to HLA knockouts in cell therapy
acttgaagaaccctgact

SEQ ID NO: 14115 - DNA, 18 bp, Artificial Sequence
  Artificial sequence related to HLA knockouts in cell therapy
cttgaagaaccctgactt

SEQ ID NO: 14116 - DNA, 18 bp, Artificial Sequence
  Artificial sequence related to HLA knockouts in cell therapy
ttgaagaaccctgacttt

SEQ ID NO: 14117 - DNA, 18 bp, Artificial Sequence
  Artificial sequence related to HLA knockouts in cell therapy
tgaagaaccctgactttg

SEQ ID NO: 14118 - DNA, 18 bp, Artificial Sequence
  Artificial sequence related to HLA knockouts in cell therapy
gaagaaccctgactttgt

SEQ ID NO: 14119 - DNA, 18 bp, Artificial Sequence
  Artificial sequence related to HLA knockouts in cell therapy
aagaaccctgactttgtt

SEQ ID NO: 14120 - DNA, 18 bp, Artificial Sequence
  Artificial sequence related to HLA knockouts in cell therapy
agaaccctgactttgttt

SEQ ID NO: 14121 - DNA, 18 bp, Artificial Sequence
  Artificial sequence related to HLA knockouts in cell therapy
gaaccctgactttgtttc

SEQ ID NO: 14122 - DNA, 18 bp, Artificial Sequence
  Artificial sequence related to HLA knockouts in cell therapy
aaccctgactttgtttct

SEQ ID NO: 14123 - DNA, 18 bp, Artificial Sequence
  Artificial sequence related to HLA knockouts in cell therapy
accctgactttgtttctg

SEQ ID NO: 14124 - DNA, 18 bp, Artificial Sequence
  Artificial sequence related to HLA knockouts in cell therapy
ccctgactttgtttctgc

SEQ ID NO: 14125 - DNA, 18 bp, Artificial Sequence
  Artificial sequence related to HLA knockouts in cell therapy
cctgactttgtttctgca

SEQ ID NO: 14126 - DNA, 18 bp, Artificial Sequence
  Artificial sequence related to HLA knockouts in cell therapy
ctgactttgtttctgcaa

SEQ ID NO: 14127 - DNA, 18 bp, Artificial Sequence
  Artificial sequence related to HLA knockouts in cell therapy
tgactttgtttctgcaaa

SEQ ID NO: 14128 - DNA, 18 bp, Artificial Sequence
  Artificial sequence related to HLA knockouts in cell therapy
gactttgtttctgcaaag

SEQ ID NO: 14129 - DNA, 18 bp, Artificial Sequence
  Artificial sequence related to HLA knockouts in cell therapy
actttgtttctgcaaagg

SEQ ID NO: 14130 - DNA, 18 bp, Artificial Sequence
  Artificial sequence related to HLA knockouts in cell therapy
ctttgtttctgcaaaggc

SEQ ID NO: 14131 - DNA, 18 bp, Artificial Sequence
  Artificial sequence related to HLA knockouts in cell therapy
tttgtttctgcaaaggca

SEQ ID NO: 14132 - DNA, 18 bp, Artificial Sequence
  Artificial sequence related to HLA knockouts in cell therapy
ttgtttctgcaaaggcac

SEQ ID NO: 14133 - DNA, 18 bp, Artificial Sequence
  Artificial sequence related to HLA knockouts in cell therapy
tgtttctgcaaaggcacc

SEQ ID NO: 14134 - DNA, 18 bp, Artificial Sequence
  Artificial sequence related to HLA knockouts in cell therapy
gtttctgcaaaggcacct

SEQ ID NO: 14135 - DNA, 18 bp, Artificial Sequence
  Artificial sequence related to HLA knockouts in cell therapy
tttctgcaaaggcacctg

SEQ ID NO: 14136 - DNA, 18 bp, Artificial Sequence
  Artificial sequence related to HLA knockouts in cell therapy
ttctgcaaaggcacctgc

SEQ ID NO: 14137 - DNA, 18 bp, Artificial Sequence
  Artificial sequence related to HLA knockouts in cell therapy
tctgcaaaggcacctgca

SEQ ID NO: 14138 - DNA, 18 bp, Artificial Sequence
  Artificial sequence related to HLA knockouts in cell therapy
ctgcaaaggcacctgcat

SEQ ID NO: 14139 - DNA, 18 bp, Artificial Sequence
  Artificial sequence related to HLA knockouts in cell therapy
tgcaaaggcacctgcatg

SEQ ID NO: 14140 - DNA, 18 bp, Artificial Sequence
  Artificial sequence related to HLA knockouts in cell therapy
gcaaaggcacctgcatgt

SEQ ID NO: 14141 - DNA, 18 bp, Artificial Sequence
  Artificial sequence related to HLA knockouts in cell therapy
caaaggcacctgcatgtg

SEQ ID NO: 14142 - DNA, 18 bp, Artificial Sequence
  Artificial sequence related to HLA knockouts in cell therapy
aaaggcacctgcatgtgt

SEQ ID NO: 14143 - DNA, 18 bp, Artificial Sequence
  Artificial sequence related to HLA knockouts in cell therapy
aaggcacctgcatgtgtc

SEQ ID NO: 14144 - DNA, 18 bp, Artificial Sequence
  Artificial sequence related to HLA knockouts in cell therapy
aggcacctgcatgtgtct

SEQ ID NO: 14145 - DNA, 18 bp, Artificial Sequence
  Artificial sequence related to HLA knockouts in cell therapy
gcacctgcatgtgtctgt

SEQ ID NO: 14146 - DNA, 18 bp, Artificial Sequence
  Artificial sequence related to HLA knockouts in cell therapy
cacctgcatgtgtctgtg

SEQ ID NO: 14147 - DNA, 18 bp, Artificial Sequence
  Artificial sequence related to HLA knockouts in cell therapy
acctgcatgtgtctgtgt

SEQ ID NO: 14148 - DNA, 18 bp, Artificial Sequence
  Artificial sequence related to HLA knockouts in cell therapy
cctgcatgtgtctgtgtt

SEQ ID NO: 14149 - DNA, 18 bp, Artificial Sequence
  Artificial sequence related to HLA knockouts in cell therapy
ctgcatgtgtctgtgttc

SEQ ID NO: 14150 - DNA, 18 bp, Artificial Sequence
  Artificial sequence related to HLA knockouts in cell therapy
tgcatgtgtctgtgttcg

SEQ ID NO: 14151 - DNA, 18 bp, Artificial Sequence
  Artificial sequence related to HLA knockouts in cell therapy
gcatgtgtctgtgttcgt

SEQ ID NO: 14152 - DNA, 18 bp, Artificial Sequence
  Artificial sequence related to HLA knockouts in cell therapy
catgtgtctgtgttcgtg

SEQ ID NO: 14153 - DNA, 18 bp, Artificial Sequence
  Artificial sequence related to HLA knockouts in cell therapy
atgtgtctgtgttcgtgt

SEQ ID NO: 14154 - DNA, 18 bp, Artificial Sequence
  Artificial sequence related to HLA knockouts in cell therapy
tgtgtctgtgttcgtgta

SEQ ID NO: 14155 - DNA, 18 bp, Artificial Sequence
  Artificial sequence related to HLA knockouts in cell therapy
gtgtctgtgttcgtgtag

SEQ ID NO: 14156 - DNA, 18 bp, Artificial Sequence
  Artificial sequence related to HLA knockouts in cell therapy
tgtctgtgttcgtgtagg

SEQ ID NO: 14157 - DNA, 18 bp, Artificial Sequence
  Artificial sequence related to HLA knockouts in cell therapy
gtctgtgttcgtgtaggc

SEQ ID NO: 14158 - DNA, 18 bp, Artificial Sequence
  Artificial sequence related to HLA knockouts in cell therapy
tctgtgttcgtgtaggca

SEQ ID NO: 14159 - DNA, 18 bp, Artificial Sequence
  Artificial sequence related to HLA knockouts in cell therapy
ctgtgttcgtgtaggcat

SEQ ID NO: 14160 - DNA, 18 bp, Artificial Sequence
  Artificial sequence related to HLA knockouts in cell therapy
tgtgttcgtgtaggcata

SEQ ID NO: 14161 - DNA, 18 bp, Artificial Sequence
  Artificial sequence related to HLA knockouts in cell therapy
gtgttcgtgtaggcataa

SEQ ID NO: 14162 - DNA, 18 bp, Artificial Sequence
  Artificial sequence related to HLA knockouts in cell therapy
tgttcgtgtaggcataat

SEQ ID NO: 14163 - DNA, 18 bp, Artificial Sequence
  Artificial sequence related to HLA knockouts in cell therapy
gttcgtgtaggcataatg

SEQ ID NO: 14164 - DNA, 18 bp, Artificial Sequence
  Artificial sequence related to HLA knockouts in cell therapy
ttcgtgtaggcataatgt

SEQ ID NO: 14165 - DNA, 18 bp, Artificial Sequence
  Artificial sequence related to HLA knockouts in cell therapy
tcgtgtaggcataatgtg

SEQ ID NO: 14166 - DNA, 18 bp, Artificial Sequence
  Artificial sequence related to HLA knockouts in cell therapy
cgtgtaggcataatgtga

SEQ ID NO: 14167 - DNA, 18 bp, Artificial Sequence
  Artificial sequence related to HLA knockouts in cell therapy
gtgtaggcataatgtgag

SEQ ID NO: 14168 - DNA, 18 bp, Artificial Sequence
  Artificial sequence related to HLA knockouts in cell therapy
tgtaggcataatgtgagg

SEQ ID NO: 14169 - DNA, 18 bp, Artificial Sequence
  Artificial sequence related to HLA knockouts in cell therapy
gtaggcataatgtgagga

SEQ ID NO: 14170 - DNA, 18 bp, Artificial Sequence
  Artificial sequence related to HLA knockouts in cell therapy
taggcataatgtgaggag

SEQ ID NO: 14171 - DNA, 18 bp, Artificial Sequence
  Artificial sequence related to HLA knockouts in cell therapy
aggcataatgtgaggagg

SEQ ID NO: 14172 - DNA, 18 bp, Artificial Sequence
  Artificial sequence related to HLA knockouts in cell therapy
ggcataatgtgaggaggt

SEQ ID NO: 14173 - DNA, 18 bp, Artificial Sequence
  Artificial sequence related to HLA knockouts in cell therapy
gcataatgtgaggaggtg

SEQ ID NO: 14174 - DNA, 18 bp, Artificial Sequence
  Artificial sequence related to HLA knockouts in cell therapy
cataatgtgaggaggtgg

SEQ ID NO: 14175 - DNA, 18 bp, Artificial Sequence
  Artificial sequence related to HLA knockouts in cell therapy
ataatgtgaggaggtggg

SEQ ID NO: 14176 - DNA, 18 bp, Artificial Sequence
  Artificial sequence related to HLA knockouts in cell therapy
catgtccaccatgaccct

SEQ ID NO: 14177 - DNA, 18 bp, Artificial Sequence
  Artificial sequence related to HLA knockouts in cell therapy
atgtccaccatgaccctc

SEQ ID NO: 14178 - DNA, 18 bp, Artificial Sequence
  Artificial sequence related to HLA knockouts in cell therapy
tgtccaccatgaccctct

SEQ ID NO: 14179 - DNA, 18 bp, Artificial Sequence
  Artificial sequence related to HLA knockouts in cell therapy
gtccaccatgaccctctt

SEQ ID NO: 14180 - DNA, 18 bp, Artificial Sequence
  Artificial sequence related to HLA knockouts in cell therapy
tccaccatgaccctcttc

SEQ ID NO: 14181 - DNA, 18 bp, Artificial Sequence
  Artificial sequence related to HLA knockouts in cell therapy
accatgaccctcttccca

SEQ ID NO: 14182 - DNA, 18 bp, Artificial Sequence
  Artificial sequence related to HLA knockouts in cell therapy
cccaatcatctttcctgt

SEQ ID NO: 14183 - DNA, 18 bp, Artificial Sequence
  Artificial sequence related to HLA knockouts in cell therapy
ccaatcatctttcctgtt

SEQ ID NO: 14184 - DNA, 18 bp, Artificial Sequence
  Artificial sequence related to HLA knockouts in cell therapy
caatcatctttcctgttc

SEQ ID NO: 14185 - DNA, 18 bp, Artificial Sequence
  Artificial sequence related to HLA knockouts in cell therapy
aatcatctttcctgttcc

SEQ ID NO: 14186 - DNA, 18 bp, Artificial Sequence
  Artificial sequence related to HLA knockouts in cell therapy
atcatctttcctgttcca

SEQ ID NO: 14187 - DNA, 18 bp, Artificial Sequence
  Artificial sequence related to HLA knockouts in cell therapy
tcatctttcctgttccag

SEQ ID NO: 14188 - DNA, 18 bp, Artificial Sequence
  Artificial sequence related to HLA knockouts in cell therapy
catctttcctgttccaga

SEQ ID NO: 14189 - DNA, 18 bp, Artificial Sequence
  Artificial sequence related to HLA knockouts in cell therapy
atctttcctgttccagag

SEQ ID NO: 14190 - DNA, 18 bp, Artificial Sequence
  Artificial sequence related to HLA knockouts in cell therapy
tctttcctgttccagaga

SEQ ID NO: 14191 - DNA, 18 bp, Artificial Sequence
  Artificial sequence related to HLA knockouts in cell therapy
ctttcctgttccagagag

SEQ ID NO: 14192 - DNA, 18 bp, Artificial Sequence
  Artificial sequence related to HLA knockouts in cell therapy
tttcctgttccagagagg

SEQ ID NO: 14193 - DNA, 18 bp, Artificial Sequence
  Artificial sequence related to HLA knockouts in cell therapy
ttcctgttccagagaggt

SEQ ID NO: 14194 - DNA, 18 bp, Artificial Sequence
  Artificial sequence related to HLA knockouts in cell therapy
tcctgttccagagaggtg

SEQ ID NO: 14195 - DNA, 18 bp, Artificial Sequence
  Artificial sequence related to HLA knockouts in cell therapy
gctgaggtgtctccatct

SEQ ID NO: 14196 - DNA, 18 bp, Artificial Sequence
  Artificial sequence related to HLA knockouts in cell therapy
ctgaggtgtctccatctc

SEQ ID NO: 14197 - DNA, 18 bp, Artificial Sequence
  Artificial sequence related to HLA knockouts in cell therapy
tgaggtgtctccatctct

SEQ ID NO: 14198 - DNA, 18 bp, Artificial Sequence
  Artificial sequence related to HLA knockouts in cell therapy
gaggtgtctccatctctg

SEQ ID NO: 14199 - DNA, 18 bp, Artificial Sequence
  Artificial sequence related to HLA knockouts in cell therapy
aggtgtctccatctctgt

SEQ ID NO: 14200 - DNA, 18 bp, Artificial Sequence
  Artificial sequence related to HLA knockouts in cell therapy
ggtgtctccatctctgtc

SEQ ID NO: 14201 - DNA, 18 bp, Artificial Sequence
  Artificial sequence related to HLA knockouts in cell therapy
gtgtctccatctctgtct

SEQ ID NO: 14202 - DNA, 18 bp, Artificial Sequence
  Artificial sequence related to HLA knockouts in cell therapy
tgtctccatctctgtctc

SEQ ID NO: 14203 - DNA, 18 bp, Artificial Sequence
  Artificial sequence related to HLA knockouts in cell therapy
gtctccatctctgtctca

SEQ ID NO: 14204 - DNA, 18 bp, Artificial Sequence
  Artificial sequence related to HLA knockouts in cell therapy
tctccatctctgtctcaa

SEQ ID NO: 14205 - DNA, 18 bp, Artificial Sequence
  Artificial sequence related to HLA knockouts in cell therapy
ctccatctctgtctcaac

SEQ ID NO: 14206 - DNA, 18 bp, Artificial Sequence
  Artificial sequence related to HLA knockouts in cell therapy
tccatctctgtctcaact

SEQ ID NO: 14207 - DNA, 18 bp, Artificial Sequence
  Artificial sequence related to HLA knockouts in cell therapy
ccatctctgtctcaactt

SEQ ID NO: 14208 - DNA, 18 bp, Artificial Sequence
  Artificial sequence related to HLA knockouts in cell therapy
catctctgtctcaacttc

SEQ ID NO: 14209 - DNA, 18 bp, Artificial Sequence
  Artificial sequence related to HLA knockouts in cell therapy
atctctgtctcaacttca

SEQ ID NO: 14210 - DNA, 18 bp, Artificial Sequence
  Artificial sequence related to HLA knockouts in cell therapy
tctctgtctcaacttcat

SEQ ID NO: 14211 - DNA, 18 bp, Artificial Sequence
  Artificial sequence related to HLA knockouts in cell therapy
ctctgtctcaacttcatg

SEQ ID NO: 14212 - DNA, 18 bp, Artificial Sequence
  Artificial sequence related to HLA knockouts in cell therapy
tctgtctcaacttcatgg

SEQ ID NO: 14213 - DNA, 18 bp, Artificial Sequence
  Artificial sequence related to HLA knockouts in cell therapy
ctgtctcaacttcatggt

SEQ ID NO: 14214 - DNA, 18 bp, Artificial Sequence
  Artificial sequence related to HLA knockouts in cell therapy
tgtctcaacttcatggtg

SEQ ID NO: 14215 - DNA, 18 bp, Artificial Sequence
  Artificial sequence related to HLA knockouts in cell therapy
gtctcaacttcatggtgc

SEQ ID NO: 14216 - DNA, 18 bp, Artificial Sequence
  Artificial sequence related to HLA knockouts in cell therapy
tctcaacttcatggtgca

SEQ ID NO: 14217 - DNA, 18 bp, Artificial Sequence
  Artificial sequence related to HLA knockouts in cell therapy
ctcaacttcatggtgcac

SEQ ID NO: 14218 - DNA, 18 bp, Artificial Sequence
  Artificial sequence related to HLA knockouts in cell therapy
tcaacttcatggtgcact

SEQ ID NO: 14219 - DNA, 18 bp, Artificial Sequence
  Artificial sequence related to HLA knockouts in cell therapy
caacttcatggtgcactg

SEQ ID NO: 14220 - DNA, 18 bp, Artificial Sequence
  Artificial sequence related to HLA knockouts in cell therapy
aacttcatggtgcactga

SEQ ID NO: 14221 - DNA, 18 bp, Artificial Sequence
  Artificial sequence related to HLA knockouts in cell therapy
acttcatggtgcactgag

SEQ ID NO: 14222 - DNA, 18 bp, Artificial Sequence
  Artificial sequence related to HLA knockouts in cell therapy
cttcatggtgcactgagc

SEQ ID NO: 14223 - DNA, 18 bp, Artificial Sequence
  Artificial sequence related to HLA knockouts in cell therapy
ttcatggtgcactgagct

SEQ ID NO: 14224 - DNA, 18 bp, Artificial Sequence
  Artificial sequence related to HLA knockouts in cell therapy
tcatggtgcactgagctg

SEQ ID NO: 14225 - DNA, 18 bp, Artificial Sequence
  Artificial sequence related to HLA knockouts in cell therapy
catggtgcactgagctgt

SEQ ID NO: 14226 - DNA, 18 bp, Artificial Sequence
  Artificial sequence related to HLA knockouts in cell therapy
atggtgcactgagctgta

SEQ ID NO: 14227 - DNA, 18 bp, Artificial Sequence
  Artificial sequence related to HLA knockouts in cell therapy
tggtgcactgagctgtaa

SEQ ID NO: 14228 - DNA, 18 bp, Artificial Sequence
  Artificial sequence related to HLA knockouts in cell therapy
ggtgcactgagctgtaac

SEQ ID NO: 14229 - DNA, 18 bp, Artificial Sequence
  Artificial sequence related to HLA knockouts in cell therapy
gtgcactgagctgtaact

SEQ ID NO: 14230 - DNA, 18 bp, Artificial Sequence
  Artificial sequence related to HLA knockouts in cell therapy
tgcactgagctgtaactt

SEQ ID NO: 14231 - DNA, 18 bp, Artificial Sequence
  Artificial sequence related to HLA knockouts in cell therapy
gcactgagctgtaacttc

SEQ ID NO: 14232 - DNA, 18 bp, Artificial Sequence
  Artificial sequence related to HLA knockouts in cell therapy
cactgagctgtaacttct

SEQ ID NO: 14233 - DNA, 18 bp, Artificial Sequence
  Artificial sequence related to HLA knockouts in cell therapy
actgagctgtaacttctt

SEQ ID NO: 14234 - DNA, 18 bp, Artificial Sequence
  Artificial sequence related to HLA knockouts in cell therapy
ctgagctgtaacttcttc

SEQ ID NO: 14235 - DNA, 18 bp, Artificial Sequence
  Artificial sequence related to HLA knockouts in cell therapy
tgagctgtaacttcttcc

SEQ ID NO: 14236 - DNA, 18 bp, Artificial Sequence
  Artificial sequence related to HLA knockouts in cell therapy
gagctgtaacttcttcct

SEQ ID NO: 14237 - DNA, 18 bp, Artificial Sequence
  Artificial sequence related to HLA knockouts in cell therapy
agctgtaacttcttcctt

SEQ ID NO: 14238 - DNA, 18 bp, Artificial Sequence
  Artificial sequence related to HLA knockouts in cell therapy
gctgtaacttcttccttc

SEQ ID NO: 14239 - DNA, 18 bp, Artificial Sequence
  Artificial sequence related to HLA knockouts in cell therapy
ctgtaacttcttccttcc

SEQ ID NO: 14240 - DNA, 18 bp, Artificial Sequence
  Artificial sequence related to HLA knockouts in cell therapy
tgtaacttcttccttccc

SEQ ID NO: 14241 - DNA, 18 bp, Artificial Sequence
  Artificial sequence related to HLA knockouts in cell therapy
gtaacttcttccttccct

SEQ ID NO: 14242 - DNA, 18 bp, Artificial Sequence
  Artificial sequence related to HLA knockouts in cell therapy
taacttcttccttcccta

SEQ ID NO: 14243 - DNA, 18 bp, Artificial Sequence
  Artificial sequence related to HLA knockouts in cell therapy
aacttcttccttccctat

SEQ ID NO: 14244 - DNA, 18 bp, Artificial Sequence
  Artificial sequence related to HLA knockouts in cell therapy
acttcttccttccctatt

SEQ ID NO: 14245 - DNA, 18 bp, Artificial Sequence
  Artificial sequence related to HLA knockouts in cell therapy
cttcttccttccctatta

SEQ ID NO: 14246 - DNA, 18 bp, Artificial Sequence
  Artificial sequence related to HLA knockouts in cell therapy
ttcttccttccctattaa

SEQ ID NO: 14247 - DNA, 18 bp, Artificial Sequence
  Artificial sequence related to HLA knockouts in cell therapy
tcttccttccctattaaa

SEQ ID NO: 14248 - DNA, 19 bp, Artificial Sequence
  Artificial sequence related to HLA knockouts in cell therapy
ccgaaggcggtgtatggat

SEQ ID NO: 14249 - DNA, 19 bp, Artificial Sequence
  Artificial sequence related to HLA knockouts in cell therapy
cgaaggcggtgtatggatt

SEQ ID NO: 14250 - DNA, 19 bp, Artificial Sequence
  Artificial sequence related to HLA knockouts in cell therapy
gaaggcggtgtatggattg

SEQ ID NO: 14251 - DNA, 19 bp, Artificial Sequence
  Artificial sequence related to HLA knockouts in cell therapy
aaggcggtgtatggattgg

SEQ ID NO: 14252 - DNA, 19 bp, Artificial Sequence
  Artificial sequence related to HLA knockouts in cell therapy
aggcggtgtatggattggg

SEQ ID NO: 14253 - DNA, 19 bp, Artificial Sequence
  Artificial sequence related to HLA knockouts in cell therapy
cccaactccgcagtttctt

SEQ ID NO: 14254 - DNA, 19 bp, Artificial Sequence
  Artificial sequence related to HLA knockouts in cell therapy
ccaactccgcagtttcttt

SEQ ID NO: 14255 - DNA, 19 bp, Artificial Sequence
  Artificial sequence related to HLA knockouts in cell therapy
tttctccctctcccaacct

SEQ ID NO: 14256 - DNA, 19 bp, Artificial Sequence
  Artificial sequence related to HLA knockouts in cell therapy
ttctccctctcccaaccta

SEQ ID NO: 14257 - DNA, 19 bp, Artificial Sequence
  Artificial sequence related to HLA knockouts in cell therapy
tctccctctcccaacctat

SEQ ID NO: 14258 - DNA, 19 bp, Artificial Sequence
  Artificial sequence related to HLA knockouts in cell therapy
ctccctctcccaacctatg

SEQ ID NO: 14259 - DNA, 19 bp, Artificial Sequence
  Artificial sequence related to HLA knockouts in cell therapy
tccctctcccaacctatgt

SEQ ID NO: 14260 - DNA, 19 bp, Artificial Sequence
  Artificial sequence related to HLA knockouts in cell therapy
ccctctcccaacctatgta

SEQ ID NO: 14261 - DNA, 19 bp, Artificial Sequence
  Artificial sequence related to HLA knockouts in cell therapy
cctctcccaacctatgtag

SEQ ID NO: 14262 - DNA, 19 bp, Artificial Sequence
  Artificial sequence related to HLA knockouts in cell therapy
ctctcccaacctatgtagg

SEQ ID NO: 14263 - DNA, 19 bp, Artificial Sequence
  Artificial sequence related to HLA knockouts in cell therapy
tctcccaacctatgtaggg

SEQ ID NO: 14264 - DNA, 19 bp, Artificial Sequence
  Artificial sequence related to HLA knockouts in cell therapy
ctcccaacctatgtagggt

SEQ ID NO: 14265 - DNA, 19 bp, Artificial Sequence
  Artificial sequence related to HLA knockouts in cell therapy
tcccaacctatgtagggtc

SEQ ID NO: 14266 - DNA, 19 bp, Artificial Sequence
  Artificial sequence related to HLA knockouts in cell therapy
cccaacctatgtagggtcc

SEQ ID NO: 14267 - DNA, 19 bp, Artificial Sequence
  Artificial sequence related to HLA knockouts in cell therapy
ccaacctatgtagggtcct

SEQ ID NO: 14268 - DNA, 19 bp, Artificial Sequence
  Artificial sequence related to HLA knockouts in cell therapy
caacctatgtagggtcctt

SEQ ID NO: 14269 - DNA, 19 bp, Artificial Sequence
  Artificial sequence related to HLA knockouts in cell therapy
aacctatgtagggtccttc

SEQ ID NO: 14270 - DNA, 19 bp, Artificial Sequence
  Artificial sequence related to HLA knockouts in cell therapy
acctatgtagggtccttct

SEQ ID NO: 14271 - DNA, 19 bp, Artificial Sequence
  Artificial sequence related to HLA knockouts in cell therapy
cctatgtagggtccttctt

SEQ ID NO: 14272 - DNA, 19 bp, Artificial Sequence
  Artificial sequence related to HLA knockouts in cell therapy
ctatgtagggtccttcttc

SEQ ID NO: 14273 - DNA, 19 bp, Artificial Sequence
  Artificial sequence related to HLA knockouts in cell therapy
tatgtagggtccttcttcc

SEQ ID NO: 14274 - DNA, 19 bp, Artificial Sequence
  Artificial sequence related to HLA knockouts in cell therapy
atgtagggtccttcttcct

SEQ ID NO: 14275 - DNA, 19 bp, Artificial Sequence
  Artificial sequence related to HLA knockouts in cell therapy
tgtagggtccttcttcctg

SEQ ID NO: 14276 - DNA, 19 bp, Artificial Sequence
  Artificial sequence related to HLA knockouts in cell therapy
gtagggtccttcttcctgg

SEQ ID NO: 14277 - DNA, 19 bp, Artificial Sequence
  Artificial sequence related to HLA knockouts in cell therapy
tagggtccttcttcctgga

SEQ ID NO: 14278 - DNA, 19 bp, Artificial Sequence
  Artificial sequence related to HLA knockouts in cell therapy
agggtccttcttcctggat

SEQ ID NO: 14279 - DNA, 19 bp, Artificial Sequence
  Artificial sequence related to HLA knockouts in cell therapy
gggtccttcttcctggata

SEQ ID NO: 14280 - DNA, 19 bp, Artificial Sequence
  Artificial sequence related to HLA knockouts in cell therapy
ggtccttcttcctggatac

SEQ ID NO: 14281 - DNA, 19 bp, Artificial Sequence
  Artificial sequence related to HLA knockouts in cell therapy
gtccttcttcctggatact

SEQ ID NO: 14282 - DNA, 19 bp, Artificial Sequence
  Artificial sequence related to HLA knockouts in cell therapy
tccttcttcctggatactc

SEQ ID NO: 14283 - DNA, 19 bp, Artificial Sequence
  Artificial sequence related to HLA knockouts in cell therapy
ccttcttcctggatactca

SEQ ID NO: 14284 - DNA, 19 bp, Artificial Sequence
  Artificial sequence related to HLA knockouts in cell therapy
cttcttcctggatactcac

SEQ ID NO: 14285 - DNA, 19 bp, Artificial Sequence
  Artificial sequence related to HLA knockouts in cell therapy
ttcttcctggatactcacg

SEQ ID NO: 14286 - DNA, 19 bp, Artificial Sequence
  Artificial sequence related to HLA knockouts in cell therapy
tcttcctggatactcacga

SEQ ID NO: 14287 - DNA, 19 bp, Artificial Sequence
  Artificial sequence related to HLA knockouts in cell therapy
cttcctggatactcacgac

SEQ ID NO: 14288 - DNA, 19 bp, Artificial Sequence
  Artificial sequence related to HLA knockouts in cell therapy
ttcctggatactcacgacg

SEQ ID NO: 14289 - DNA, 19 bp, Artificial Sequence
  Artificial sequence related to HLA knockouts in cell therapy
tcctggatactcacgacgc

SEQ ID NO: 14290 - DNA, 19 bp, Artificial Sequence
  Artificial sequence related to HLA knockouts in cell therapy
tggatactcacgacgcgga

SEQ ID NO: 14291 - DNA, 19 bp, Artificial Sequence
  Artificial sequence related to HLA knockouts in cell therapy
gacccagttctcactccca

SEQ ID NO: 14292 - DNA, 19 bp, Artificial Sequence
  Artificial sequence related to HLA knockouts in cell therapy
acccagttctcactcccat

SEQ ID NO: 14293 - DNA, 19 bp, Artificial Sequence
  Artificial sequence related to HLA knockouts in cell therapy
cccagttctcactcccatt

SEQ ID NO: 14294 - DNA, 19 bp, Artificial Sequence
  Artificial sequence related to HLA knockouts in cell therapy
ccagttctcactcccattg

SEQ ID NO: 14295 - DNA, 19 bp, Artificial Sequence
  Artificial sequence related to HLA knockouts in cell therapy
cagttctcactcccattgg

SEQ ID NO: 14296 - DNA, 19 bp, Artificial Sequence
  Artificial sequence related to HLA knockouts in cell therapy
agttctcactcccattggg

SEQ ID NO: 14297 - DNA, 19 bp, Artificial Sequence
  Artificial sequence related to HLA knockouts in cell therapy
gttctcactcccattgggt

SEQ ID NO: 14298 - DNA, 19 bp, Artificial Sequence
  Artificial sequence related to HLA knockouts in cell therapy
ttctcactcccattgggtg

SEQ ID NO: 14299 - DNA, 19 bp, Artificial Sequence
  Artificial sequence related to HLA knockouts in cell therapy
tctcactcccattgggtgt

SEQ ID NO: 14300 - DNA, 19 bp, Artificial Sequence
  Artificial sequence related to HLA knockouts in cell therapy
ctcactcccattgggtgtc

SEQ ID NO: 14301 - DNA, 19 bp, Artificial Sequence
  Artificial sequence related to HLA knockouts in cell therapy
tcactcccattgggtgtcg

SEQ ID NO: 14302 - DNA, 19 bp, Artificial Sequence
  Artificial sequence related to HLA knockouts in cell therapy
tcccattgggtgtcgggtt

SEQ ID NO: 14303 - DNA, 19 bp, Artificial Sequence
  Artificial sequence related to HLA knockouts in cell therapy
cccattgggtgtcgggttt

SEQ ID NO: 14304 - DNA, 19 bp, Artificial Sequence
  Artificial sequence related to HLA knockouts in cell therapy
ccattgggtgtcgggtttc

SEQ ID NO: 14305 - DNA, 19 bp, Artificial Sequence
  Artificial sequence related to HLA knockouts in cell therapy
cattgggtgtcgggtttcc

SEQ ID NO: 14306 - DNA, 19 bp, Artificial Sequence
  Artificial sequence related to HLA knockouts in cell therapy
attgggtgtcgggtttcca

SEQ ID NO: 14307 - DNA, 19 bp, Artificial Sequence
  Artificial sequence related to HLA knockouts in cell therapy
ttgggtgtcgggtttccag

SEQ ID NO: 14308 - DNA, 19 bp, Artificial Sequence
  Artificial sequence related to HLA knockouts in cell therapy
tgggtgtcgggtttccaga

SEQ ID NO: 14309 - DNA, 19 bp, Artificial Sequence
  Artificial sequence related to HLA knockouts in cell therapy
ggtgtcgggtttccagaga

SEQ ID NO: 14310 - DNA, 19 bp, Artificial Sequence
  Artificial sequence related to HLA knockouts in cell therapy
gtgtcgggtttccagagaa

SEQ ID NO: 14311 - DNA, 19 bp, Artificial Sequence
  Artificial sequence related to HLA knockouts in cell therapy
tgtcgggtttccagagaag

SEQ ID NO: 14312 - DNA, 19 bp, Artificial Sequence
  Artificial sequence related to HLA knockouts in cell therapy
gtcgggtttccagagaagc

SEQ ID NO: 14313 - DNA, 19 bp, Artificial Sequence
  Artificial sequence related to HLA knockouts in cell therapy
tcgggtttccagagaagcc

SEQ ID NO: 14314 - DNA, 19 bp, Artificial Sequence
  Artificial sequence related to HLA knockouts in cell therapy
cgggtttccagagaagcca

SEQ ID NO: 14315 - DNA, 19 bp, Artificial Sequence
  Artificial sequence related to HLA knockouts in cell therapy
gggtttccagagaagccaa

SEQ ID NO: 14316 - DNA, 19 bp, Artificial Sequence
  Artificial sequence related to HLA knockouts in cell therapy
ggtttccagagaagccaat

SEQ ID NO: 14317 - DNA, 19 bp, Artificial Sequence
  Artificial sequence related to HLA knockouts in cell therapy
gtttccagagaagccaatc

SEQ ID NO: 14318 - DNA, 19 bp, Artificial Sequence
  Artificial sequence related to HLA knockouts in cell therapy
tttccagagaagccaatca

SEQ ID NO: 14319 - DNA, 19 bp, Artificial Sequence
  Artificial sequence related to HLA knockouts in cell therapy
ttccagagaagccaatcag

SEQ ID NO: 14320 - DNA, 19 bp, Artificial Sequence
  Artificial sequence related to HLA knockouts in cell therapy
tccagagaagccaatcagt

SEQ ID NO: 14321 - DNA, 19 bp, Artificial Sequence
  Artificial sequence related to HLA knockouts in cell therapy
ccagagaagccaatcagtg

SEQ ID NO: 14322 - DNA, 19 bp, Artificial Sequence
  Artificial sequence related to HLA knockouts in cell therapy
cagagaagccaatcagtgt

SEQ ID NO: 14323 - DNA, 19 bp, Artificial Sequence
  Artificial sequence related to HLA knockouts in cell therapy
agagaagccaatcagtgtc

SEQ ID NO: 14324 - DNA, 19 bp, Artificial Sequence
  Artificial sequence related to HLA knockouts in cell therapy
gagaagccaatcagtgtcg

SEQ ID NO: 14325 - DNA, 19 bp, Artificial Sequence
  Artificial sequence related to HLA knockouts in cell therapy
agaagccaatcagtgtcgt

SEQ ID NO: 14326 - DNA, 19 bp, Artificial Sequence
  Artificial sequence related to HLA knockouts in cell therapy
gaagccaatcagtgtcgtc

SEQ ID NO: 14327 - DNA, 19 bp, Artificial Sequence
  Artificial sequence related to HLA knockouts in cell therapy
aagccaatcagtgtcgtcg

SEQ ID NO: 14328 - DNA, 19 bp, Artificial Sequence
  Artificial sequence related to HLA knockouts in cell therapy
agccaatcagtgtcgtcgc

SEQ ID NO: 14329 - DNA, 19 bp, Artificial Sequence
  Artificial sequence related to HLA knockouts in cell therapy
caatcagtgtcgtcgcggt

SEQ ID NO: 14330 - DNA, 19 bp, Artificial Sequence
  Artificial sequence related to HLA knockouts in cell therapy
aatcagtgtcgtcgcggtc

SEQ ID NO: 14331 - DNA, 19 bp, Artificial Sequence
  Artificial sequence related to HLA knockouts in cell therapy
tcgcggtcgcggttctaaa

SEQ ID NO: 14332 - DNA, 19 bp, Artificial Sequence
  Artificial sequence related to HLA knockouts in cell therapy
gcggtcgcggttctaaagt

SEQ ID NO: 14333 - DNA, 19 bp, Artificial Sequence
  Artificial sequence related to HLA knockouts in cell therapy
cggtcgcggttctaaagtc

SEQ ID NO: 14334 - DNA, 19 bp, Artificial Sequence
  Artificial sequence related to HLA knockouts in cell therapy
ggtcgcggttctaaagtcc

SEQ ID NO: 14335 - DNA, 19 bp, Artificial Sequence
  Artificial sequence related to HLA knockouts in cell therapy
gtcgcggttctaaagtccg

SEQ ID NO: 14336 - DNA, 19 bp, Artificial Sequence
  Artificial sequence related to HLA knockouts in cell therapy
tcgcggttctaaagtccgc

SEQ ID NO: 14337 - DNA, 19 bp, Artificial Sequence
  Artificial sequence related to HLA knockouts in cell therapy
cgcggttctaaagtccgca

SEQ ID NO: 14338 - DNA, 19 bp, Artificial Sequence
  Artificial sequence related to HLA knockouts in cell therapy
gcggttctaaagtccgcac

SEQ ID NO: 14339 - DNA, 19 bp, Artificial Sequence
  Artificial sequence related to HLA knockouts in cell therapy
cggttctaaagtccgcacg

SEQ ID NO: 14340 - DNA, 19 bp, Artificial Sequence
  Artificial sequence related to HLA knockouts in cell therapy
ggttctaaagtccgcacgc

SEQ ID NO: 14341 - DNA, 19 bp, Artificial Sequence
  Artificial sequence related to HLA knockouts in cell therapy
gttctaaagtccgcacgca

SEQ ID NO: 14342 - DNA, 19 bp, Artificial Sequence
  Artificial sequence related to HLA knockouts in cell therapy
ttctaaagtccgcacgcac

SEQ ID NO: 14343 - DNA, 19 bp, Artificial Sequence
  Artificial sequence related to HLA knockouts in cell therapy
tctaaagtccgcacgcacc

SEQ ID NO: 14344 - DNA, 19 bp, Artificial Sequence
  Artificial sequence related to HLA knockouts in cell therapy
taaagtccgcacgcaccca

SEQ ID NO: 14345 - DNA, 19 bp, Artificial Sequence
  Artificial sequence related to HLA knockouts in cell therapy
acccaccgggactcagatt

SEQ ID NO: 14346 - DNA, 19 bp, Artificial Sequence
  Artificial sequence related to HLA knockouts in cell therapy
ccaccgggactcagattct

SEQ ID NO: 14347 - DNA, 19 bp, Artificial Sequence
  Artificial sequence related to HLA knockouts in cell therapy
caccgggactcagattctc

SEQ ID NO: 14348 - DNA, 19 bp, Artificial Sequence
  Artificial sequence related to HLA knockouts in cell therapy
accgggactcagattctcc

SEQ ID NO: 14349 - DNA, 19 bp, Artificial Sequence
  Artificial sequence related to HLA knockouts in cell therapy
gaaccctcgtcctgctact

SEQ ID NO: 14350 - DNA, 19 bp, Artificial Sequence
  Artificial sequence related to HLA knockouts in cell therapy
aaccctcgtcctgctactc

SEQ ID NO: 14351 - DNA, 19 bp, Artificial Sequence
  Artificial sequence related to HLA knockouts in cell therapy
accctcgtcctgctactct

SEQ ID NO: 14352 - DNA, 19 bp, Artificial Sequence
  Artificial sequence related to HLA knockouts in cell therapy
ggctctcactccatgaggt

SEQ ID NO: 14353 - DNA, 19 bp, Artificial Sequence
  Artificial sequence related to HLA knockouts in cell therapy
gctctcactccatgaggta

SEQ ID NO: 14354 - DNA, 19 bp, Artificial Sequence
  Artificial sequence related to HLA knockouts in cell therapy
ctctcactccatgaggtat

SEQ ID NO: 14355 - DNA, 19 bp, Artificial Sequence
  Artificial sequence related to HLA knockouts in cell therapy
tctcactccatgaggtatt

SEQ ID NO: 14356 - DNA, 19 bp, Artificial Sequence
  Artificial sequence related to HLA knockouts in cell therapy
ctcactccatgaggtattt

SEQ ID NO: 14357 - DNA, 19 bp, Artificial Sequence
  Artificial sequence related to HLA knockouts in cell therapy
tcactccatgaggtatttc

SEQ ID NO: 14358 - DNA, 19 bp, Artificial Sequence
  Artificial sequence related to HLA knockouts in cell therapy
cactccatgaggtatttct

SEQ ID NO: 14359 - DNA, 19 bp, Artificial Sequence
  Artificial sequence related to HLA knockouts in cell therapy
actccatgaggtatttctt

SEQ ID NO: 14360 - DNA, 19 bp, Artificial Sequence
  Artificial sequence related to HLA knockouts in cell therapy
ctccatgaggtatttcttc

SEQ ID NO: 14361 - DNA, 19 bp, Artificial Sequence
  Artificial sequence related to HLA knockouts in cell therapy
tccatgaggtatttcttca

SEQ ID NO: 14362 - DNA, 19 bp, Artificial Sequence
  Artificial sequence related to HLA knockouts in cell therapy
ccatgaggtatttcttcac

SEQ ID NO: 14363 - DNA, 19 bp, Artificial Sequence
  Artificial sequence related to HLA knockouts in cell therapy
catgaggtatttcttcaca

SEQ ID NO: 14364 - DNA, 19 bp, Artificial Sequence
  Artificial sequence related to HLA knockouts in cell therapy
atgaggtatttcttcacat

SEQ ID NO: 14365 - DNA, 19 bp, Artificial Sequence
  Artificial sequence related to HLA knockouts in cell therapy
tgaggtatttcttcacatc

SEQ ID NO: 14366 - DNA, 19 bp, Artificial Sequence
  Artificial sequence related to HLA knockouts in cell therapy
gaggtatttcttcacatcc

SEQ ID NO: 14367 - DNA, 19 bp, Artificial Sequence
  Artificial sequence related to HLA knockouts in cell therapy
aggtatttcttcacatccg

SEQ ID NO: 14368 - DNA, 19 bp, Artificial Sequence
  Artificial sequence related to HLA knockouts in cell therapy
ggtatttcttcacatccgt

SEQ ID NO: 14369 - DNA, 19 bp, Artificial Sequence
  Artificial sequence related to HLA knockouts in cell therapy
gtatttcttcacatccgtg

SEQ ID NO: 14370 - DNA, 19 bp, Artificial Sequence
  Artificial sequence related to HLA knockouts in cell therapy
tatttcttcacatccgtgt

SEQ ID NO: 14371 - DNA, 19 bp, Artificial Sequence
  Artificial sequence related to HLA knockouts in cell therapy
atttcttcacatccgtgtc

SEQ ID NO: 14372 - DNA, 19 bp, Artificial Sequence
  Artificial sequence related to HLA knockouts in cell therapy
tttcttcacatccgtgtcc

SEQ ID NO: 14373 - DNA, 19 bp, Artificial Sequence
  Artificial sequence related to HLA knockouts in cell therapy
ttcttcacatccgtgtccc

SEQ ID NO: 14374 - DNA, 19 bp, Artificial Sequence
  Artificial sequence related to HLA knockouts in cell therapy
tcttcacatccgtgtcccg

SEQ ID NO: 14375 - DNA, 19 bp, Artificial Sequence
  Artificial sequence related to HLA knockouts in cell therapy
gcttcatcgcagtgggcta

SEQ ID NO: 14376 - DNA, 19 bp, Artificial Sequence
  Artificial sequence related to HLA knockouts in cell therapy
cttcatcgcagtgggctac

SEQ ID NO: 14377 - DNA, 19 bp, Artificial Sequence
  Artificial sequence related to HLA knockouts in cell therapy
ttcatcgcagtgggctacg

SEQ ID NO: 14378 - DNA, 19 bp, Artificial Sequence
  Artificial sequence related to HLA knockouts in cell therapy
tcatcgcagtgggctacgt

SEQ ID NO: 14379 - DNA, 19 bp, Artificial Sequence
  Artificial sequence related to HLA knockouts in cell therapy
tacgtggacgacacgcagt

SEQ ID NO: 14380 - DNA, 19 bp, Artificial Sequence
  Artificial sequence related to HLA knockouts in cell therapy
acgtggacgacacgcagtt

SEQ ID NO: 14381 - DNA, 19 bp, Artificial Sequence
  Artificial sequence related to HLA knockouts in cell therapy
tggacgacacgcagttcgt

SEQ ID NO: 14382 - DNA, 19 bp, Artificial Sequence
  Artificial sequence related to HLA knockouts in cell therapy
acacgcagttcgtgcggtt

SEQ ID NO: 14383 - DNA, 19 bp, Artificial Sequence
  Artificial sequence related to HLA knockouts in cell therapy
cagttcgtgcggttcgaca

SEQ ID NO: 14384 - DNA, 19 bp, Artificial Sequence
  Artificial sequence related to HLA knockouts in cell therapy
agttcgtgcggttcgacag

SEQ ID NO: 14385 - DNA, 19 bp, Artificial Sequence
  Artificial sequence related to HLA knockouts in cell therapy
gtggatagagcaggagggt

SEQ ID NO: 14386 - DNA, 19 bp, Artificial Sequence
  Artificial sequence related to HLA knockouts in cell therapy
tggatagagcaggagggtc

SEQ ID NO: 14387 - DNA, 19 bp, Artificial Sequence
  Artificial sequence related to HLA knockouts in cell therapy
caggagggtccggagtatt

SEQ ID NO: 14388 - DNA, 19 bp, Artificial Sequence
  Artificial sequence related to HLA knockouts in cell therapy
aggagggtccggagtattg

SEQ ID NO: 14389 - DNA, 19 bp, Artificial Sequence
  Artificial sequence related to HLA knockouts in cell therapy
agggtccggagtattggga

SEQ ID NO: 14390 - DNA, 19 bp, Artificial Sequence
  Artificial sequence related to HLA knockouts in cell therapy
ggagacacggaaagtgaag

SEQ ID NO: 14391 - DNA, 19 bp, Artificial Sequence
  Artificial sequence related to HLA knockouts in cell therapy
gagacacggaaagtgaagg

SEQ ID NO: 14392 - DNA, 19 bp, Artificial Sequence
  Artificial sequence related to HLA knockouts in cell therapy
agacacggaaagtgaaggc

SEQ ID NO: 14393 - DNA, 19 bp, Artificial Sequence
  Artificial sequence related to HLA knockouts in cell therapy
gacacggaaagtgaaggcc

SEQ ID NO: 14394 - DNA, 19 bp, Artificial Sequence
  Artificial sequence related to HLA knockouts in cell therapy
acacggaaagtgaaggccc

SEQ ID NO: 14395 - DNA, 19 bp, Artificial Sequence
  Artificial sequence related to HLA knockouts in cell therapy
cacggaaagtgaaggccca

SEQ ID NO: 14396 - DNA, 19 bp, Artificial Sequence
  Artificial sequence related to HLA knockouts in cell therapy
acggaaagtgaaggcccac

SEQ ID NO: 14397 - DNA, 19 bp, Artificial Sequence
  Artificial sequence related to HLA knockouts in cell therapy
cggaaagtgaaggcccact

SEQ ID NO: 14398 - DNA, 19 bp, Artificial Sequence
  Artificial sequence related to HLA knockouts in cell therapy
ggaaagtgaaggcccactc

SEQ ID NO: 14399 - DNA, 19 bp, Artificial Sequence
  Artificial sequence related to HLA knockouts in cell therapy
aaagtgaaggcccactcac

SEQ ID NO: 14400 - DNA, 19 bp, Artificial Sequence
  Artificial sequence related to HLA knockouts in cell therapy
aagtgaaggcccactcaca

SEQ ID NO: 14401 - DNA, 19 bp, Artificial Sequence
  Artificial sequence related to HLA knockouts in cell therapy
agtgaaggcccactcacag

SEQ ID NO: 14402 - DNA, 19 bp, Artificial Sequence
  Artificial sequence related to HLA knockouts in cell therapy
gtgaaggcccactcacaga

SEQ ID NO: 14403 - DNA, 19 bp, Artificial Sequence
  Artificial sequence related to HLA knockouts in cell therapy
tgaaggcccactcacagac

SEQ ID NO: 14404 - DNA, 19 bp, Artificial Sequence
  Artificial sequence related to HLA knockouts in cell therapy
gaaggcccactcacagact

SEQ ID NO: 14405 - DNA, 19 bp, Artificial Sequence
  Artificial sequence related to HLA knockouts in cell therapy
aaggcccactcacagactc

SEQ ID NO: 14406 - DNA, 19 bp, Artificial Sequence
  Artificial sequence related to HLA knockouts in cell therapy
aggcccactcacagactca

SEQ ID NO: 14407 - DNA, 19 bp, Artificial Sequence
  Artificial sequence related to HLA knockouts in cell therapy
ccactcacagactcaccga

SEQ ID NO: 14408 - DNA, 19 bp, Artificial Sequence
  Artificial sequence related to HLA knockouts in cell therapy
cactcacagactcaccgag

SEQ ID NO: 14409 - DNA, 19 bp, Artificial Sequence
  Artificial sequence related to HLA knockouts in cell therapy
actcacagactcaccgagt

SEQ ID NO: 14410 - DNA, 19 bp, Artificial Sequence
  Artificial sequence related to HLA knockouts in cell therapy
ctcacagactcaccgagtg

SEQ ID NO: 14411 - DNA, 19 bp, Artificial Sequence
  Artificial sequence related to HLA knockouts in cell therapy
tcacagactcaccgagtgg

SEQ ID NO: 14412 - DNA, 19 bp, Artificial Sequence
  Artificial sequence related to HLA knockouts in cell therapy
cacagactcaccgagtgga

SEQ ID NO: 14413 - DNA, 19 bp, Artificial Sequence
  Artificial sequence related to HLA knockouts in cell therapy
acagactcaccgagtggac

SEQ ID NO: 14414 - DNA, 19 bp, Artificial Sequence
  Artificial sequence related to HLA knockouts in cell therapy
agactcaccgagtggacct

SEQ ID NO: 14415 - DNA, 19 bp, Artificial Sequence
  Artificial sequence related to HLA knockouts in cell therapy
cgcggctactacaaccaga

SEQ ID NO: 14416 - DNA, 19 bp, Artificial Sequence
  Artificial sequence related to HLA knockouts in cell therapy
gcggctactacaaccagag

SEQ ID NO: 14417 - DNA, 19 bp, Artificial Sequence
  Artificial sequence related to HLA knockouts in cell therapy
cggctactacaaccagagc

SEQ ID NO: 14418 - DNA, 19 bp, Artificial Sequence
  Artificial sequence related to HLA knockouts in cell therapy
ggctactacaaccagagcg

SEQ ID NO: 14419 - DNA, 19 bp, Artificial Sequence
  Artificial sequence related to HLA knockouts in cell therapy
gctactacaaccagagcga

SEQ ID NO: 14420 - DNA, 19 bp, Artificial Sequence
  Artificial sequence related to HLA knockouts in cell therapy
ctactacaaccagagcgag

SEQ ID NO: 14421 - DNA, 19 bp, Artificial Sequence
  Artificial sequence related to HLA knockouts in cell therapy
tactacaaccagagcgagg

SEQ ID NO: 14422 - DNA, 19 bp, Artificial Sequence
  Artificial sequence related to HLA knockouts in cell therapy
actacaaccagagcgaggc

SEQ ID NO: 14423 - DNA, 19 bp, Artificial Sequence
  Artificial sequence related to HLA knockouts in cell therapy
ggttctcacaccgtccaga

SEQ ID NO: 14424 - DNA, 19 bp, Artificial Sequence
  Artificial sequence related to HLA knockouts in cell therapy
gttctcacaccgtccagag

SEQ ID NO: 14425 - DNA, 19 bp, Artificial Sequence
  Artificial sequence related to HLA knockouts in cell therapy
ttctcacaccgtccagagg

SEQ ID NO: 14426 - DNA, 19 bp, Artificial Sequence
  Artificial sequence related to HLA knockouts in cell therapy
tctcacaccgtccagagga

SEQ ID NO: 14427 - DNA, 19 bp, Artificial Sequence
  Artificial sequence related to HLA knockouts in cell therapy
ctcacaccgtccagaggat

SEQ ID NO: 14428 - DNA, 19 bp, Artificial Sequence
  Artificial sequence related to HLA knockouts in cell therapy
tcacaccgtccagaggatg

SEQ ID NO: 14429 - DNA, 19 bp, Artificial Sequence
  Artificial sequence related to HLA knockouts in cell therapy
cacaccgtccagaggatgt

SEQ ID NO: 14430 - DNA, 19 bp, Artificial Sequence
  Artificial sequence related to HLA knockouts in cell therapy
acaccgtccagaggatgta

SEQ ID NO: 14431 - DNA, 19 bp, Artificial Sequence
  Artificial sequence related to HLA knockouts in cell therapy
caccgtccagaggatgtat

SEQ ID NO: 14432 - DNA, 19 bp, Artificial Sequence
  Artificial sequence related to HLA knockouts in cell therapy
accgtccagaggatgtatg

SEQ ID NO: 14433 - DNA, 19 bp, Artificial Sequence
  Artificial sequence related to HLA knockouts in cell therapy
ccgtccagaggatgtatgg

SEQ ID NO: 14434 - DNA, 19 bp, Artificial Sequence
  Artificial sequence related to HLA knockouts in cell therapy
cgtccagaggatgtatggc

SEQ ID NO: 14435 - DNA, 19 bp, Artificial Sequence
  Artificial sequence related to HLA knockouts in cell therapy
gtccagaggatgtatggct

SEQ ID NO: 14436 - DNA, 19 bp, Artificial Sequence
  Artificial sequence related to HLA knockouts in cell therapy
tccagaggatgtatggctg

SEQ ID NO: 14437 - DNA, 19 bp, Artificial Sequence
  Artificial sequence related to HLA knockouts in cell therapy
ccagaggatgtatggctgc

SEQ ID NO: 14438 - DNA, 19 bp, Artificial Sequence
  Artificial sequence related to HLA knockouts in cell therapy
cagaggatgtatggctgcg

SEQ ID NO: 14439 - DNA, 19 bp, Artificial Sequence
  Artificial sequence related to HLA knockouts in cell therapy
agaggatgtatggctgcga

SEQ ID NO: 14440 - DNA, 19 bp, Artificial Sequence
  Artificial sequence related to HLA knockouts in cell therapy
gaggatgtatggctgcgac

SEQ ID NO: 14441 - DNA, 19 bp, Artificial Sequence
  Artificial sequence related to HLA knockouts in cell therapy
aggatgtatggctgcgacg

SEQ ID NO: 14442 - DNA, 19 bp, Artificial Sequence
  Artificial sequence related to HLA knockouts in cell therapy
ggatgtatggctgcgacgt

SEQ ID NO: 14443 - DNA, 19 bp, Artificial Sequence
  Artificial sequence related to HLA knockouts in cell therapy
gatgtatggctgcgacgtg

SEQ ID NO: 14444 - DNA, 19 bp, Artificial Sequence
  Artificial sequence related to HLA knockouts in cell therapy
atgtatggctgcgacgtgg

SEQ ID NO: 14445 - DNA, 19 bp, Artificial Sequence
  Artificial sequence related to HLA knockouts in cell therapy
ggtaccaccagtacgccta

SEQ ID NO: 14446 - DNA, 19 bp, Artificial Sequence
  Artificial sequence related to HLA knockouts in cell therapy
gtaccaccagtacgcctac

SEQ ID NO: 14447 - DNA, 19 bp, Artificial Sequence
  Artificial sequence related to HLA knockouts in cell therapy
taccaccagtacgcctacg

SEQ ID NO: 14448 - DNA, 19 bp, Artificial Sequence
  Artificial sequence related to HLA knockouts in cell therapy
accaccagtacgcctacga

SEQ ID NO: 14449 - DNA, 19 bp, Artificial Sequence
  Artificial sequence related to HLA knockouts in cell therapy
agtacgcctacgacggcaa

SEQ ID NO: 14450 - DNA, 19 bp, Artificial Sequence
  Artificial sequence related to HLA knockouts in cell therapy
gcctacgacggcaaggatt

SEQ ID NO: 14451 - DNA, 19 bp, Artificial Sequence
  Artificial sequence related to HLA knockouts in cell therapy
cctacgacggcaaggatta

SEQ ID NO: 14452 - DNA, 19 bp, Artificial Sequence
  Artificial sequence related to HLA knockouts in cell therapy
ctacgacggcaaggattac

SEQ ID NO: 14453 - DNA, 19 bp, Artificial Sequence
  Artificial sequence related to HLA knockouts in cell therapy
tacgacggcaaggattaca

SEQ ID NO: 14454 - DNA, 19 bp, Artificial Sequence
  Artificial sequence related to HLA knockouts in cell therapy
acgacggcaaggattacat

SEQ ID NO: 14455 - DNA, 19 bp, Artificial Sequence
  Artificial sequence related to HLA knockouts in cell therapy
cgacggcaaggattacatc

SEQ ID NO: 14456 - DNA, 19 bp, Artificial Sequence
  Artificial sequence related to HLA knockouts in cell therapy
gacggcaaggattacatcg

SEQ ID NO: 14457 - DNA, 19 bp, Artificial Sequence
  Artificial sequence related to HLA knockouts in cell therapy
acggcaaggattacatcgc

SEQ ID NO: 14458 - DNA, 19 bp, Artificial Sequence
  Artificial sequence related to HLA knockouts in cell therapy
cggcaaggattacatcgcc

SEQ ID NO: 14459 - DNA, 19 bp, Artificial Sequence
  Artificial sequence related to HLA knockouts in cell therapy
ggcaaggattacatcgccc

SEQ ID NO: 14460 - DNA, 19 bp, Artificial Sequence
  Artificial sequence related to HLA knockouts in cell therapy
gcaaggattacatcgccct

SEQ ID NO: 14461 - DNA, 19 bp, Artificial Sequence
  Artificial sequence related to HLA knockouts in cell therapy
caaggattacatcgccctg

SEQ ID NO: 14462 - DNA, 19 bp, Artificial Sequence
  Artificial sequence related to HLA knockouts in cell therapy
aaggattacatcgccctga

SEQ ID NO: 14463 - DNA, 19 bp, Artificial Sequence
  Artificial sequence related to HLA knockouts in cell therapy
aggattacatcgccctgaa

SEQ ID NO: 14464 - DNA, 19 bp, Artificial Sequence
  Artificial sequence related to HLA knockouts in cell therapy
ggattacatcgccctgaaa

SEQ ID NO: 14465 - DNA, 19 bp, Artificial Sequence
  Artificial sequence related to HLA knockouts in cell therapy
gattacatcgccctgaaag

SEQ ID NO: 14466 - DNA, 19 bp, Artificial Sequence
  Artificial sequence related to HLA knockouts in cell therapy
attacatcgccctgaaaga

SEQ ID NO: 14467 - DNA, 19 bp, Artificial Sequence
  Artificial sequence related to HLA knockouts in cell therapy
ttacatcgccctgaaagag

SEQ ID NO: 14468 - DNA, 19 bp, Artificial Sequence
  Artificial sequence related to HLA knockouts in cell therapy
tacatcgccctgaaagagg

SEQ ID NO: 14469 - DNA, 19 bp, Artificial Sequence
  Artificial sequence related to HLA knockouts in cell therapy
acatcgccctgaaagagga

SEQ ID NO: 14470 - DNA, 19 bp, Artificial Sequence
  Artificial sequence related to HLA knockouts in cell therapy
catcgccctgaaagaggac

SEQ ID NO: 14471 - DNA, 19 bp, Artificial Sequence
  Artificial sequence related to HLA knockouts in cell therapy
atcgccctgaaagaggacc

SEQ ID NO: 14472 - DNA, 19 bp, Artificial Sequence
  Artificial sequence related to HLA knockouts in cell therapy
tcgccctgaaagaggacct

SEQ ID NO: 14473 - DNA, 19 bp, Artificial Sequence
  Artificial sequence related to HLA knockouts in cell therapy
ctgaaagaggacctgcgct

SEQ ID NO: 14474 - DNA, 19 bp, Artificial Sequence
  Artificial sequence related to HLA knockouts in cell therapy
tgaaagaggacctgcgctc

SEQ ID NO: 14475 - DNA, 19 bp, Artificial Sequence
  Artificial sequence related to HLA knockouts in cell therapy
gaaagaggacctgcgctct

SEQ ID NO: 14476 - DNA, 19 bp, Artificial Sequence
  Artificial sequence related to HLA knockouts in cell therapy
aaagaggacctgcgctctt

SEQ ID NO: 14477 - DNA, 19 bp, Artificial Sequence
  Artificial sequence related to HLA knockouts in cell therapy
aagaggacctgcgctcttg

SEQ ID NO: 14478 - DNA, 19 bp, Artificial Sequence
  Artificial sequence related to HLA knockouts in cell therapy
gacatggcagctcagacca

SEQ ID NO: 14479 - DNA, 19 bp, Artificial Sequence
  Artificial sequence related to HLA knockouts in cell therapy
acatggcagctcagaccac

SEQ ID NO: 14480 - DNA, 19 bp, Artificial Sequence
  Artificial sequence related to HLA knockouts in cell therapy
atggcagctcagaccacca

SEQ ID NO: 14481 - DNA, 19 bp, Artificial Sequence
  Artificial sequence related to HLA knockouts in cell therapy
tggcagctcagaccaccaa

SEQ ID NO: 14482 - DNA, 19 bp, Artificial Sequence
  Artificial sequence related to HLA knockouts in cell therapy
cagctcagaccaccaagca

SEQ ID NO: 14483 - DNA, 19 bp, Artificial Sequence
  Artificial sequence related to HLA knockouts in cell therapy
agctcagaccaccaagcac

SEQ ID NO: 14484 - DNA, 19 bp, Artificial Sequence
  Artificial sequence related to HLA knockouts in cell therapy
gctcagaccaccaagcaca

SEQ ID NO: 14485 - DNA, 19 bp, Artificial Sequence
  Artificial sequence related to HLA knockouts in cell therapy
ctcagaccaccaagcacaa

SEQ ID NO: 14486 - DNA, 19 bp, Artificial Sequence
  Artificial sequence related to HLA knockouts in cell therapy
tcagaccaccaagcacaag

SEQ ID NO: 14487 - DNA, 19 bp, Artificial Sequence
  Artificial sequence related to HLA knockouts in cell therapy
cagaccaccaagcacaagt

SEQ ID NO: 14488 - DNA, 19 bp, Artificial Sequence
  Artificial sequence related to HLA knockouts in cell therapy
agaccaccaagcacaagtg

SEQ ID NO: 14489 - DNA, 19 bp, Artificial Sequence
  Artificial sequence related to HLA knockouts in cell therapy
gaccaccaagcacaagtgg

SEQ ID NO: 14490 - DNA, 19 bp, Artificial Sequence
  Artificial sequence related to HLA knockouts in cell therapy
accaccaagcacaagtggg

SEQ ID NO: 14491 - DNA, 19 bp, Artificial Sequence
  Artificial sequence related to HLA knockouts in cell therapy
ccaccaagcacaagtggga

SEQ ID NO: 14492 - DNA, 19 bp, Artificial Sequence
  Artificial sequence related to HLA knockouts in cell therapy
caccaagcacaagtgggag

SEQ ID NO: 14493 - DNA, 19 bp, Artificial Sequence
  Artificial sequence related to HLA knockouts in cell therapy
accaagcacaagtgggagg

SEQ ID NO: 14494 - DNA, 19 bp, Artificial Sequence
  Artificial sequence related to HLA knockouts in cell therapy
catgtggcggagcagttga

SEQ ID NO: 14495 - DNA, 19 bp, Artificial Sequence
  Artificial sequence related to HLA knockouts in cell therapy
atgtggcggagcagttgag

SEQ ID NO: 14496 - DNA, 19 bp, Artificial Sequence
  Artificial sequence related to HLA knockouts in cell therapy
tgtggcggagcagttgaga

SEQ ID NO: 14497 - DNA, 19 bp, Artificial Sequence
  Artificial sequence related to HLA knockouts in cell therapy
cggagcagttgagagccta

SEQ ID NO: 14498 - DNA, 19 bp, Artificial Sequence
  Artificial sequence related to HLA knockouts in cell therapy
ggagcagttgagagcctac

SEQ ID NO: 14499 - DNA, 19 bp, Artificial Sequence
  Artificial sequence related to HLA knockouts in cell therapy
gagcagttgagagcctacc

SEQ ID NO: 14500 - DNA, 19 bp, Artificial Sequence
  Artificial sequence related to HLA knockouts in cell therapy
agcagttgagagcctacct

SEQ ID NO: 14501 - DNA, 19 bp, Artificial Sequence
  Artificial sequence related to HLA knockouts in cell therapy
gcagttgagagcctacctg

SEQ ID NO: 14502 - DNA, 19 bp, Artificial Sequence
  Artificial sequence related to HLA knockouts in cell therapy
cagttgagagcctacctgg

SEQ ID NO: 14503 - DNA, 19 bp, Artificial Sequence
  Artificial sequence related to HLA knockouts in cell therapy
agttgagagcctacctgga

SEQ ID NO: 14504 - DNA, 19 bp, Artificial Sequence
  Artificial sequence related to HLA knockouts in cell therapy
gttgagagcctacctggag

SEQ ID NO: 14505 - DNA, 19 bp, Artificial Sequence
  Artificial sequence related to HLA knockouts in cell therapy
ttgagagcctacctggagg

SEQ ID NO: 14506 - DNA, 19 bp, Artificial Sequence
  Artificial sequence related to HLA knockouts in cell therapy
tggagtggctccgcagata

SEQ ID NO: 14507 - DNA, 19 bp, Artificial Sequence
  Artificial sequence related to HLA knockouts in cell therapy
agtggctccgcagatacct

SEQ ID NO: 14508 - DNA, 19 bp, Artificial Sequence
  Artificial sequence related to HLA knockouts in cell therapy
ctccgcagatacctggaga

SEQ ID NO: 14509 - DNA, 19 bp, Artificial Sequence
  Artificial sequence related to HLA knockouts in cell therapy
tccgcagatacctggagaa

SEQ ID NO: 14510 - DNA, 19 bp, Artificial Sequence
  Artificial sequence related to HLA knockouts in cell therapy
ccgcagatacctggagaac

SEQ ID NO: 14511 - DNA, 19 bp, Artificial Sequence
  Artificial sequence related to HLA knockouts in cell therapy
cgcagatacctggagaacg

SEQ ID NO: 14512 - DNA, 19 bp, Artificial Sequence
  Artificial sequence related to HLA knockouts in cell therapy
gcagatacctggagaacgg

SEQ ID NO: 14513 - DNA, 19 bp, Artificial Sequence
  Artificial sequence related to HLA knockouts in cell therapy
cagatacctggagaacggg

SEQ ID NO: 14514 - DNA, 19 bp, Artificial Sequence
  Artificial sequence related to HLA knockouts in cell therapy
agatacctggagaacggga

SEQ ID NO: 14515 - DNA, 19 bp, Artificial Sequence
  Artificial sequence related to HLA knockouts in cell therapy
gatacctggagaacgggaa

SEQ ID NO: 14516 - DNA, 19 bp, Artificial Sequence
  Artificial sequence related to HLA knockouts in cell therapy
atacctggagaacgggaag

SEQ ID NO: 14517 - DNA, 19 bp, Artificial Sequence
  Artificial sequence related to HLA knockouts in cell therapy
tacctggagaacgggaagg

SEQ ID NO: 14518 - DNA, 19 bp, Artificial Sequence
  Artificial sequence related to HLA knockouts in cell therapy
acctggagaacgggaagga

SEQ ID NO: 14519 - DNA, 19 bp, Artificial Sequence
  Artificial sequence related to HLA knockouts in cell therapy
ctggagaacgggaaggaga

SEQ ID NO: 14520 - DNA, 19 bp, Artificial Sequence
  Artificial sequence related to HLA knockouts in cell therapy
tggagaacgggaaggagac

SEQ ID NO: 14521 - DNA, 19 bp, Artificial Sequence
  Artificial sequence related to HLA knockouts in cell therapy
agaacgggaaggagacgct

SEQ ID NO: 14522 - DNA, 19 bp, Artificial Sequence
  Artificial sequence related to HLA knockouts in cell therapy
aaacgcatatgactcacca

SEQ ID NO: 14523 - DNA, 19 bp, Artificial Sequence
  Artificial sequence related to HLA knockouts in cell therapy
aacgcatatgactcaccac

SEQ ID NO: 14524 - DNA, 19 bp, Artificial Sequence
  Artificial sequence related to HLA knockouts in cell therapy
cgcatatgactcaccacgc

SEQ ID NO: 14525 - DNA, 19 bp, Artificial Sequence
  Artificial sequence related to HLA knockouts in cell therapy
gcatatgactcaccacgct

SEQ ID NO: 14526 - DNA, 19 bp, Artificial Sequence
  Artificial sequence related to HLA knockouts in cell therapy
catatgactcaccacgctg

SEQ ID NO: 14527 - DNA, 19 bp, Artificial Sequence
  Artificial sequence related to HLA knockouts in cell therapy
atatgactcaccacgctgt

SEQ ID NO: 14528 - DNA, 19 bp, Artificial Sequence
  Artificial sequence related to HLA knockouts in cell therapy
tatgactcaccacgctgtc

SEQ ID NO: 14529 - DNA, 19 bp, Artificial Sequence
  Artificial sequence related to HLA knockouts in cell therapy
atgactcaccacgctgtct

SEQ ID NO: 14530 - DNA, 19 bp, Artificial Sequence
  Artificial sequence related to HLA knockouts in cell therapy
tgactcaccacgctgtctc

SEQ ID NO: 14531 - DNA, 19 bp, Artificial Sequence
  Artificial sequence related to HLA knockouts in cell therapy
gactcaccacgctgtctct

SEQ ID NO: 14532 - DNA, 19 bp, Artificial Sequence
  Artificial sequence related to HLA knockouts in cell therapy
actcaccacgctgtctctg

SEQ ID NO: 14533 - DNA, 19 bp, Artificial Sequence
  Artificial sequence related to HLA knockouts in cell therapy
ctcaccacgctgtctctga

SEQ ID NO: 14534 - DNA, 19 bp, Artificial Sequence
  Artificial sequence related to HLA knockouts in cell therapy
tcaccacgctgtctctgac

SEQ ID NO: 14535 - DNA, 19 bp, Artificial Sequence
  Artificial sequence related to HLA knockouts in cell therapy
accacgctgtctctgacca

SEQ ID NO: 14536 - DNA, 19 bp, Artificial Sequence
  Artificial sequence related to HLA knockouts in cell therapy
ccacgctgtctctgaccat

SEQ ID NO: 14537 - DNA, 19 bp, Artificial Sequence
  Artificial sequence related to HLA knockouts in cell therapy
cacgctgtctctgaccatg

SEQ ID NO: 14538 - DNA, 19 bp, Artificial Sequence
  Artificial sequence related to HLA knockouts in cell therapy
acgctgtctctgaccatga

SEQ ID NO: 14539 - DNA, 19 bp, Artificial Sequence
  Artificial sequence related to HLA knockouts in cell therapy
cgctgtctctgaccatgaa

SEQ ID NO: 14540 - DNA, 19 bp, Artificial Sequence
  Artificial sequence related to HLA knockouts in cell therapy
gctgtctctgaccatgaag

SEQ ID NO: 14541 - DNA, 19 bp, Artificial Sequence
  Artificial sequence related to HLA knockouts in cell therapy
ctgtctctgaccatgaagc

SEQ ID NO: 14542 - DNA, 19 bp, Artificial Sequence
  Artificial sequence related to HLA knockouts in cell therapy
tgtctctgaccatgaagcc

SEQ ID NO: 14543 - DNA, 19 bp, Artificial Sequence
  Artificial sequence related to HLA knockouts in cell therapy
gtctctgaccatgaagcca

SEQ ID NO: 14544 - DNA, 19 bp, Artificial Sequence
  Artificial sequence related to HLA knockouts in cell therapy
tctctgaccatgaagccac

SEQ ID NO: 14545 - DNA, 19 bp, Artificial Sequence
  Artificial sequence related to HLA knockouts in cell therapy
ctctgaccatgaagccacc

SEQ ID NO: 14546 - DNA, 19 bp, Artificial Sequence
  Artificial sequence related to HLA knockouts in cell therapy
tctgaccatgaagccaccc

SEQ ID NO: 14547 - DNA, 19 bp, Artificial Sequence
  Artificial sequence related to HLA knockouts in cell therapy
ctgaccatgaagccaccct

SEQ ID NO: 14548 - DNA, 19 bp, Artificial Sequence
  Artificial sequence related to HLA knockouts in cell therapy
tgaccatgaagccaccctg

SEQ ID NO: 14549 - DNA, 19 bp, Artificial Sequence
  Artificial sequence related to HLA knockouts in cell therapy
gaccatgaagccaccctga

SEQ ID NO: 14550 - DNA, 19 bp, Artificial Sequence
  Artificial sequence related to HLA knockouts in cell therapy
accatgaagccaccctgag

SEQ ID NO: 14551 - DNA, 19 bp, Artificial Sequence
  Artificial sequence related to HLA knockouts in cell therapy
catgaagccaccctgaggt

SEQ ID NO: 14552 - DNA, 19 bp, Artificial Sequence
  Artificial sequence related to HLA knockouts in cell therapy
atgaagccaccctgaggtg

SEQ ID NO: 14553 - DNA, 19 bp, Artificial Sequence
  Artificial sequence related to HLA knockouts in cell therapy
tgagcttctaccctgcgga

SEQ ID NO: 14554 - DNA, 19 bp, Artificial Sequence
  Artificial sequence related to HLA knockouts in cell therapy
agcttctaccctgcggaga

SEQ ID NO: 14555 - DNA, 19 bp, Artificial Sequence
  Artificial sequence related to HLA knockouts in cell therapy
gcttctaccctgcggagat

SEQ ID NO: 14556 - DNA, 19 bp, Artificial Sequence
  Artificial sequence related to HLA knockouts in cell therapy
cttctaccctgcggagatc

SEQ ID NO: 14557 - DNA, 19 bp, Artificial Sequence
  Artificial sequence related to HLA knockouts in cell therapy
ttctaccctgcggagatca

SEQ ID NO: 14558 - DNA, 19 bp, Artificial Sequence
  Artificial sequence related to HLA knockouts in cell therapy
tctaccctgcggagatcac

SEQ ID NO: 14559 - DNA, 19 bp, Artificial Sequence
  Artificial sequence related to HLA knockouts in cell therapy
ctaccctgcggagatcaca

SEQ ID NO: 14560 - DNA, 19 bp, Artificial Sequence
  Artificial sequence related to HLA knockouts in cell therapy
taccctgcggagatcacac

SEQ ID NO: 14561 - DNA, 19 bp, Artificial Sequence
  Artificial sequence related to HLA knockouts in cell therapy
accctgcggagatcacact

SEQ ID NO: 14562 - DNA, 19 bp, Artificial Sequence
  Artificial sequence related to HLA knockouts in cell therapy
cctgcggagatcacactga

SEQ ID NO: 14563 - DNA, 19 bp, Artificial Sequence
  Artificial sequence related to HLA knockouts in cell therapy
ctgcggagatcacactgac

SEQ ID NO: 14564 - DNA, 19 bp, Artificial Sequence
  Artificial sequence related to HLA knockouts in cell therapy
tgcggagatcacactgacc

SEQ ID NO: 14565 - DNA, 19 bp, Artificial Sequence
  Artificial sequence related to HLA knockouts in cell therapy
gcggagatcacactgacct

SEQ ID NO: 14566 - DNA, 19 bp, Artificial Sequence
  Artificial sequence related to HLA knockouts in cell therapy
cggagatcacactgacctg

SEQ ID NO: 14567 - DNA, 19 bp, Artificial Sequence
  Artificial sequence related to HLA knockouts in cell therapy
ggagatcacactgacctgg

SEQ ID NO: 14568 - DNA, 19 bp, Artificial Sequence
  Artificial sequence related to HLA knockouts in cell therapy
gagatcacactgacctggc

SEQ ID NO: 14569 - DNA, 19 bp, Artificial Sequence
  Artificial sequence related to HLA knockouts in cell therapy
agatcacactgacctggca

SEQ ID NO: 14570 - DNA, 19 bp, Artificial Sequence
  Artificial sequence related to HLA knockouts in cell therapy
gatcacactgacctggcag

SEQ ID NO: 14571 - DNA, 19 bp, Artificial Sequence
  Artificial sequence related to HLA knockouts in cell therapy
atcacactgacctggcagc

SEQ ID NO: 14572 - DNA, 19 bp, Artificial Sequence
  Artificial sequence related to HLA knockouts in cell therapy
gggatggaaccttccagaa

SEQ ID NO: 14573 - DNA, 19 bp, Artificial Sequence
  Artificial sequence related to HLA knockouts in cell therapy
ggatggaaccttccagaag

SEQ ID NO: 14574 - DNA, 19 bp, Artificial Sequence
  Artificial sequence related to HLA knockouts in cell therapy
gatggaaccttccagaagt

SEQ ID NO: 14575 - DNA, 19 bp, Artificial Sequence
  Artificial sequence related to HLA knockouts in cell therapy
atggaaccttccagaagtg

SEQ ID NO: 14576 - DNA, 19 bp, Artificial Sequence
  Artificial sequence related to HLA knockouts in cell therapy
tggaaccttccagaagtgg

SEQ ID NO: 14577 - DNA, 19 bp, Artificial Sequence
  Artificial sequence related to HLA knockouts in cell therapy
ggaaccttccagaagtggg

SEQ ID NO: 14578 - DNA, 19 bp, Artificial Sequence
  Artificial sequence related to HLA knockouts in cell therapy
gaaccttccagaagtgggc

SEQ ID NO: 14579 - DNA, 19 bp, Artificial Sequence
  Artificial sequence related to HLA knockouts in cell therapy
aaccttccagaagtgggcg

SEQ ID NO: 14580 - DNA, 19 bp, Artificial Sequence
  Artificial sequence related to HLA knockouts in cell therapy
tgtggtggtgccttctgga

SEQ ID NO: 14581 - DNA, 19 bp, Artificial Sequence
  Artificial sequence related to HLA knockouts in cell therapy
tggtggtgccttctggaca

SEQ ID NO: 14582 - DNA, 19 bp, Artificial Sequence
  Artificial sequence related to HLA knockouts in cell therapy
tggtgccttctggacagga

SEQ ID NO: 14583 - DNA, 19 bp, Artificial Sequence
  Artificial sequence related to HLA knockouts in cell therapy
tgccttctggacaggagca

SEQ ID NO: 14584 - DNA, 19 bp, Artificial Sequence
  Artificial sequence related to HLA knockouts in cell therapy
ccttctggacaggagcaga

SEQ ID NO: 14585 - DNA, 19 bp, Artificial Sequence
  Artificial sequence related to HLA knockouts in cell therapy
cttctggacaggagcagag

SEQ ID NO: 14586 - DNA, 19 bp, Artificial Sequence
  Artificial sequence related to HLA knockouts in cell therapy
ttctggacaggagcagaga

SEQ ID NO: 14587 - DNA, 19 bp, Artificial Sequence
  Artificial sequence related to HLA knockouts in cell therapy
tctggacaggagcagagat

SEQ ID NO: 14588 - DNA, 19 bp, Artificial Sequence
  Artificial sequence related to HLA knockouts in cell therapy
ctggacaggagcagagata

SEQ ID NO: 14589 - DNA, 19 bp, Artificial Sequence
  Artificial sequence related to HLA knockouts in cell therapy
tggacaggagcagagatac

SEQ ID NO: 14590 - DNA, 19 bp, Artificial Sequence
  Artificial sequence related to HLA knockouts in cell therapy
ggacaggagcagagataca

SEQ ID NO: 14591 - DNA, 19 bp, Artificial Sequence
  Artificial sequence related to HLA knockouts in cell therapy
gacaggagcagagatacac

SEQ ID NO: 14592 - DNA, 19 bp, Artificial Sequence
  Artificial sequence related to HLA knockouts in cell therapy
acaggagcagagatacacc

SEQ ID NO: 14593 - DNA, 19 bp, Artificial Sequence
  Artificial sequence related to HLA knockouts in cell therapy
caggagcagagatacacct

SEQ ID NO: 14594 - DNA, 19 bp, Artificial Sequence
  Artificial sequence related to HLA knockouts in cell therapy
aggagcagagatacacctg

SEQ ID NO: 14595 - DNA, 19 bp, Artificial Sequence
  Artificial sequence related to HLA knockouts in cell therapy
ggagcagagatacacctgc

SEQ ID NO: 14596 - DNA, 19 bp, Artificial Sequence
  Artificial sequence related to HLA knockouts in cell therapy
gagcagagatacacctgcc

SEQ ID NO: 14597 - DNA, 19 bp, Artificial Sequence
  Artificial sequence related to HLA knockouts in cell therapy
agcagagatacacctgcca

SEQ ID NO: 14598 - DNA, 19 bp, Artificial Sequence
  Artificial sequence related to HLA knockouts in cell therapy
gcagagatacacctgccat

SEQ ID NO: 14599 - DNA, 19 bp, Artificial Sequence
  Artificial sequence related to HLA knockouts in cell therapy
cagagatacacctgccatg

SEQ ID NO: 14600 - DNA, 19 bp, Artificial Sequence
  Artificial sequence related to HLA knockouts in cell therapy
agagatacacctgccatgt

SEQ ID NO: 14601 - DNA, 19 bp, Artificial Sequence
  Artificial sequence related to HLA knockouts in cell therapy
gagatacacctgccatgtg

SEQ ID NO: 14602 - DNA, 19 bp, Artificial Sequence
  Artificial sequence related to HLA knockouts in cell therapy
agatacacctgccatgtgc

SEQ ID NO: 14603 - DNA, 19 bp, Artificial Sequence
  Artificial sequence related to HLA knockouts in cell therapy
gatacacctgccatgtgca

SEQ ID NO: 14604 - DNA, 19 bp, Artificial Sequence
  Artificial sequence related to HLA knockouts in cell therapy
atacacctgccatgtgcag

SEQ ID NO: 14605 - DNA, 19 bp, Artificial Sequence
  Artificial sequence related to HLA knockouts in cell therapy
tacacctgccatgtgcagc

SEQ ID NO: 14606 - DNA, 19 bp, Artificial Sequence
  Artificial sequence related to HLA knockouts in cell therapy
acacctgccatgtgcagca

SEQ ID NO: 14607 - DNA, 19 bp, Artificial Sequence
  Artificial sequence related to HLA knockouts in cell therapy
cacctgccatgtgcagcat

SEQ ID NO: 14608 - DNA, 19 bp, Artificial Sequence
  Artificial sequence related to HLA knockouts in cell therapy
acctgccatgtgcagcatg

SEQ ID NO: 14609 - DNA, 19 bp, Artificial Sequence
  Artificial sequence related to HLA knockouts in cell therapy
cctgccatgtgcagcatga

SEQ ID NO: 14610 - DNA, 19 bp, Artificial Sequence
  Artificial sequence related to HLA knockouts in cell therapy
ctgccatgtgcagcatgag

SEQ ID NO: 14611 - DNA, 19 bp, Artificial Sequence
  Artificial sequence related to HLA knockouts in cell therapy
tgccatgtgcagcatgagg

SEQ ID NO: 14612 - DNA, 19 bp, Artificial Sequence
  Artificial sequence related to HLA knockouts in cell therapy
ccatgtgcagcatgagggt

SEQ ID NO: 14613 - DNA, 19 bp, Artificial Sequence
  Artificial sequence related to HLA knockouts in cell therapy
catgtgcagcatgagggtt

SEQ ID NO: 14614 - DNA, 19 bp, Artificial Sequence
  Artificial sequence related to HLA knockouts in cell therapy
atgtgcagcatgagggttt

SEQ ID NO: 14615 - DNA, 19 bp, Artificial Sequence
  Artificial sequence related to HLA knockouts in cell therapy
tgtgcagcatgagggtttg

SEQ ID NO: 14616 - DNA, 19 bp, Artificial Sequence
  Artificial sequence related to HLA knockouts in cell therapy
gtgcagcatgagggtttgc

SEQ ID NO: 14617 - DNA, 19 bp, Artificial Sequence
  Artificial sequence related to HLA knockouts in cell therapy
tgcagcatgagggtttgcc

SEQ ID NO: 14618 - DNA, 19 bp, Artificial Sequence
  Artificial sequence related to HLA knockouts in cell therapy
cagcatgagggtttgccca

SEQ ID NO: 14619 - DNA, 19 bp, Artificial Sequence
  Artificial sequence related to HLA knockouts in cell therapy
agcatgagggtttgcccaa

SEQ ID NO: 14620 - DNA, 19 bp, Artificial Sequence
  Artificial sequence related to HLA knockouts in cell therapy
gcatgagggtttgcccaag

SEQ ID NO: 14621 - DNA, 19 bp, Artificial Sequence
  Artificial sequence related to HLA knockouts in cell therapy
catgagggtttgcccaagc

SEQ ID NO: 14622 - DNA, 19 bp, Artificial Sequence
  Artificial sequence related to HLA knockouts in cell therapy
atgagggtttgcccaagcc

SEQ ID NO: 14623 - DNA, 19 bp, Artificial Sequence
  Artificial sequence related to HLA knockouts in cell therapy
ctgagatgggagccgtctt

SEQ ID NO: 14624 - DNA, 19 bp, Artificial Sequence
  Artificial sequence related to HLA knockouts in cell therapy
tgagatgggagccgtcttc

SEQ ID NO: 14625 - DNA, 19 bp, Artificial Sequence
  Artificial sequence related to HLA knockouts in cell therapy
cccatcgtgggcatcattg

SEQ ID NO: 14626 - DNA, 19 bp, Artificial Sequence
  Artificial sequence related to HLA knockouts in cell therapy
ccatcgtgggcatcattgc

SEQ ID NO: 14627 - DNA, 19 bp, Artificial Sequence
  Artificial sequence related to HLA knockouts in cell therapy
catcgtgggcatcattgct

SEQ ID NO: 14628 - DNA, 19 bp, Artificial Sequence
  Artificial sequence related to HLA knockouts in cell therapy
atcgtgggcatcattgctg

SEQ ID NO: 14629 - DNA, 19 bp, Artificial Sequence
  Artificial sequence related to HLA knockouts in cell therapy
tcgtgggcatcattgctgg

SEQ ID NO: 14630 - DNA, 19 bp, Artificial Sequence
  Artificial sequence related to HLA knockouts in cell therapy
tgggcatcattgctggcct

SEQ ID NO: 14631 - DNA, 19 bp, Artificial Sequence
  Artificial sequence related to HLA knockouts in cell therapy
gcatcattgctggcctggt

SEQ ID NO: 14632 - DNA, 19 bp, Artificial Sequence
  Artificial sequence related to HLA knockouts in cell therapy
catcattgctggcctggtt

SEQ ID NO: 14633 - DNA, 19 bp, Artificial Sequence
  Artificial sequence related to HLA knockouts in cell therapy
atcattgctggcctggttc

SEQ ID NO: 14634 - DNA, 19 bp, Artificial Sequence
  Artificial sequence related to HLA knockouts in cell therapy
tcattgctggcctggttct

SEQ ID NO: 14635 - DNA, 19 bp, Artificial Sequence
  Artificial sequence related to HLA knockouts in cell therapy
cattgctggcctggttctc

SEQ ID NO: 14636 - DNA, 19 bp, Artificial Sequence
  Artificial sequence related to HLA knockouts in cell therapy
attgctggcctggttctct

SEQ ID NO: 14637 - DNA, 19 bp, Artificial Sequence
  Artificial sequence related to HLA knockouts in cell therapy
ttgctggcctggttctctt

SEQ ID NO: 14638 - DNA, 19 bp, Artificial Sequence
  Artificial sequence related to HLA knockouts in cell therapy
tgctggcctggttctcttt

SEQ ID NO: 14639 - DNA, 19 bp, Artificial Sequence
  Artificial sequence related to HLA knockouts in cell therapy
gctggcctggttctctttg

SEQ ID NO: 14640 - DNA, 19 bp, Artificial Sequence
  Artificial sequence related to HLA knockouts in cell therapy
ctggcctggttctctttgg

SEQ ID NO: 14641 - DNA, 19 bp, Artificial Sequence
  Artificial sequence related to HLA knockouts in cell therapy
tggcctggttctctttgga

SEQ ID NO: 14642 - DNA, 19 bp, Artificial Sequence
  Artificial sequence related to HLA knockouts in cell therapy
ggcctggttctctttggag

SEQ ID NO: 14643 - DNA, 19 bp, Artificial Sequence
  Artificial sequence related to HLA knockouts in cell therapy
gcctggttctctttggagc

SEQ ID NO: 14644 - DNA, 19 bp, Artificial Sequence
  Artificial sequence related to HLA knockouts in cell therapy
cctggttctctttggagct

SEQ ID NO: 14645 - DNA, 19 bp, Artificial Sequence
  Artificial sequence related to HLA knockouts in cell therapy
ctggttctctttggagctg

SEQ ID NO: 14646 - DNA, 19 bp, Artificial Sequence
  Artificial sequence related to HLA knockouts in cell therapy
tggttctctttggagctgt

SEQ ID NO: 14647 - DNA, 19 bp, Artificial Sequence
  Artificial sequence related to HLA knockouts in cell therapy
ggttctctttggagctgtg

SEQ ID NO: 14648 - DNA, 19 bp, Artificial Sequence
  Artificial sequence related to HLA knockouts in cell therapy
gttctctttggagctgtga

SEQ ID NO: 14649 - DNA, 19 bp, Artificial Sequence
  Artificial sequence related to HLA knockouts in cell therapy
ttctctttggagctgtgat

SEQ ID NO: 14650 - DNA, 19 bp, Artificial Sequence
  Artificial sequence related to HLA knockouts in cell therapy
tctctttggagctgtgatc

SEQ ID NO: 14651 - DNA, 19 bp, Artificial Sequence
  Artificial sequence related to HLA knockouts in cell therapy
ctctttggagctgtgatca

SEQ ID NO: 14652 - DNA, 19 bp, Artificial Sequence
  Artificial sequence related to HLA knockouts in cell therapy
tctttggagctgtgatcac

SEQ ID NO: 14653 - DNA, 19 bp, Artificial Sequence
  Artificial sequence related to HLA knockouts in cell therapy
ctttggagctgtgatcact

SEQ ID NO: 14654 - DNA, 19 bp, Artificial Sequence
  Artificial sequence related to HLA knockouts in cell therapy
tttggagctgtgatcactg

SEQ ID NO: 14655 - DNA, 19 bp, Artificial Sequence
  Artificial sequence related to HLA knockouts in cell therapy
ttggagctgtgatcactgg

SEQ ID NO: 14656 - DNA, 19 bp, Artificial Sequence
  Artificial sequence related to HLA knockouts in cell therapy
tggagctgtgatcactgga

SEQ ID NO: 14657 - DNA, 19 bp, Artificial Sequence
  Artificial sequence related to HLA knockouts in cell therapy
ggagctgtgatcactggag

SEQ ID NO: 14658 - DNA, 19 bp, Artificial Sequence
  Artificial sequence related to HLA knockouts in cell therapy
gagctgtgatcactggagc

SEQ ID NO: 14659 - DNA, 19 bp, Artificial Sequence
  Artificial sequence related to HLA knockouts in cell therapy
agctgtgatcactggagct

SEQ ID NO: 14660 - DNA, 19 bp, Artificial Sequence
  Artificial sequence related to HLA knockouts in cell therapy
gctgtgatcactggagctg

SEQ ID NO: 14661 - DNA, 19 bp, Artificial Sequence
  Artificial sequence related to HLA knockouts in cell therapy
ctgtgatcactggagctgt

SEQ ID NO: 14662 - DNA, 19 bp, Artificial Sequence
  Artificial sequence related to HLA knockouts in cell therapy
tgtgatcactggagctgtg

SEQ ID NO: 14663 - DNA, 19 bp, Artificial Sequence
  Artificial sequence related to HLA knockouts in cell therapy
gtgatcactggagctgtgg

SEQ ID NO: 14664 - DNA, 19 bp, Artificial Sequence
  Artificial sequence related to HLA knockouts in cell therapy
tgatcactggagctgtggt

SEQ ID NO: 14665 - DNA, 19 bp, Artificial Sequence
  Artificial sequence related to HLA knockouts in cell therapy
gatcactggagctgtggtc

SEQ ID NO: 14666 - DNA, 19 bp, Artificial Sequence
  Artificial sequence related to HLA knockouts in cell therapy
atcactggagctgtggtcg

SEQ ID NO: 14667 - DNA, 19 bp, Artificial Sequence
  Artificial sequence related to HLA knockouts in cell therapy
ctgtggtcgctgctgtgat

SEQ ID NO: 14668 - DNA, 19 bp, Artificial Sequence
  Artificial sequence related to HLA knockouts in cell therapy
tgtggtcgctgctgtgatg

SEQ ID NO: 14669 - DNA, 19 bp, Artificial Sequence
  Artificial sequence related to HLA knockouts in cell therapy
gtggtcgctgctgtgatgt

SEQ ID NO: 14670 - DNA, 19 bp, Artificial Sequence
  Artificial sequence related to HLA knockouts in cell therapy
tggtcgctgctgtgatgtg

SEQ ID NO: 14671 - DNA, 19 bp, Artificial Sequence
  Artificial sequence related to HLA knockouts in cell therapy
gtcgctgctgtgatgtgga

SEQ ID NO: 14672 - DNA, 19 bp, Artificial Sequence
  Artificial sequence related to HLA knockouts in cell therapy
tcgctgctgtgatgtggag

SEQ ID NO: 14673 - DNA, 19 bp, Artificial Sequence
  Artificial sequence related to HLA knockouts in cell therapy
gctgctgtgatgtggagga

SEQ ID NO: 14674 - DNA, 19 bp, Artificial Sequence
  Artificial sequence related to HLA knockouts in cell therapy
ctgctgtgatgtggaggag

SEQ ID NO: 14675 - DNA, 19 bp, Artificial Sequence
  Artificial sequence related to HLA knockouts in cell therapy
tgctgtgatgtggaggagg

SEQ ID NO: 14676 - DNA, 19 bp, Artificial Sequence
  Artificial sequence related to HLA knockouts in cell therapy
gctgtgatgtggaggagga

SEQ ID NO: 14677 - DNA, 19 bp, Artificial Sequence
  Artificial sequence related to HLA knockouts in cell therapy
ctgtgatgtggaggaggaa

SEQ ID NO: 14678 - DNA, 19 bp, Artificial Sequence
  Artificial sequence related to HLA knockouts in cell therapy
tgtgatgtggaggaggaag

SEQ ID NO: 14679 - DNA, 19 bp, Artificial Sequence
  Artificial sequence related to HLA knockouts in cell therapy
gtgatgtggaggaggaaga

SEQ ID NO: 14680 - DNA, 19 bp, Artificial Sequence
  Artificial sequence related to HLA knockouts in cell therapy
tgatgtggaggaggaagag

SEQ ID NO: 14681 - DNA, 19 bp, Artificial Sequence
  Artificial sequence related to HLA knockouts in cell therapy
gatgtggaggaggaagagc

SEQ ID NO: 14682 - DNA, 19 bp, Artificial Sequence
  Artificial sequence related to HLA knockouts in cell therapy
atgtggaggaggaagagct

SEQ ID NO: 14683 - DNA, 19 bp, Artificial Sequence
  Artificial sequence related to HLA knockouts in cell therapy
tgtggaggaggaagagctc

SEQ ID NO: 14684 - DNA, 19 bp, Artificial Sequence
  Artificial sequence related to HLA knockouts in cell therapy
gtggaggaggaagagctca

SEQ ID NO: 14685 - DNA, 19 bp, Artificial Sequence
  Artificial sequence related to HLA knockouts in cell therapy
tggaggaggaagagctcag

SEQ ID NO: 14686 - DNA, 19 bp, Artificial Sequence
  Artificial sequence related to HLA knockouts in cell therapy
ggaggaggaagagctcaga

SEQ ID NO: 14687 - DNA, 19 bp, Artificial Sequence
  Artificial sequence related to HLA knockouts in cell therapy
gaggaggaagagctcagat

SEQ ID NO: 14688 - DNA, 19 bp, Artificial Sequence
  Artificial sequence related to HLA knockouts in cell therapy
aggaggaagagctcagata

SEQ ID NO: 14689 - DNA, 19 bp, Artificial Sequence
  Artificial sequence related to HLA knockouts in cell therapy
ggaggaagagctcagatag

SEQ ID NO: 14690 - DNA, 19 bp, Artificial Sequence
  Artificial sequence related to HLA knockouts in cell therapy
gaggaagagctcagataga

SEQ ID NO: 14691 - DNA, 19 bp, Artificial Sequence
  Artificial sequence related to HLA knockouts in cell therapy
aggaagagctcagatagaa

SEQ ID NO: 14692 - DNA, 19 bp, Artificial Sequence
  Artificial sequence related to HLA knockouts in cell therapy
aaaggagggagctactctc

SEQ ID NO: 14693 - DNA, 19 bp, Artificial Sequence
  Artificial sequence related to HLA knockouts in cell therapy
aaggagggagctactctca

SEQ ID NO: 14694 - DNA, 19 bp, Artificial Sequence
  Artificial sequence related to HLA knockouts in cell therapy
aggagggagctactctcag

SEQ ID NO: 14695 - DNA, 19 bp, Artificial Sequence
  Artificial sequence related to HLA knockouts in cell therapy
agggagctactctcaggct

SEQ ID NO: 14696 - DNA, 19 bp, Artificial Sequence
  Artificial sequence related to HLA knockouts in cell therapy
gagctactctcaggctgca

SEQ ID NO: 14697 - DNA, 19 bp, Artificial Sequence
  Artificial sequence related to HLA knockouts in cell therapy
agctactctcaggctgcaa

SEQ ID NO: 14698 - DNA, 19 bp, Artificial Sequence
  Artificial sequence related to HLA knockouts in cell therapy
gctactctcaggctgcaag

SEQ ID NO: 14699 - DNA, 19 bp, Artificial Sequence
  Artificial sequence related to HLA knockouts in cell therapy
ctactctcaggctgcaagc

SEQ ID NO: 14700 - DNA, 19 bp, Artificial Sequence
  Artificial sequence related to HLA knockouts in cell therapy
tactctcaggctgcaagca

SEQ ID NO: 14701 - DNA, 19 bp, Artificial Sequence
  Artificial sequence related to HLA knockouts in cell therapy
actctcaggctgcaagcag

SEQ ID NO: 14702 - DNA, 19 bp, Artificial Sequence
  Artificial sequence related to HLA knockouts in cell therapy
ctctcaggctgcaagcagt

SEQ ID NO: 14703 - DNA, 19 bp, Artificial Sequence
  Artificial sequence related to HLA knockouts in cell therapy
tctcaggctgcaagcagtg

SEQ ID NO: 14704 - DNA, 19 bp, Artificial Sequence
  Artificial sequence related to HLA knockouts in cell therapy
ctcaggctgcaagcagtga

SEQ ID NO: 14705 - DNA, 19 bp, Artificial Sequence
  Artificial sequence related to HLA knockouts in cell therapy
tcaggctgcaagcagtgac

SEQ ID NO: 14706 - DNA, 19 bp, Artificial Sequence
  Artificial sequence related to HLA knockouts in cell therapy
caggctgcaagcagtgaca

SEQ ID NO: 14707 - DNA, 19 bp, Artificial Sequence
  Artificial sequence related to HLA knockouts in cell therapy
aggctgcaagcagtgacag

SEQ ID NO: 14708 - DNA, 19 bp, Artificial Sequence
  Artificial sequence related to HLA knockouts in cell therapy
ggctgcaagcagtgacagt

SEQ ID NO: 14709 - DNA, 19 bp, Artificial Sequence
  Artificial sequence related to HLA knockouts in cell therapy
gctgcaagcagtgacagtg

SEQ ID NO: 14710 - DNA, 19 bp, Artificial Sequence
  Artificial sequence related to HLA knockouts in cell therapy
ctgcaagcagtgacagtgc

SEQ ID NO: 14711 - DNA, 19 bp, Artificial Sequence
  Artificial sequence related to HLA knockouts in cell therapy
tgcaagcagtgacagtgcc

SEQ ID NO: 14712 - DNA, 19 bp, Artificial Sequence
  Artificial sequence related to HLA knockouts in cell therapy
caagcagtgacagtgccca

SEQ ID NO: 14713 - DNA, 19 bp, Artificial Sequence
  Artificial sequence related to HLA knockouts in cell therapy
aagcagtgacagtgcccag

SEQ ID NO: 14714 - DNA, 19 bp, Artificial Sequence
  Artificial sequence related to HLA knockouts in cell therapy
ccagggctctgatgtgtct

SEQ ID NO: 14715 - DNA, 19 bp, Artificial Sequence
  Artificial sequence related to HLA knockouts in cell therapy
cagggctctgatgtgtctc

SEQ ID NO: 14716 - DNA, 19 bp, Artificial Sequence
  Artificial sequence related to HLA knockouts in cell therapy
agggctctgatgtgtctct

SEQ ID NO: 14717 - DNA, 19 bp, Artificial Sequence
  Artificial sequence related to HLA knockouts in cell therapy
gggctctgatgtgtctctc

SEQ ID NO: 14718 - DNA, 19 bp, Artificial Sequence
  Artificial sequence related to HLA knockouts in cell therapy
ggctctgatgtgtctctca

SEQ ID NO: 14719 - DNA, 19 bp, Artificial Sequence
  Artificial sequence related to HLA knockouts in cell therapy
gctctgatgtgtctctcac

SEQ ID NO: 14720 - DNA, 19 bp, Artificial Sequence
  Artificial sequence related to HLA knockouts in cell therapy
ctctgatgtgtctctcaca

SEQ ID NO: 14721 - DNA, 19 bp, Artificial Sequence
  Artificial sequence related to HLA knockouts in cell therapy
tctgatgtgtctctcacag

SEQ ID NO: 14722 - DNA, 19 bp, Artificial Sequence
  Artificial sequence related to HLA knockouts in cell therapy
ctgatgtgtctctcacagc

SEQ ID NO: 14723 - DNA, 19 bp, Artificial Sequence
  Artificial sequence related to HLA knockouts in cell therapy
tgatgtgtctctcacagct

SEQ ID NO: 14724 - DNA, 19 bp, Artificial Sequence
  Artificial sequence related to HLA knockouts in cell therapy
gatgtgtctctcacagctt

SEQ ID NO: 14725 - DNA, 19 bp, Artificial Sequence
  Artificial sequence related to HLA knockouts in cell therapy
atgtgtctctcacagcttg

SEQ ID NO: 14726 - DNA, 19 bp, Artificial Sequence
  Artificial sequence related to HLA knockouts in cell therapy
tgtgtctctcacagcttgt

SEQ ID NO: 14727 - DNA, 19 bp, Artificial Sequence
  Artificial sequence related to HLA knockouts in cell therapy
gtgtctctcacagcttgta

SEQ ID NO: 14728 - DNA, 19 bp, Artificial Sequence
  Artificial sequence related to HLA knockouts in cell therapy
tgtctctcacagcttgtaa

SEQ ID NO: 14729 - DNA, 19 bp, Artificial Sequence
  Artificial sequence related to HLA knockouts in cell therapy
gtctctcacagcttgtaaa

SEQ ID NO: 14730 - DNA, 19 bp, Artificial Sequence
  Artificial sequence related to HLA knockouts in cell therapy
tctctcacagcttgtaaag

SEQ ID NO: 14731 - DNA, 19 bp, Artificial Sequence
  Artificial sequence related to HLA knockouts in cell therapy
ctctcacagcttgtaaagt

SEQ ID NO: 14732 - DNA, 19 bp, Artificial Sequence
  Artificial sequence related to HLA knockouts in cell therapy
tctcacagcttgtaaagtg

SEQ ID NO: 14733 - DNA, 19 bp, Artificial Sequence
  Artificial sequence related to HLA knockouts in cell therapy
ctcacagcttgtaaagtgt

SEQ ID NO: 14734 - DNA, 19 bp, Artificial Sequence
  Artificial sequence related to HLA knockouts in cell therapy
tcacagcttgtaaagtgtg

SEQ ID NO: 14735 - DNA, 19 bp, Artificial Sequence
  Artificial sequence related to HLA knockouts in cell therapy
cacagcttgtaaagtgtga

SEQ ID NO: 14736 - DNA, 19 bp, Artificial Sequence
  Artificial sequence related to HLA knockouts in cell therapy
acagcttgtaaagtgtgag

SEQ ID NO: 14737 - DNA, 19 bp, Artificial Sequence
  Artificial sequence related to HLA knockouts in cell therapy
cagcttgtaaagtgtgaga

SEQ ID NO: 14738 - DNA, 19 bp, Artificial Sequence
  Artificial sequence related to HLA knockouts in cell therapy
agcttgtaaagtgtgagac

SEQ ID NO: 14739 - DNA, 19 bp, Artificial Sequence
  Artificial sequence related to HLA knockouts in cell therapy
gcttgtaaagtgtgagaca

SEQ ID NO: 14740 - DNA, 19 bp, Artificial Sequence
  Artificial sequence related to HLA knockouts in cell therapy
cttgtaaagtgtgagacag

SEQ ID NO: 14741 - DNA, 19 bp, Artificial Sequence
  Artificial sequence related to HLA knockouts in cell therapy
ttgtaaagtgtgagacagc

SEQ ID NO: 14742 - DNA, 19 bp, Artificial Sequence
  Artificial sequence related to HLA knockouts in cell therapy
tgtaaagtgtgagacagct

SEQ ID NO: 14743 - DNA, 19 bp, Artificial Sequence
  Artificial sequence related to HLA knockouts in cell therapy
gtaaagtgtgagacagctg

SEQ ID NO: 14744 - DNA, 19 bp, Artificial Sequence
  Artificial sequence related to HLA knockouts in cell therapy
taaagtgtgagacagctgc

SEQ ID NO: 14745 - DNA, 19 bp, Artificial Sequence
  Artificial sequence related to HLA knockouts in cell therapy
aaagtgtgagacagctgcc

SEQ ID NO: 14746 - DNA, 19 bp, Artificial Sequence
  Artificial sequence related to HLA knockouts in cell therapy
aagtgtgagacagctgcct

SEQ ID NO: 14747 - DNA, 19 bp, Artificial Sequence
  Artificial sequence related to HLA knockouts in cell therapy
agtgtgagacagctgcctt

SEQ ID NO: 14748 - DNA, 19 bp, Artificial Sequence
  Artificial sequence related to HLA knockouts in cell therapy
tgtgagacagctgccttgt

SEQ ID NO: 14749 - DNA, 19 bp, Artificial Sequence
  Artificial sequence related to HLA knockouts in cell therapy
gtgagacagctgccttgtg

SEQ ID NO: 14750 - DNA, 19 bp, Artificial Sequence
  Artificial sequence related to HLA knockouts in cell therapy
tgagacagctgccttgtgt

SEQ ID NO: 14751 - DNA, 19 bp, Artificial Sequence
  Artificial sequence related to HLA knockouts in cell therapy
gagacagctgccttgtgtg

SEQ ID NO: 14752 - DNA, 19 bp, Artificial Sequence
  Artificial sequence related to HLA knockouts in cell therapy
agacagctgccttgtgtgg

SEQ ID NO: 14753 - DNA, 19 bp, Artificial Sequence
  Artificial sequence related to HLA knockouts in cell therapy
acagctgccttgtgtggga

SEQ ID NO: 14754 - DNA, 19 bp, Artificial Sequence
  Artificial sequence related to HLA knockouts in cell therapy
agctgccttgtgtgggact

SEQ ID NO: 14755 - DNA, 19 bp, Artificial Sequence
  Artificial sequence related to HLA knockouts in cell therapy
ctgccttgtgtgggactga

SEQ ID NO: 14756 - DNA, 19 bp, Artificial Sequence
  Artificial sequence related to HLA knockouts in cell therapy
tgccttgtgtgggactgag

SEQ ID NO: 14757 - DNA, 19 bp, Artificial Sequence
  Artificial sequence related to HLA knockouts in cell therapy
gccttgtgtgggactgaga

SEQ ID NO: 14758 - DNA, 19 bp, Artificial Sequence
  Artificial sequence related to HLA knockouts in cell therapy
ccttgtgtgggactgagag

SEQ ID NO: 14759 - DNA, 19 bp, Artificial Sequence
  Artificial sequence related to HLA knockouts in cell therapy
cttgtgtgggactgagagg

SEQ ID NO: 14760 - DNA, 19 bp, Artificial Sequence
  Artificial sequence related to HLA knockouts in cell therapy
ttgtgtgggactgagaggc

SEQ ID NO: 14761 - DNA, 19 bp, Artificial Sequence
  Artificial sequence related to HLA knockouts in cell therapy
tgtgtgggactgagaggca

SEQ ID NO: 14762 - DNA, 19 bp, Artificial Sequence
  Artificial sequence related to HLA knockouts in cell therapy
gtgtgggactgagaggcaa

SEQ ID NO: 14763 - DNA, 19 bp, Artificial Sequence
  Artificial sequence related to HLA knockouts in cell therapy
tgtgggactgagaggcaag

SEQ ID NO: 14764 - DNA, 19 bp, Artificial Sequence
  Artificial sequence related to HLA knockouts in cell therapy
gtgggactgagaggcaaga

SEQ ID NO: 14765 - DNA, 19 bp, Artificial Sequence
  Artificial sequence related to HLA knockouts in cell therapy
tgggactgagaggcaagag

SEQ ID NO: 14766 - DNA, 19 bp, Artificial Sequence
  Artificial sequence related to HLA knockouts in cell therapy
gggactgagaggcaagagt

SEQ ID NO: 14767 - DNA, 19 bp, Artificial Sequence
  Artificial sequence related to HLA knockouts in cell therapy
ggactgagaggcaagagtt

SEQ ID NO: 14768 - DNA, 19 bp, Artificial Sequence
  Artificial sequence related to HLA knockouts in cell therapy
gactgagaggcaagagttg

SEQ ID NO: 14769 - DNA, 19 bp, Artificial Sequence
  Artificial sequence related to HLA knockouts in cell therapy
actgagaggcaagagttgt

SEQ ID NO: 14770 - DNA, 19 bp, Artificial Sequence
  Artificial sequence related to HLA knockouts in cell therapy
ctgagaggcaagagttgtt

SEQ ID NO: 14771 - DNA, 19 bp, Artificial Sequence
  Artificial sequence related to HLA knockouts in cell therapy
tgagaggcaagagttgttc

SEQ ID NO: 14772 - DNA, 19 bp, Artificial Sequence
  Artificial sequence related to HLA knockouts in cell therapy
gagaggcaagagttgttcc

SEQ ID NO: 14773 - DNA, 19 bp, Artificial Sequence
  Artificial sequence related to HLA knockouts in cell therapy
agaggcaagagttgttcct

SEQ ID NO: 14774 - DNA, 19 bp, Artificial Sequence
  Artificial sequence related to HLA knockouts in cell therapy
gaggcaagagttgttcctg

SEQ ID NO: 14775 - DNA, 19 bp, Artificial Sequence
  Artificial sequence related to HLA knockouts in cell therapy
aggcaagagttgttcctgc

SEQ ID NO: 14776 - DNA, 19 bp, Artificial Sequence
  Artificial sequence related to HLA knockouts in cell therapy
ggcaagagttgttcctgcc

SEQ ID NO: 14777 - DNA, 19 bp, Artificial Sequence
  Artificial sequence related to HLA knockouts in cell therapy
gcaagagttgttcctgccc

SEQ ID NO: 14778 - DNA, 19 bp, Artificial Sequence
  Artificial sequence related to HLA knockouts in cell therapy
caagagttgttcctgccct

SEQ ID NO: 14779 - DNA, 19 bp, Artificial Sequence
  Artificial sequence related to HLA knockouts in cell therapy
aagagttgttcctgccctt

SEQ ID NO: 14780 - DNA, 19 bp, Artificial Sequence
  Artificial sequence related to HLA knockouts in cell therapy
agagttgttcctgcccttc

SEQ ID NO: 14781 - DNA, 19 bp, Artificial Sequence
  Artificial sequence related to HLA knockouts in cell therapy
gagttgttcctgcccttcc

SEQ ID NO: 14782 - DNA, 19 bp, Artificial Sequence
  Artificial sequence related to HLA knockouts in cell therapy
agttgttcctgcccttccc

SEQ ID NO: 14783 - DNA, 19 bp, Artificial Sequence
  Artificial sequence related to HLA knockouts in cell therapy
gttgttcctgcccttccct

SEQ ID NO: 14784 - DNA, 19 bp, Artificial Sequence
  Artificial sequence related to HLA knockouts in cell therapy
ttgttcctgcccttccctt

SEQ ID NO: 14785 - DNA, 19 bp, Artificial Sequence
  Artificial sequence related to HLA knockouts in cell therapy
tgttcctgcccttcccttt

SEQ ID NO: 14786 - DNA, 19 bp, Artificial Sequence
  Artificial sequence related to HLA knockouts in cell therapy
gttcctgcccttccctttg

SEQ ID NO: 14787 - DNA, 19 bp, Artificial Sequence
  Artificial sequence related to HLA knockouts in cell therapy
ttcctgcccttccctttgt

SEQ ID NO: 14788 - DNA, 19 bp, Artificial Sequence
  Artificial sequence related to HLA knockouts in cell therapy
tcctgcccttccctttgtg

SEQ ID NO: 14789 - DNA, 19 bp, Artificial Sequence
  Artificial sequence related to HLA knockouts in cell therapy
cctgcccttccctttgtga

SEQ ID NO: 14790 - DNA, 19 bp, Artificial Sequence
  Artificial sequence related to HLA knockouts in cell therapy
ctgcccttccctttgtgac

SEQ ID NO: 14791 - DNA, 19 bp, Artificial Sequence
  Artificial sequence related to HLA knockouts in cell therapy
tgcccttccctttgtgact

SEQ ID NO: 14792 - DNA, 19 bp, Artificial Sequence
  Artificial sequence related to HLA knockouts in cell therapy
gcccttccctttgtgactt

SEQ ID NO: 14793 - DNA, 19 bp, Artificial Sequence
  Artificial sequence related to HLA knockouts in cell therapy
cccttccctttgtgacttg

SEQ ID NO: 14794 - DNA, 19 bp, Artificial Sequence
  Artificial sequence related to HLA knockouts in cell therapy
ccttccctttgtgacttga

SEQ ID NO: 14795 - DNA, 19 bp, Artificial Sequence
  Artificial sequence related to HLA knockouts in cell therapy
cttccctttgtgacttgaa

SEQ ID NO: 14796 - DNA, 19 bp, Artificial Sequence
  Artificial sequence related to HLA knockouts in cell therapy
ttccctttgtgacttgaag

SEQ ID NO: 14797 - DNA, 19 bp, Artificial Sequence
  Artificial sequence related to HLA knockouts in cell therapy
tccctttgtgacttgaaga

SEQ ID NO: 14798 - DNA, 19 bp, Artificial Sequence
  Artificial sequence related to HLA knockouts in cell therapy
ccctttgtgacttgaagaa

SEQ ID NO: 14799 - DNA, 19 bp, Artificial Sequence
  Artificial sequence related to HLA knockouts in cell therapy
cctttgtgacttgaagaac

SEQ ID NO: 14800 - DNA, 19 bp, Artificial Sequence
  Artificial sequence related to HLA knockouts in cell therapy
ctttgtgacttgaagaacc

SEQ ID NO: 14801 - DNA, 19 bp, Artificial Sequence
  Artificial sequence related to HLA knockouts in cell therapy
tttgtgacttgaagaaccc

SEQ ID NO: 14802 - DNA, 19 bp, Artificial Sequence
  Artificial sequence related to HLA knockouts in cell therapy
ttgtgacttgaagaaccct

SEQ ID NO: 14803 - DNA, 19 bp, Artificial Sequence
  Artificial sequence related to HLA knockouts in cell therapy
tgtgacttgaagaaccctg

SEQ ID NO: 14804 - DNA, 19 bp, Artificial Sequence
  Artificial sequence related to HLA knockouts in cell therapy
gtgacttgaagaaccctga

SEQ ID NO: 14805 - DNA, 19 bp, Artificial Sequence
  Artificial sequence related to HLA knockouts in cell therapy
tgacttgaagaaccctgac

SEQ ID NO: 14806 - DNA, 19 bp, Artificial Sequence
  Artificial sequence related to HLA knockouts in cell therapy
gacttgaagaaccctgact

SEQ ID NO: 14807 - DNA, 19 bp, Artificial Sequence
  Artificial sequence related to HLA knockouts in cell therapy
acttgaagaaccctgactt

SEQ ID NO: 14808 - DNA, 19 bp, Artificial Sequence
  Artificial sequence related to HLA knockouts in cell therapy
cttgaagaaccctgacttt

SEQ ID NO: 14809 - DNA, 19 bp, Artificial Sequence
  Artificial sequence related to HLA knockouts in cell therapy
ttgaagaaccctgactttg

SEQ ID NO: 14810 - DNA, 19 bp, Artificial Sequence
  Artificial sequence related to HLA knockouts in cell therapy
tgaagaaccctgactttgt

SEQ ID NO: 14811 - DNA, 19 bp, Artificial Sequence
  Artificial sequence related to HLA knockouts in cell therapy
gaagaaccctgactttgtt

SEQ ID NO: 14812 - DNA, 19 bp, Artificial Sequence
  Artificial sequence related to HLA knockouts in cell therapy
aagaaccctgactttgttt

SEQ ID NO: 14813 - DNA, 19 bp, Artificial Sequence
  Artificial sequence related to HLA knockouts in cell therapy
agaaccctgactttgtttc

SEQ ID NO: 14814 - DNA, 19 bp, Artificial Sequence
  Artificial sequence related to HLA knockouts in cell therapy
gaaccctgactttgtttct

SEQ ID NO: 14815 - DNA, 19 bp, Artificial Sequence
  Artificial sequence related to HLA knockouts in cell therapy
aaccctgactttgtttctg

SEQ ID NO: 14816 - DNA, 19 bp, Artificial Sequence
  Artificial sequence related to HLA knockouts in cell therapy
accctgactttgtttctgc

SEQ ID NO: 14817 - DNA, 19 bp, Artificial Sequence
  Artificial sequence related to HLA knockouts in cell therapy
ccctgactttgtttctgca

SEQ ID NO: 14818 - DNA, 19 bp, Artificial Sequence
  Artificial sequence related to HLA knockouts in cell therapy
cctgactttgtttctgcaa

SEQ ID NO: 14819 - DNA, 19 bp, Artificial Sequence
  Artificial sequence related to HLA knockouts in cell therapy
ctgactttgtttctgcaaa

SEQ ID NO: 14820 - DNA, 19 bp, Artificial Sequence
  Artificial sequence related to HLA knockouts in cell therapy
tgactttgtttctgcaaag

SEQ ID NO: 14821 - DNA, 19 bp, Artificial Sequence
  Artificial sequence related to HLA knockouts in cell therapy
gactttgtttctgcaaagg

SEQ ID NO: 14822 - DNA, 19 bp, Artificial Sequence
  Artificial sequence related to HLA knockouts in cell therapy
actttgtttctgcaaaggc

SEQ ID NO: 14823 - DNA, 19 bp, Artificial Sequence
  Artificial sequence related to HLA knockouts in cell therapy
ctttgtttctgcaaaggca

SEQ ID NO: 14824 - DNA, 19 bp, Artificial Sequence
  Artificial sequence related to HLA knockouts in cell therapy
tttgtttctgcaaaggcac

SEQ ID NO: 14825 - DNA, 19 bp, Artificial Sequence
  Artificial sequence related to HLA knockouts in cell therapy
ttgtttctgcaaaggcacc

SEQ ID NO: 14826 - DNA, 19 bp, Artificial Sequence
  Artificial sequence related to HLA knockouts in cell therapy
tgtttctgcaaaggcacct

SEQ ID NO: 14827 - DNA, 19 bp, Artificial Sequence
  Artificial sequence related to HLA knockouts in cell therapy
gtttctgcaaaggcacctg

SEQ ID NO: 14828 - DNA, 19 bp, Artificial Sequence
  Artificial sequence related to HLA knockouts in cell therapy
tttctgcaaaggcacctgc

SEQ ID NO: 14829 - DNA, 19 bp, Artificial Sequence
  Artificial sequence related to HLA knockouts in cell therapy
ttctgcaaaggcacctgca

SEQ ID NO: 14830 - DNA, 19 bp, Artificial Sequence
  Artificial sequence related to HLA knockouts in cell therapy
tctgcaaaggcacctgcat

SEQ ID NO: 14831 - DNA, 19 bp, Artificial Sequence
  Artificial sequence related to HLA knockouts in cell therapy
ctgcaaaggcacctgcatg

SEQ ID NO: 14832 - DNA, 19 bp, Artificial Sequence
  Artificial sequence related to HLA knockouts in cell therapy
tgcaaaggcacctgcatgt

SEQ ID NO: 14833 - DNA, 19 bp, Artificial Sequence
  Artificial sequence related to HLA knockouts in cell therapy
gcaaaggcacctgcatgtg

SEQ ID NO: 14834 - DNA, 19 bp, Artificial Sequence
  Artificial sequence related to HLA knockouts in cell therapy
caaaggcacctgcatgtgt

SEQ ID NO: 14835 - DNA, 19 bp, Artificial Sequence
  Artificial sequence related to HLA knockouts in cell therapy
aaaggcacctgcatgtgtc

SEQ ID NO: 14836 - DNA, 19 bp, Artificial Sequence
  Artificial sequence related to HLA knockouts in cell therapy
aaggcacctgcatgtgtct

SEQ ID NO: 14837 - DNA, 19 bp, Artificial Sequence
  Artificial sequence related to HLA knockouts in cell therapy
gcacctgcatgtgtctgtg

SEQ ID NO: 14838 - DNA, 19 bp, Artificial Sequence
  Artificial sequence related to HLA knockouts in cell therapy
cacctgcatgtgtctgtgt

SEQ ID NO: 14839 - DNA, 19 bp, Artificial Sequence
  Artificial sequence related to HLA knockouts in cell therapy
acctgcatgtgtctgtgtt

SEQ ID NO: 14840 - DNA, 19 bp, Artificial Sequence
  Artificial sequence related to HLA knockouts in cell therapy
cctgcatgtgtctgtgttc

SEQ ID NO: 14841 - DNA, 19 bp, Artificial Sequence
  Artificial sequence related to HLA knockouts in cell therapy
ctgcatgtgtctgtgttcg

SEQ ID NO: 14842 - DNA, 19 bp, Artificial Sequence
  Artificial sequence related to HLA knockouts in cell therapy
tgcatgtgtctgtgttcgt

SEQ ID NO: 14843 - DNA, 19 bp, Artificial Sequence
  Artificial sequence related to HLA knockouts in cell therapy
gcatgtgtctgtgttcgtg

SEQ ID NO: 14844 - DNA, 19 bp, Artificial Sequence
  Artificial sequence related to HLA knockouts in cell therapy
catgtgtctgtgttcgtgt

SEQ ID NO: 14845 - DNA, 19 bp, Artificial Sequence
  Artificial sequence related to HLA knockouts in cell therapy
atgtgtctgtgttcgtgta

SEQ ID NO: 14846 - DNA, 19 bp, Artificial Sequence
  Artificial sequence related to HLA knockouts in cell therapy
tgtgtctgtgttcgtgtag

SEQ ID NO: 14847 - DNA, 19 bp, Artificial Sequence
  Artificial sequence related to HLA knockouts in cell therapy
gtgtctgtgttcgtgtagg

SEQ ID NO: 14848 - DNA, 19 bp, Artificial Sequence
  Artificial sequence related to HLA knockouts in cell therapy
tgtctgtgttcgtgtaggc

SEQ ID NO: 14849 - DNA, 19 bp, Artificial Sequence
  Artificial sequence related to HLA knockouts in cell therapy
gtctgtgttcgtgtaggca

SEQ ID NO: 14850 - DNA, 19 bp, Artificial Sequence
  Artificial sequence related to HLA knockouts in cell therapy
tctgtgttcgtgtaggcat

SEQ ID NO: 14851 - DNA, 19 bp, Artificial Sequence
  Artificial sequence related to HLA knockouts in cell therapy
ctgtgttcgtgtaggcata

SEQ ID NO: 14852 - DNA, 19 bp, Artificial Sequence
  Artificial sequence related to HLA knockouts in cell therapy
tgtgttcgtgtaggcataa

SEQ ID NO: 14853 - DNA, 19 bp, Artificial Sequence
  Artificial sequence related to HLA knockouts in cell therapy
gtgttcgtgtaggcataat

SEQ ID NO: 14854 - DNA, 19 bp, Artificial Sequence
  Artificial sequence related to HLA knockouts in cell therapy
tgttcgtgtaggcataatg

SEQ ID NO: 14855 - DNA, 19 bp, Artificial Sequence
  Artificial sequence related to HLA knockouts in cell therapy
gttcgtgtaggcataatgt

SEQ ID NO: 14856 - DNA, 19 bp, Artificial Sequence
  Artificial sequence related to HLA knockouts in cell therapy
ttcgtgtaggcataatgtg

SEQ ID NO: 14857 - DNA, 19 bp, Artificial Sequence
  Artificial sequence related to HLA knockouts in cell therapy
tcgtgtaggcataatgtga

SEQ ID NO: 14858 - DNA, 19 bp, Artificial Sequence
  Artificial sequence related to HLA knockouts in cell therapy
cgtgtaggcataatgtgag

SEQ ID NO: 14859 - DNA, 19 bp, Artificial Sequence
  Artificial sequence related to HLA knockouts in cell therapy
gtgtaggcataatgtgagg

SEQ ID NO: 14860 - DNA, 19 bp, Artificial Sequence
  Artificial sequence related to HLA knockouts in cell therapy
tgtaggcataatgtgagga

SEQ ID NO: 14861 - DNA, 19 bp, Artificial Sequence
  Artificial sequence related to HLA knockouts in cell therapy
gtaggcataatgtgaggag

SEQ ID NO: 14862 - DNA, 19 bp, Artificial Sequence
  Artificial sequence related to HLA knockouts in cell therapy
taggcataatgtgaggagg

SEQ ID NO: 14863 - DNA, 19 bp, Artificial Sequence
  Artificial sequence related to HLA knockouts in cell therapy
aggcataatgtgaggaggt

SEQ ID NO: 14864 - DNA, 19 bp, Artificial Sequence
  Artificial sequence related to HLA knockouts in cell therapy
ggcataatgtgaggaggtg

SEQ ID NO: 14865 - DNA, 19 bp, Artificial Sequence
  Artificial sequence related to HLA knockouts in cell therapy
gcataatgtgaggaggtgg

SEQ ID NO: 14866 - DNA, 19 bp, Artificial Sequence
  Artificial sequence related to HLA knockouts in cell therapy
cataatgtgaggaggtggg

SEQ ID NO: 14867 - DNA, 19 bp, Artificial Sequence
  Artificial sequence related to HLA knockouts in cell therapy
ccatgtccaccatgaccct

SEQ ID NO: 14868 - DNA, 19 bp, Artificial Sequence
  Artificial sequence related to HLA knockouts in cell therapy
catgtccaccatgaccctc

SEQ ID NO: 14869 - DNA, 19 bp, Artificial Sequence
  Artificial sequence related to HLA knockouts in cell therapy
atgtccaccatgaccctct

SEQ ID NO: 14870 - DNA, 19 bp, Artificial Sequence
  Artificial sequence related to HLA knockouts in cell therapy
tgtccaccatgaccctctt

SEQ ID NO: 14871 - DNA, 19 bp, Artificial Sequence
  Artificial sequence related to HLA knockouts in cell therapy
gtccaccatgaccctcttc

SEQ ID NO: 14872 - DNA, 19 bp, Artificial Sequence
  Artificial sequence related to HLA knockouts in cell therapy
tccaccatgaccctcttcc

SEQ ID NO: 14873 - DNA, 19 bp, Artificial Sequence
  Artificial sequence related to HLA knockouts in cell therapy
caccatgaccctcttccca

SEQ ID NO: 14874 - DNA, 19 bp, Artificial Sequence
  Artificial sequence related to HLA knockouts in cell therapy
accatgaccctcttcccac

SEQ ID NO: 14875 - DNA, 19 bp, Artificial Sequence
  Artificial sequence related to HLA knockouts in cell therapy
atgaccctcttcccacgct

SEQ ID NO: 14876 - DNA, 19 bp, Artificial Sequence
  Artificial sequence related to HLA knockouts in cell therapy
tcttcccacgctgacctgt

SEQ ID NO: 14877 - DNA, 19 bp, Artificial Sequence
  Artificial sequence related to HLA knockouts in cell therapy
cccaatcatctttcctgtt

SEQ ID NO: 14878 - DNA, 19 bp, Artificial Sequence
  Artificial sequence related to HLA knockouts in cell therapy
ccaatcatctttcctgttc

SEQ ID NO: 14879 - DNA, 19 bp, Artificial Sequence
  Artificial sequence related to HLA knockouts in cell therapy
caatcatctttcctgttcc

SEQ ID NO: 14880 - DNA, 19 bp, Artificial Sequence
  Artificial sequence related to HLA knockouts in cell therapy
aatcatctttcctgttcca

SEQ ID NO: 14881 - DNA, 19 bp, Artificial Sequence
  Artificial sequence related to HLA knockouts in cell therapy
atcatctttcctgttccag

SEQ ID NO: 14882 - DNA, 19 bp, Artificial Sequence
  Artificial sequence related to HLA knockouts in cell therapy
catctttcctgttccagag

SEQ ID NO: 14883 - DNA, 19 bp, Artificial Sequence
  Artificial sequence related to HLA knockouts in cell therapy
atctttcctgttccagaga

SEQ ID NO: 14884 - DNA, 19 bp, Artificial Sequence
  Artificial sequence related to HLA knockouts in cell therapy
tctttcctgttccagagag

SEQ ID NO: 14885 - DNA, 19 bp, Artificial Sequence
  Artificial sequence related to HLA knockouts in cell therapy
ctttcctgttccagagagg

SEQ ID NO: 14886 - DNA, 19 bp, Artificial Sequence
  Artificial sequence related to HLA knockouts in cell therapy
tttcctgttccagagaggt

SEQ ID NO: 14887 - DNA, 19 bp, Artificial Sequence
  Artificial sequence related to HLA knockouts in cell therapy
ttcctgttccagagaggtg

SEQ ID NO: 14888 - DNA, 19 bp, Artificial Sequence
  Artificial sequence related to HLA knockouts in cell therapy
tcctgttccagagaggtgg

SEQ ID NO: 14889 - DNA, 19 bp, Artificial Sequence
  Artificial sequence related to HLA knockouts in cell therapy
ggctgaggtgtctccatct

SEQ ID NO: 14890 - DNA, 19 bp, Artificial Sequence
  Artificial sequence related to HLA knockouts in cell therapy
gctgaggtgtctccatctc

SEQ ID NO: 14891 - DNA, 19 bp, Artificial Sequence
  Artificial sequence related to HLA knockouts in cell therapy
ctgaggtgtctccatctct

SEQ ID NO: 14892 - DNA, 19 bp, Artificial Sequence
  Artificial sequence related to HLA knockouts in cell therapy
tgaggtgtctccatctctg

SEQ ID NO: 14893 - DNA, 19 bp, Artificial Sequence
  Artificial sequence related to HLA knockouts in cell therapy
gaggtgtctccatctctgt

SEQ ID NO: 14894 - DNA, 19 bp, Artificial Sequence
  Artificial sequence related to HLA knockouts in cell therapy
aggtgtctccatctctgtc

SEQ ID NO: 14895 - DNA, 19 bp, Artificial Sequence
  Artificial sequence related to HLA knockouts in cell therapy
ggtgtctccatctctgtct

SEQ ID NO: 14896 - DNA, 19 bp, Artificial Sequence
  Artificial sequence related to HLA knockouts in cell therapy
gtgtctccatctctgtctc

SEQ ID NO: 14897 - DNA, 19 bp, Artificial Sequence
  Artificial sequence related to HLA knockouts in cell therapy
tgtctccatctctgtctca

SEQ ID NO: 14898 - DNA, 19 bp, Artificial Sequence
  Artificial sequence related to HLA knockouts in cell therapy
gtctccatctctgtctcaa

SEQ ID NO: 14899 - DNA, 19 bp, Artificial Sequence
  Artificial sequence related to HLA knockouts in cell therapy
tctccatctctgtctcaac

SEQ ID NO: 14900 - DNA, 19 bp, Artificial Sequence
  Artificial sequence related to HLA knockouts in cell therapy
ctccatctctgtctcaact

SEQ ID NO: 14901 - DNA, 19 bp, Artificial Sequence
  Artificial sequence related to HLA knockouts in cell therapy
tccatctctgtctcaactt

SEQ ID NO: 14902 - DNA, 19 bp, Artificial Sequence
  Artificial sequence related to HLA knockouts in cell therapy
ccatctctgtctcaacttc

SEQ ID NO: 14903 - DNA, 19 bp, Artificial Sequence
  Artificial sequence related to HLA knockouts in cell therapy
catctctgtctcaacttca

SEQ ID NO: 14904 - DNA, 19 bp, Artificial Sequence
  Artificial sequence related to HLA knockouts in cell therapy
atctctgtctcaacttcat

SEQ ID NO: 14905 - DNA, 19 bp, Artificial Sequence
  Artificial sequence related to HLA knockouts in cell therapy
tctctgtctcaacttcatg

SEQ ID NO: 14906 - DNA, 19 bp, Artificial Sequence
  Artificial sequence related to HLA knockouts in cell therapy
ctctgtctcaacttcatgg

SEQ ID NO: 14907 - DNA, 19 bp, Artificial Sequence
  Artificial sequence related to HLA knockouts in cell therapy
tctgtctcaacttcatggt

SEQ ID NO: 14908 - DNA, 19 bp, Artificial Sequence
  Artificial sequence related to HLA knockouts in cell therapy
ctgtctcaacttcatggtg

SEQ ID NO: 14909 - DNA, 19 bp, Artificial Sequence
  Artificial sequence related to HLA knockouts in cell therapy
tgtctcaacttcatggtgc

SEQ ID NO: 14910 - DNA, 19 bp, Artificial Sequence
  Artificial sequence related to HLA knockouts in cell therapy
gtctcaacttcatggtgca

SEQ ID NO: 14911 - DNA, 19 bp, Artificial Sequence
  Artificial sequence related to HLA knockouts in cell therapy
tctcaacttcatggtgcac

SEQ ID NO: 14912 - DNA, 19 bp, Artificial Sequence
  Artificial sequence related to HLA knockouts in cell therapy
ctcaacttcatggtgcact

SEQ ID NO: 14913 - DNA, 19 bp, Artificial Sequence
  Artificial sequence related to HLA knockouts in cell therapy
tcaacttcatggtgcactg

SEQ ID NO: 14914 - DNA, 19 bp, Artificial Sequence
  Artificial sequence related to HLA knockouts in cell therapy
caacttcatggtgcactga

SEQ ID NO: 14915 - DNA, 19 bp, Artificial Sequence
  Artificial sequence related to HLA knockouts in cell therapy
aacttcatggtgcactgag

SEQ ID NO: 14916 - DNA, 19 bp, Artificial Sequence
  Artificial sequence related to HLA knockouts in cell therapy
acttcatggtgcactgagc

SEQ ID NO: 14917 - DNA, 19 bp, Artificial Sequence
  Artificial sequence related to HLA knockouts in cell therapy
cttcatggtgcactgagct

SEQ ID NO: 14918 - DNA, 19 bp, Artificial Sequence
  Artificial sequence related to HLA knockouts in cell therapy
ttcatggtgcactgagctg

SEQ ID NO: 14919 - DNA, 19 bp, Artificial Sequence
  Artificial sequence related to HLA knockouts in cell therapy
tcatggtgcactgagctgt

SEQ ID NO: 14920 - DNA, 19 bp, Artificial Sequence
  Artificial sequence related to HLA knockouts in cell therapy
catggtgcactgagctgta

SEQ ID NO: 14921 - DNA, 19 bp, Artificial Sequence
  Artificial sequence related to HLA knockouts in cell therapy
atggtgcactgagctgtaa

SEQ ID NO: 14922 - DNA, 19 bp, Artificial Sequence
  Artificial sequence related to HLA knockouts in cell therapy
tggtgcactgagctgtaac

SEQ ID NO: 14923 - DNA, 19 bp, Artificial Sequence
  Artificial sequence related to HLA knockouts in cell therapy
ggtgcactgagctgtaact

SEQ ID NO: 14924 - DNA, 19 bp, Artificial Sequence
  Artificial sequence related to HLA knockouts in cell therapy
gtgcactgagctgtaactt

SEQ ID NO: 14925 - DNA, 19 bp, Artificial Sequence
  Artificial sequence related to HLA knockouts in cell therapy
tgcactgagctgtaacttc

SEQ ID NO: 14926 - DNA, 19 bp, Artificial Sequence
  Artificial sequence related to HLA knockouts in cell therapy
gcactgagctgtaacttct

SEQ ID NO: 14927 - DNA, 19 bp, Artificial Sequence
  Artificial sequence related to HLA knockouts in cell therapy
cactgagctgtaacttctt

SEQ ID NO: 14928 - DNA, 19 bp, Artificial Sequence
  Artificial sequence related to HLA knockouts in cell therapy
actgagctgtaacttcttc

SEQ ID NO: 14929 - DNA, 19 bp, Artificial Sequence
  Artificial sequence related to HLA knockouts in cell therapy
ctgagctgtaacttcttcc

SEQ ID NO: 14930 - DNA, 19 bp, Artificial Sequence
  Artificial sequence related to HLA knockouts in cell therapy
tgagctgtaacttcttcct

SEQ ID NO: 14931 - DNA, 19 bp, Artificial Sequence
  Artificial sequence related to HLA knockouts in cell therapy
gagctgtaacttcttcctt

SEQ ID NO: 14932 - DNA, 19 bp, Artificial Sequence
  Artificial sequence related to HLA knockouts in cell therapy
agctgtaacttcttccttc

SEQ ID NO: 14933 - DNA, 19 bp, Artificial Sequence
  Artificial sequence related to HLA knockouts in cell therapy
gctgtaacttcttccttcc

SEQ ID NO: 14934 - DNA, 19 bp, Artificial Sequence
  Artificial sequence related to HLA knockouts in cell therapy
ctgtaacttcttccttccc

SEQ ID NO: 14935 - DNA, 19 bp, Artificial Sequence
  Artificial sequence related to HLA knockouts in cell therapy
tgtaacttcttccttccct

SEQ ID NO: 14936 - DNA, 19 bp, Artificial Sequence
  Artificial sequence related to HLA knockouts in cell therapy
gtaacttcttccttcccta

SEQ ID NO: 14937 - DNA, 19 bp, Artificial Sequence
  Artificial sequence related to HLA knockouts in cell therapy
taacttcttccttccctat

SEQ ID NO: 14938 - DNA, 19 bp, Artificial Sequence
  Artificial sequence related to HLA knockouts in cell therapy
aacttcttccttccctatt

SEQ ID NO: 14939 - DNA, 19 bp, Artificial Sequence
  Artificial sequence related to HLA knockouts in cell therapy
acttcttccttccctatta

SEQ ID NO: 14940 - DNA, 19 bp, Artificial Sequence
  Artificial sequence related to HLA knockouts in cell therapy
cttcttccttccctattaa

SEQ ID NO: 14941 - DNA, 19 bp, Artificial Sequence
  Artificial sequence related to HLA knockouts in cell therapy
ttcttccttccctattaaa

SEQ ID NO: 14942 - DNA, 20 bp, Artificial Sequence
  Artificial sequence related to HLA knockouts in cell therapy
ccgaaggcggtgtatggatt

SEQ ID NO: 14943 - DNA, 20 bp, Artificial Sequence
  Artificial sequence related to HLA knockouts in cell therapy
cgaaggcggtgtatggattg

SEQ ID NO: 14944 - DNA, 20 bp, Artificial Sequence
  Artificial sequence related to HLA knockouts in cell therapy
gaaggcggtgtatggattgg

SEQ ID NO: 14945 - DNA, 20 bp, Artificial Sequence
  Artificial sequence related to HLA knockouts in cell therapy
aaggcggtgtatggattggg

SEQ ID NO: 14946 - DNA, 20 bp, Artificial Sequence
  Artificial sequence related to HLA knockouts in cell therapy
cccaactccgcagtttcttt

SEQ ID NO: 14947 - DNA, 20 bp, Artificial Sequence
  Artificial sequence related to HLA knockouts in cell therapy
tttctccctctcccaaccta

SEQ ID NO: 14948 - DNA, 20 bp, Artificial Sequence
  Artificial sequence related to HLA knockouts in cell therapy
ttctccctctcccaacctat

SEQ ID NO: 14949 - DNA, 20 bp, Artificial Sequence
  Artificial sequence related to HLA knockouts in cell therapy
tctccctctcccaacctatg

SEQ ID NO: 14950 - DNA, 20 bp, Artificial Sequence
  Artificial sequence related to HLA knockouts in cell therapy
ctccctctcccaacctatgt

SEQ ID NO: 14951 - DNA, 20 bp, Artificial Sequence
  Artificial sequence related to HLA knockouts in cell therapy
tccctctcccaacctatgta

SEQ ID NO: 14952 - DNA, 20 bp, Artificial Sequence
  Artificial sequence related to HLA knockouts in cell therapy
ccctctcccaacctatgtag

SEQ ID NO: 14953 - DNA, 20 bp, Artificial Sequence
  Artificial sequence related to HLA knockouts in cell therapy
cctctcccaacctatgtagg

SEQ ID NO: 14954 - DNA, 20 bp, Artificial Sequence
  Artificial sequence related to HLA knockouts in cell therapy
ctctcccaacctatgtaggg

SEQ ID NO: 14955 - DNA, 20 bp, Artificial Sequence
  Artificial sequence related to HLA knockouts in cell therapy
tctcccaacctatgtagggt

SEQ ID NO: 14956 - DNA, 20 bp, Artificial Sequence
  Artificial sequence related to HLA knockouts in cell therapy
ctcccaacctatgtagggtc

SEQ ID NO: 14957 - DNA, 20 bp, Artificial Sequence
  Artificial sequence related to HLA knockouts in cell therapy
tcccaacctatgtagggtcc

SEQ ID NO: 14958 - DNA, 20 bp, Artificial Sequence
  Artificial sequence related to HLA knockouts in cell therapy
cccaacctatgtagggtcct

SEQ ID NO: 14959 - DNA, 20 bp, Artificial Sequence
  Artificial sequence related to HLA knockouts in cell therapy
ccaacctatgtagggtcctt

SEQ ID NO: 14960 - DNA, 20 bp, Artificial Sequence
  Artificial sequence related to HLA knockouts in cell therapy
caacctatgtagggtccttc

SEQ ID NO: 14961 - DNA, 20 bp, Artificial Sequence
  Artificial sequence related to HLA knockouts in cell therapy
aacctatgtagggtccttct

SEQ ID NO: 14962 - DNA, 20 bp, Artificial Sequence
  Artificial sequence related to HLA knockouts in cell therapy
acctatgtagggtccttctt

SEQ ID NO: 14963 - DNA, 20 bp, Artificial Sequence
  Artificial sequence related to HLA knockouts in cell therapy
cctatgtagggtccttcttc

SEQ ID NO: 14964 - DNA, 20 bp, Artificial Sequence
  Artificial sequence related to HLA knockouts in cell therapy
ctatgtagggtccttcttcc

SEQ ID NO: 14965 - DNA, 20 bp, Artificial Sequence
  Artificial sequence related to HLA knockouts in cell therapy
tatgtagggtccttcttcct

SEQ ID NO: 14966 - DNA, 20 bp, Artificial Sequence
  Artificial sequence related to HLA knockouts in cell therapy
atgtagggtccttcttcctg

SEQ ID NO: 14967 - DNA, 20 bp, Artificial Sequence
  Artificial sequence related to HLA knockouts in cell therapy
tgtagggtccttcttcctgg

SEQ ID NO: 14968 - DNA, 20 bp, Artificial Sequence
  Artificial sequence related to HLA knockouts in cell therapy
gtagggtccttcttcctgga

SEQ ID NO: 14969 - DNA, 20 bp, Artificial Sequence
  Artificial sequence related to HLA knockouts in cell therapy
tagggtccttcttcctggat

SEQ ID NO: 14970 - DNA, 20 bp, Artificial Sequence
  Artificial sequence related to HLA knockouts in cell therapy
agggtccttcttcctggata

SEQ ID NO: 14971 - DNA, 20 bp, Artificial Sequence
  Artificial sequence related to HLA knockouts in cell therapy
gggtccttcttcctggatac

SEQ ID NO: 14972 - DNA, 20 bp, Artificial Sequence
  Artificial sequence related to HLA knockouts in cell therapy
ggtccttcttcctggatact

SEQ ID NO: 14973 - DNA, 20 bp, Artificial Sequence
  Artificial sequence related to HLA knockouts in cell therapy
gtccttcttcctggatactc

SEQ ID NO: 14974 - DNA, 20 bp, Artificial Sequence
  Artificial sequence related to HLA knockouts in cell therapy
tccttcttcctggatactca

SEQ ID NO: 14975 - DNA, 20 bp, Artificial Sequence
  Artificial sequence related to HLA knockouts in cell therapy
ccttcttcctggatactcac

SEQ ID NO: 14976 - DNA, 20 bp, Artificial Sequence
  Artificial sequence related to HLA knockouts in cell therapy
cttcttcctggatactcacg

SEQ ID NO: 14977 - DNA, 20 bp, Artificial Sequence
  Artificial sequence related to HLA knockouts in cell therapy
ttcttcctggatactcacga

SEQ ID NO: 14978 - DNA, 20 bp, Artificial Sequence
  Artificial sequence related to HLA knockouts in cell therapy
tcttcctggatactcacgac

SEQ ID NO: 14979 - DNA, 20 bp, Artificial Sequence
  Artificial sequence related to HLA knockouts in cell therapy
cttcctggatactcacgacg

SEQ ID NO: 14980 - DNA, 20 bp, Artificial Sequence
  Artificial sequence related to HLA knockouts in cell therapy
ttcctggatactcacgacgc

SEQ ID NO: 14981 - DNA, 20 bp, Artificial Sequence
  Artificial sequence related to HLA knockouts in cell therapy
gacccagttctcactcccat

SEQ ID NO: 14982 - DNA, 20 bp, Artificial Sequence
  Artificial sequence related to HLA knockouts in cell therapy
acccagttctcactcccatt

SEQ ID NO: 14983 - DNA, 20 bp, Artificial Sequence
  Artificial sequence related to HLA knockouts in cell therapy
cccagttctcactcccattg

SEQ ID NO: 14984 - DNA, 20 bp, Artificial Sequence
  Artificial sequence related to HLA knockouts in cell therapy
ccagttctcactcccattgg

SEQ ID NO: 14985 - DNA, 20 bp, Artificial Sequence
  Artificial sequence related to HLA knockouts in cell therapy
cagttctcactcccattggg

SEQ ID NO: 14986 - DNA, 20 bp, Artificial Sequence
  Artificial sequence related to HLA knockouts in cell therapy
agttctcactcccattgggt

SEQ ID NO: 14987 - DNA, 20 bp, Artificial Sequence
  Artificial sequence related to HLA knockouts in cell therapy
gttctcactcccattgggtg

SEQ ID NO: 14988 - DNA, 20 bp, Artificial Sequence
  Artificial sequence related to HLA knockouts in cell therapy
ttctcactcccattgggtgt

SEQ ID NO: 14989 - DNA, 20 bp, Artificial Sequence
  Artificial sequence related to HLA knockouts in cell therapy
tctcactcccattgggtgtc

SEQ ID NO: 14990 - DNA, 20 bp, Artificial Sequence
  Artificial sequence related to HLA knockouts in cell therapy
tcccattgggtgtcgggttt

SEQ ID NO: 14991 - DNA, 20 bp, Artificial Sequence
  Artificial sequence related to HLA knockouts in cell therapy
cattgggtgtcgggtttcca

SEQ ID NO: 14992 - DNA, 20 bp, Artificial Sequence
  Artificial sequence related to HLA knockouts in cell therapy
attgggtgtcgggtttccag

SEQ ID NO: 14993 - DNA, 20 bp, Artificial Sequence
  Artificial sequence related to HLA knockouts in cell therapy
ttgggtgtcgggtttccaga

SEQ ID NO: 14994 - DNA, 20 bp, Artificial Sequence
  Artificial sequence related to HLA knockouts in cell therapy
ggtgtcgggtttccagagaa

SEQ ID NO: 14995 - DNA, 20 bp, Artificial Sequence
  Artificial sequence related to HLA knockouts in cell therapy
gtgtcgggtttccagagaag

SEQ ID NO: 14996 - DNA, 20 bp, Artificial Sequence
  Artificial sequence related to HLA knockouts in cell therapy
tgtcgggtttccagagaagc

SEQ ID NO: 14997 - DNA, 20 bp, Artificial Sequence
  Artificial sequence related to HLA knockouts in cell therapy
tcgggtttccagagaagcca

SEQ ID NO: 14998 - DNA, 20 bp, Artificial Sequence
  Artificial sequence related to HLA knockouts in cell therapy
cgggtttccagagaagccaa

SEQ ID NO: 14999 - DNA, 20 bp, Artificial Sequence
  Artificial sequence related to HLA knockouts in cell therapy
gggtttccagagaagccaat

SEQ ID NO: 15000 - DNA, 20 bp, Artificial Sequence
  Artificial sequence related to HLA knockouts in cell therapy
ggtttccagagaagccaatc

SEQ ID NO: 15001 - DNA, 20 bp, Artificial Sequence
  Artificial sequence related to HLA knockouts in cell therapy
gtttccagagaagccaatca

SEQ ID NO: 15002 - DNA, 20 bp, Artificial Sequence
  Artificial sequence related to HLA knockouts in cell therapy
tttccagagaagccaatcag

SEQ ID NO: 15003 - DNA, 20 bp, Artificial Sequence
  Artificial sequence related to HLA knockouts in cell therapy
ttccagagaagccaatcagt

SEQ ID NO: 15004 - DNA, 20 bp, Artificial Sequence
  Artificial sequence related to HLA knockouts in cell therapy
tccagagaagccaatcagtg

SEQ ID NO: 15005 - DNA, 20 bp, Artificial Sequence
  Artificial sequence related to HLA knockouts in cell therapy
ccagagaagccaatcagtgt

SEQ ID NO: 15006 - DNA, 20 bp, Artificial Sequence
  Artificial sequence related to HLA knockouts in cell therapy
cagagaagccaatcagtgtc

SEQ ID NO: 15007 - DNA, 20 bp, Artificial Sequence
  Artificial sequence related to HLA knockouts in cell therapy
agagaagccaatcagtgtcg

SEQ ID NO: 15008 - DNA, 20 bp, Artificial Sequence
  Artificial sequence related to HLA knockouts in cell therapy
gagaagccaatcagtgtcgt

SEQ ID NO: 15009 - DNA, 20 bp, Artificial Sequence
  Artificial sequence related to HLA knockouts in cell therapy
agaagccaatcagtgtcgtc

SEQ ID NO: 15010 - DNA, 20 bp, Artificial Sequence
  Artificial sequence related to HLA knockouts in cell therapy
gaagccaatcagtgtcgtcg

SEQ ID NO: 15011 - DNA, 20 bp, Artificial Sequence
  Artificial sequence related to HLA knockouts in cell therapy
aagccaatcagtgtcgtcgc

SEQ ID NO: 15012 - DNA, 20 bp, Artificial Sequence
  Artificial sequence related to HLA knockouts in cell therapy
tcgcggttctaaagtccgca

SEQ ID NO: 15013 - DNA, 20 bp, Artificial Sequence
  Artificial sequence related to HLA knockouts in cell therapy
ggttctaaagtccgcacgca

SEQ ID NO: 15014 - DNA, 20 bp, Artificial Sequence
  Artificial sequence related to HLA knockouts in cell therapy
gttctaaagtccgcacgcac

SEQ ID NO: 15015 - DNA, 20 bp, Artificial Sequence
  Artificial sequence related to HLA knockouts in cell therapy
ttctaaagtccgcacgcacc

SEQ ID NO: 15016 - DNA, 20 bp, Artificial Sequence
  Artificial sequence related to HLA knockouts in cell therapy
aaccctcgtcctgctactct

SEQ ID NO: 15017 - DNA, 20 bp, Artificial Sequence
  Artificial sequence related to HLA knockouts in cell therapy
ggctctcactccatgaggta

SEQ ID NO: 15018 - DNA, 20 bp, Artificial Sequence
  Artificial sequence related to HLA knockouts in cell therapy
gctctcactccatgaggtat

SEQ ID NO: 15019 - DNA, 20 bp, Artificial Sequence
  Artificial sequence related to HLA knockouts in cell therapy
ctctcactccatgaggtatt

SEQ ID NO: 15020 - DNA, 20 bp, Artificial Sequence
  Artificial sequence related to HLA knockouts in cell therapy
tctcactccatgaggtattt

SEQ ID NO: 15021 - DNA, 20 bp, Artificial Sequence
  Artificial sequence related to HLA knockouts in cell therapy
ctcactccatgaggtatttc

SEQ ID NO: 15022 - DNA, 20 bp, Artificial Sequence
  Artificial sequence related to HLA knockouts in cell therapy
tcactccatgaggtatttct

SEQ ID NO: 15023 - DNA, 20 bp, Artificial Sequence
  Artificial sequence related to HLA knockouts in cell therapy
cactccatgaggtatttctt

SEQ ID NO: 15024 - DNA, 20 bp, Artificial Sequence
  Artificial sequence related to HLA knockouts in cell therapy
actccatgaggtatttcttc

SEQ ID NO: 15025 - DNA, 20 bp, Artificial Sequence
  Artificial sequence related to HLA knockouts in cell therapy
ctccatgaggtatttcttca

SEQ ID NO: 15026 - DNA, 20 bp, Artificial Sequence
  Artificial sequence related to HLA knockouts in cell therapy
tccatgaggtatttcttcac

SEQ ID NO: 15027 - DNA, 20 bp, Artificial Sequence
  Artificial sequence related to HLA knockouts in cell therapy
ccatgaggtatttcttcaca

SEQ ID NO: 15028 - DNA, 20 bp, Artificial Sequence
  Artificial sequence related to HLA knockouts in cell therapy
catgaggtatttcttcacat

SEQ ID NO: 15029 - DNA, 20 bp, Artificial Sequence
  Artificial sequence related to HLA knockouts in cell therapy
atgaggtatttcttcacatc

SEQ ID NO: 15030 - DNA, 20 bp, Artificial Sequence
  Artificial sequence related to HLA knockouts in cell therapy
tgaggtatttcttcacatcc

SEQ ID NO: 15031 - DNA, 20 bp, Artificial Sequence
  Artificial sequence related to HLA knockouts in cell therapy
gaggtatttcttcacatccg

SEQ ID NO: 15032 - DNA, 20 bp, Artificial Sequence
  Artificial sequence related to HLA knockouts in cell therapy
aggtatttcttcacatccgt

SEQ ID NO: 15033 - DNA, 20 bp, Artificial Sequence
  Artificial sequence related to HLA knockouts in cell therapy
ggtatttcttcacatccgtg

SEQ ID NO: 15034 - DNA, 20 bp, Artificial Sequence
  Artificial sequence related to HLA knockouts in cell therapy
gtatttcttcacatccgtgt

SEQ ID NO: 15035 - DNA, 20 bp, Artificial Sequence
  Artificial sequence related to HLA knockouts in cell therapy
tatttcttcacatccgtgtc

SEQ ID NO: 15036 - DNA, 20 bp, Artificial Sequence
  Artificial sequence related to HLA knockouts in cell therapy
atttcttcacatccgtgtcc

SEQ ID NO: 15037 - DNA, 20 bp, Artificial Sequence
  Artificial sequence related to HLA knockouts in cell therapy
tttcttcacatccgtgtccc

SEQ ID NO: 15038 - DNA, 20 bp, Artificial Sequence
  Artificial sequence related to HLA knockouts in cell therapy
ttcttcacatccgtgtcccg

SEQ ID NO: 15039 - DNA, 20 bp, Artificial Sequence
  Artificial sequence related to HLA knockouts in cell therapy
ttcatcgcagtgggctacgt

SEQ ID NO: 15040 - DNA, 20 bp, Artificial Sequence
  Artificial sequence related to HLA knockouts in cell therapy
tacgtggacgacacgcagtt

SEQ ID NO: 15041 - DNA, 20 bp, Artificial Sequence
  Artificial sequence related to HLA knockouts in cell therapy
gggagacacggaaagtgaag

SEQ ID NO: 15042 - DNA, 20 bp, Artificial Sequence
  Artificial sequence related to HLA knockouts in cell therapy
ggagacacggaaagtgaagg

SEQ ID NO: 15043 - DNA, 20 bp, Artificial Sequence
  Artificial sequence related to HLA knockouts in cell therapy
gagacacggaaagtgaaggc

SEQ ID NO: 15044 - DNA, 20 bp, Artificial Sequence
  Artificial sequence related to HLA knockouts in cell therapy
agacacggaaagtgaaggcc

SEQ ID NO: 15045 - DNA, 20 bp, Artificial Sequence
  Artificial sequence related to HLA knockouts in cell therapy
acacggaaagtgaaggccca

SEQ ID NO: 15046 - DNA, 20 bp, Artificial Sequence
  Artificial sequence related to HLA knockouts in cell therapy
acggaaagtgaaggcccact

SEQ ID NO: 15047 - DNA, 20 bp, Artificial Sequence
  Artificial sequence related to HLA knockouts in cell therapy
ggaaagtgaaggcccactca

SEQ ID NO: 15048 - DNA, 20 bp, Artificial Sequence
  Artificial sequence related to HLA knockouts in cell therapy
gaaagtgaaggcccactcac

SEQ ID NO: 15049 - DNA, 20 bp, Artificial Sequence
  Artificial sequence related to HLA knockouts in cell therapy
aaagtgaaggcccactcaca

SEQ ID NO: 15050 - DNA, 20 bp, Artificial Sequence
  Artificial sequence related to HLA knockouts in cell therapy
aagtgaaggcccactcacag

SEQ ID NO: 15051 - DNA, 20 bp, Artificial Sequence
  Artificial sequence related to HLA knockouts in cell therapy
agtgaaggcccactcacaga

SEQ ID NO: 15052 - DNA, 20 bp, Artificial Sequence
  Artificial sequence related to HLA knockouts in cell therapy
tgaaggcccactcacagact

SEQ ID NO: 15053 - DNA, 20 bp, Artificial Sequence
  Artificial sequence related to HLA knockouts in cell therapy
aaggcccactcacagactca

SEQ ID NO: 15054 - DNA, 20 bp, Artificial Sequence
  Artificial sequence related to HLA knockouts in cell therapy
cactcacagactcaccgagt

SEQ ID NO: 15055 - DNA, 20 bp, Artificial Sequence
  Artificial sequence related to HLA knockouts in cell therapy
actcacagactcaccgagtg

SEQ ID NO: 15056 - DNA, 20 bp, Artificial Sequence
  Artificial sequence related to HLA knockouts in cell therapy
tcacagactcaccgagtgga

SEQ ID NO: 15057 - DNA, 20 bp, Artificial Sequence
  Artificial sequence related to HLA knockouts in cell therapy
ggctactacaaccagagcga

SEQ ID NO: 15058 - DNA, 20 bp, Artificial Sequence
  Artificial sequence related to HLA knockouts in cell therapy
ctactacaaccagagcgagg

SEQ ID NO: 15059 - DNA, 20 bp, Artificial Sequence
  Artificial sequence related to HLA knockouts in cell therapy
tactacaaccagagcgaggc

SEQ ID NO: 15060 - DNA, 20 bp, Artificial Sequence
  Artificial sequence related to HLA knockouts in cell therapy
ttctcacaccgtccagagga

SEQ ID NO: 15061 - DNA, 20 bp, Artificial Sequence
  Artificial sequence related to HLA knockouts in cell therapy
tctcacaccgtccagaggat

SEQ ID NO: 15062 - DNA, 20 bp, Artificial Sequence
  Artificial sequence related to HLA knockouts in cell therapy
tcacaccgtccagaggatgt

SEQ ID NO: 15063 - DNA, 20 bp, Artificial Sequence
  Artificial sequence related to HLA knockouts in cell therapy
cacaccgtccagaggatgta

SEQ ID NO: 15064 - DNA, 20 bp, Artificial Sequence
  Artificial sequence related to HLA knockouts in cell therapy
acaccgtccagaggatgtat

SEQ ID NO: 15065 - DNA, 20 bp, Artificial Sequence
  Artificial sequence related to HLA knockouts in cell therapy
caccgtccagaggatgtatg

SEQ ID NO: 15066 - DNA, 20 bp, Artificial Sequence
  Artificial sequence related to HLA knockouts in cell therapy
accgtccagaggatgtatgg

SEQ ID NO: 15067 - DNA, 20 bp, Artificial Sequence
  Artificial sequence related to HLA knockouts in cell therapy
cgtccagaggatgtatggct

SEQ ID NO: 15068 - DNA, 20 bp, Artificial Sequence
  Artificial sequence related to HLA knockouts in cell therapy
gtccagaggatgtatggctg

SEQ ID NO: 15069 - DNA, 20 bp, Artificial Sequence
  Artificial sequence related to HLA knockouts in cell therapy
tccagaggatgtatggctgc

SEQ ID NO: 15070 - DNA, 20 bp, Artificial Sequence
  Artificial sequence related to HLA knockouts in cell therapy
cagaggatgtatggctgcga

SEQ ID NO: 15071 - DNA, 20 bp, Artificial Sequence
  Artificial sequence related to HLA knockouts in cell therapy
agaggatgtatggctgcgac

SEQ ID NO: 15072 - DNA, 20 bp, Artificial Sequence
  Artificial sequence related to HLA knockouts in cell therapy
aggatgtatggctgcgacgt

SEQ ID NO: 15073 - DNA, 20 bp, Artificial Sequence
  Artificial sequence related to HLA knockouts in cell therapy
taccaccagtacgcctacga

SEQ ID NO: 15074 - DNA, 20 bp, Artificial Sequence
  Artificial sequence related to HLA knockouts in cell therapy
gcctacgacggcaaggatta

SEQ ID NO: 15075 - DNA, 20 bp, Artificial Sequence
  Artificial sequence related to HLA knockouts in cell therapy
cctacgacggcaaggattac

SEQ ID NO: 15076 - DNA, 20 bp, Artificial Sequence
  Artificial sequence related to HLA knockouts in cell therapy
ctacgacggcaaggattaca

SEQ ID NO: 15077 - DNA, 20 bp, Artificial Sequence
  Artificial sequence related to HLA knockouts in cell therapy
tacgacggcaaggattacat

SEQ ID NO: 15078 - DNA, 20 bp, Artificial Sequence
  Artificial sequence related to HLA knockouts in cell therapy
acgacggcaaggattacatc

SEQ ID NO: 15079 - DNA, 20 bp, Artificial Sequence
  Artificial sequence related to HLA knockouts in cell therapy
cgacggcaaggattacatcg

SEQ ID NO: 15080 - DNA, 20 bp, Artificial Sequence
  Artificial sequence related to HLA knockouts in cell therapy
gacggcaaggattacatcgc

SEQ ID NO: 15081 - DNA, 20 bp, Artificial Sequence
  Artificial sequence related to HLA knockouts in cell therapy
acggcaaggattacatcgcc

SEQ ID NO: 15082 - DNA, 20 bp, Artificial Sequence
  Artificial sequence related to HLA knockouts in cell therapy
ggcaaggattacatcgccct

SEQ ID NO: 15083 - DNA, 20 bp, Artificial Sequence
  Artificial sequence related to HLA knockouts in cell therapy
gcaaggattacatcgccctg

SEQ ID NO: 15084 - DNA, 20 bp, Artificial Sequence
  Artificial sequence related to HLA knockouts in cell therapy
caaggattacatcgccctga

SEQ ID NO: 15085 - DNA, 20 bp, Artificial Sequence
  Artificial sequence related to HLA knockouts in cell therapy
aaggattacatcgccctgaa

SEQ ID NO: 15086 - DNA, 20 bp, Artificial Sequence
  Artificial sequence related to HLA knockouts in cell therapy
aggattacatcgccctgaaa

SEQ ID NO: 15087 - DNA, 20 bp, Artificial Sequence
  Artificial sequence related to HLA knockouts in cell therapy
gattacatcgccctgaaaga

SEQ ID NO: 15088 - DNA, 20 bp, Artificial Sequence
  Artificial sequence related to HLA knockouts in cell therapy
attacatcgccctgaaagag

SEQ ID NO: 15089 - DNA, 20 bp, Artificial Sequence
  Artificial sequence related to HLA knockouts in cell therapy
ttacatcgccctgaaagagg

SEQ ID NO: 15090 - DNA, 20 bp, Artificial Sequence
  Artificial sequence related to HLA knockouts in cell therapy
tacatcgccctgaaagagga

SEQ ID NO: 15091 - DNA, 20 bp, Artificial Sequence
  Artificial sequence related to HLA knockouts in cell therapy
acatcgccctgaaagaggac

SEQ ID NO: 15092 - DNA, 20 bp, Artificial Sequence
  Artificial sequence related to HLA knockouts in cell therapy
atcgccctgaaagaggacct

SEQ ID NO: 15093 - DNA, 20 bp, Artificial Sequence
  Artificial sequence related to HLA knockouts in cell therapy
tgaaagaggacctgcgctct

SEQ ID NO: 15094 - DNA, 20 bp, Artificial Sequence
  Artificial sequence related to HLA knockouts in cell therapy
gaaagaggacctgcgctctt

SEQ ID NO: 15095 - DNA, 20 bp, Artificial Sequence
  Artificial sequence related to HLA knockouts in cell therapy
aaagaggacctgcgctcttg

SEQ ID NO: 15096 - DNA, 20 bp, Artificial Sequence
  Artificial sequence related to HLA knockouts in cell therapy
atggcagctcagaccaccaa

SEQ ID NO: 15097 - DNA, 20 bp, Artificial Sequence
  Artificial sequence related to HLA knockouts in cell therapy
agctcagaccaccaagcaca

SEQ ID NO: 15098 - DNA, 20 bp, Artificial Sequence
  Artificial sequence related to HLA knockouts in cell therapy
gctcagaccaccaagcacaa

SEQ ID NO: 15099 - DNA, 20 bp, Artificial Sequence
  Artificial sequence related to HLA knockouts in cell therapy
ctcagaccaccaagcacaag

SEQ ID NO: 15100 - DNA, 20 bp, Artificial Sequence
  Artificial sequence related to HLA knockouts in cell therapy
tcagaccaccaagcacaagt

SEQ ID NO: 15101 - DNA, 20 bp, Artificial Sequence
  Artificial sequence related to HLA knockouts in cell therapy
cagaccaccaagcacaagtg

SEQ ID NO: 15102 - DNA, 20 bp, Artificial Sequence
  Artificial sequence related to HLA knockouts in cell therapy
agaccaccaagcacaagtgg

SEQ ID NO: 15103 - DNA, 20 bp, Artificial Sequence
  Artificial sequence related to HLA knockouts in cell therapy
accaccaagcacaagtggga

SEQ ID NO: 15104 - DNA, 20 bp, Artificial Sequence
  Artificial sequence related to HLA knockouts in cell therapy
atgtggcggagcagttgaga

SEQ ID NO: 15105 - DNA, 20 bp, Artificial Sequence
  Artificial sequence related to HLA knockouts in cell therapy
gagcagttgagagcctacct

SEQ ID NO: 15106 - DNA, 20 bp, Artificial Sequence
  Artificial sequence related to HLA knockouts in cell therapy
agcagttgagagcctacctg

SEQ ID NO: 15107 - DNA, 20 bp, Artificial Sequence
  Artificial sequence related to HLA knockouts in cell therapy
cagttgagagcctacctgga

SEQ ID NO: 15108 - DNA, 20 bp, Artificial Sequence
  Artificial sequence related to HLA knockouts in cell therapy
agttgagagcctacctggag

SEQ ID NO: 15109 - DNA, 20 bp, Artificial Sequence
  Artificial sequence related to HLA knockouts in cell therapy
ctccgcagatacctggagaa

SEQ ID NO: 15110 - DNA, 20 bp, Artificial Sequence
  Artificial sequence related to HLA knockouts in cell therapy
tccgcagatacctggagaac

SEQ ID NO: 15111 - DNA, 20 bp, Artificial Sequence
  Artificial sequence related to HLA knockouts in cell therapy
cagatacctggagaacggga

SEQ ID NO: 15112 - DNA, 20 bp, Artificial Sequence
  Artificial sequence related to HLA knockouts in cell therapy
agatacctggagaacgggaa

SEQ ID NO: 15113 - DNA, 20 bp, Artificial Sequence
  Artificial sequence related to HLA knockouts in cell therapy
atacctggagaacgggaagg

SEQ ID NO: 15114 - DNA, 20 bp, Artificial Sequence
  Artificial sequence related to HLA knockouts in cell therapy
tacctggagaacgggaagga

SEQ ID NO: 15115 - DNA, 20 bp, Artificial Sequence
  Artificial sequence related to HLA knockouts in cell therapy
aaacgcatatgactcaccac

SEQ ID NO: 15116 - DNA, 20 bp, Artificial Sequence
  Artificial sequence related to HLA knockouts in cell therapy
aacgcatatgactcaccacg

SEQ ID NO: 15117 - DNA, 20 bp, Artificial Sequence
  Artificial sequence related to HLA knockouts in cell therapy
acgcatatgactcaccacgc

SEQ ID NO: 15118 - DNA, 20 bp, Artificial Sequence
  Artificial sequence related to HLA knockouts in cell therapy
cgcatatgactcaccacgct

SEQ ID NO: 15119 - DNA, 20 bp, Artificial Sequence
  Artificial sequence related to HLA knockouts in cell therapy
gcatatgactcaccacgctg

SEQ ID NO: 15120 - DNA, 20 bp, Artificial Sequence
  Artificial sequence related to HLA knockouts in cell therapy
catatgactcaccacgctgt

SEQ ID NO: 15121 - DNA, 20 bp, Artificial Sequence
  Artificial sequence related to HLA knockouts in cell therapy
atatgactcaccacgctgtc

SEQ ID NO: 15122 - DNA, 20 bp, Artificial Sequence
  Artificial sequence related to HLA knockouts in cell therapy
tatgactcaccacgctgtct

SEQ ID NO: 15123 - DNA, 20 bp, Artificial Sequence
  Artificial sequence related to HLA knockouts in cell therapy
atgactcaccacgctgtctc

SEQ ID NO: 15124 - DNA, 20 bp, Artificial Sequence
  Artificial sequence related to HLA knockouts in cell therapy
tgactcaccacgctgtctct

SEQ ID NO: 15125 - DNA, 20 bp, Artificial Sequence
  Artificial sequence related to HLA knockouts in cell therapy
actcaccacgctgtctctga

SEQ ID NO: 15126 - DNA, 20 bp, Artificial Sequence
  Artificial sequence related to HLA knockouts in cell therapy
accacgctgtctctgaccat

SEQ ID NO: 15127 - DNA, 20 bp, Artificial Sequence
  Artificial sequence related to HLA knockouts in cell therapy
cacgctgtctctgaccatga

SEQ ID NO: 15128 - DNA, 20 bp, Artificial Sequence
  Artificial sequence related to HLA knockouts in cell therapy
acgctgtctctgaccatgaa

SEQ ID NO: 15129 - DNA, 20 bp, Artificial Sequence
  Artificial sequence related to HLA knockouts in cell therapy
cgctgtctctgaccatgaag

SEQ ID NO: 15130 - DNA, 20 bp, Artificial Sequence
  Artificial sequence related to HLA knockouts in cell therapy
gctgtctctgaccatgaagc

SEQ ID NO: 15131 - DNA, 20 bp, Artificial Sequence
  Artificial sequence related to HLA knockouts in cell therapy
ctgtctctgaccatgaagcc

SEQ ID NO: 15132 - DNA, 20 bp, Artificial Sequence
  Artificial sequence related to HLA knockouts in cell therapy
tgtctctgaccatgaagcca

SEQ ID NO: 15133 - DNA, 20 bp, Artificial Sequence
  Artificial sequence related to HLA knockouts in cell therapy
gtctctgaccatgaagccac

SEQ ID NO: 15134 - DNA, 20 bp, Artificial Sequence
  Artificial sequence related to HLA knockouts in cell therapy
tctctgaccatgaagccacc

SEQ ID NO: 15135 - DNA, 20 bp, Artificial Sequence
  Artificial sequence related to HLA knockouts in cell therapy
tctgaccatgaagccaccct

SEQ ID NO: 15136 - DNA, 20 bp, Artificial Sequence
  Artificial sequence related to HLA knockouts in cell therapy
tgaccatgaagccaccctga

SEQ ID NO: 15137 - DNA, 20 bp, Artificial Sequence
  Artificial sequence related to HLA knockouts in cell therapy
agcttctaccctgcggagat

SEQ ID NO: 15138 - DNA, 20 bp, Artificial Sequence
  Artificial sequence related to HLA knockouts in cell therapy
cttctaccctgcggagatca

SEQ ID NO: 15139 - DNA, 20 bp, Artificial Sequence
  Artificial sequence related to HLA knockouts in cell therapy
ttctaccctgcggagatcac

SEQ ID NO: 15140 - DNA, 20 bp, Artificial Sequence
  Artificial sequence related to HLA knockouts in cell therapy
tctaccctgcggagatcaca

SEQ ID NO: 15141 - DNA, 20 bp, Artificial Sequence
  Artificial sequence related to HLA knockouts in cell therapy
taccctgcggagatcacact

SEQ ID NO: 15142 - DNA, 20 bp, Artificial Sequence
  Artificial sequence related to HLA knockouts in cell therapy
tgcggagatcacactgacct

SEQ ID NO: 15143 - DNA, 20 bp, Artificial Sequence
  Artificial sequence related to HLA knockouts in cell therapy
gagatcacactgacctggca

SEQ ID NO: 15144 - DNA, 20 bp, Artificial Sequence
  Artificial sequence related to HLA knockouts in cell therapy
agatcacactgacctggcag

SEQ ID NO: 15145 - DNA, 20 bp, Artificial Sequence
  Artificial sequence related to HLA knockouts in cell therapy
gggatggaaccttccagaag

SEQ ID NO: 15146 - DNA, 20 bp, Artificial Sequence
  Artificial sequence related to HLA knockouts in cell therapy
ggatggaaccttccagaagt

SEQ ID NO: 15147 - DNA, 20 bp, Artificial Sequence
  Artificial sequence related to HLA knockouts in cell therapy
gatggaaccttccagaagtg

SEQ ID NO: 15148 - DNA, 20 bp, Artificial Sequence
  Artificial sequence related to HLA knockouts in cell therapy
atggaaccttccagaagtgg

SEQ ID NO: 15149 - DNA, 20 bp, Artificial Sequence
  Artificial sequence related to HLA knockouts in cell therapy
tggaaccttccagaagtggg

SEQ ID NO: 15150 - DNA, 20 bp, Artificial Sequence
  Artificial sequence related to HLA knockouts in cell therapy
cttctggacaggagcagaga

SEQ ID NO: 15151 - DNA, 20 bp, Artificial Sequence
  Artificial sequence related to HLA knockouts in cell therapy
ttctggacaggagcagagat

SEQ ID NO: 15152 - DNA, 20 bp, Artificial Sequence
  Artificial sequence related to HLA knockouts in cell therapy
tctggacaggagcagagata

SEQ ID NO: 15153 - DNA, 20 bp, Artificial Sequence
  Artificial sequence related to HLA knockouts in cell therapy
ctggacaggagcagagatac

SEQ ID NO: 15154 - DNA, 20 bp, Artificial Sequence
  Artificial sequence related to HLA knockouts in cell therapy
tggacaggagcagagataca

SEQ ID NO: 15155 - DNA, 20 bp, Artificial Sequence
  Artificial sequence related to HLA knockouts in cell therapy
ggacaggagcagagatacac

SEQ ID NO: 15156 - DNA, 20 bp, Artificial Sequence
  Artificial sequence related to HLA knockouts in cell therapy
gacaggagcagagatacacc

SEQ ID NO: 15157 - DNA, 20 bp, Artificial Sequence
  Artificial sequence related to HLA knockouts in cell therapy
acaggagcagagatacacct

SEQ ID NO: 15158 - DNA, 20 bp, Artificial Sequence
  Artificial sequence related to HLA knockouts in cell therapy
caggagcagagatacacctg

SEQ ID NO: 15159 - DNA, 20 bp, Artificial Sequence
  Artificial sequence related to HLA knockouts in cell therapy
aggagcagagatacacctgc

SEQ ID NO: 15160 - DNA, 20 bp, Artificial Sequence
  Artificial sequence related to HLA knockouts in cell therapy
gagcagagatacacctgcca

SEQ ID NO: 15161 - DNA, 20 bp, Artificial Sequence
  Artificial sequence related to HLA knockouts in cell therapy
agcagagatacacctgccat

SEQ ID NO: 15162 - DNA, 20 bp, Artificial Sequence
  Artificial sequence related to HLA knockouts in cell therapy
gcagagatacacctgccatg

SEQ ID NO: 15163 - DNA, 20 bp, Artificial Sequence
  Artificial sequence related to HLA knockouts in cell therapy
cagagatacacctgccatgt

SEQ ID NO: 15164 - DNA, 20 bp, Artificial Sequence
  Artificial sequence related to HLA knockouts in cell therapy
agagatacacctgccatgtg

SEQ ID NO: 15165 - DNA, 20 bp, Artificial Sequence
  Artificial sequence related to HLA knockouts in cell therapy
gagatacacctgccatgtgc

SEQ ID NO: 15166 - DNA, 20 bp, Artificial Sequence
  Artificial sequence related to HLA knockouts in cell therapy
agatacacctgccatgtgca

SEQ ID NO: 15167 - DNA, 20 bp, Artificial Sequence
  Artificial sequence related to HLA knockouts in cell therapy
gatacacctgccatgtgcag

SEQ ID NO: 15168 - DNA, 20 bp, Artificial Sequence
  Artificial sequence related to HLA knockouts in cell therapy
atacacctgccatgtgcagc

SEQ ID NO: 15169 - DNA, 20 bp, Artificial Sequence
  Artificial sequence related to HLA knockouts in cell therapy
tacacctgccatgtgcagca

SEQ ID NO: 15170 - DNA, 20 bp, Artificial Sequence
  Artificial sequence related to HLA knockouts in cell therapy
acacctgccatgtgcagcat

SEQ ID NO: 15171 - DNA, 20 bp, Artificial Sequence
  Artificial sequence related to HLA knockouts in cell therapy
acctgccatgtgcagcatga

SEQ ID NO: 15172 - DNA, 20 bp, Artificial Sequence
  Artificial sequence related to HLA knockouts in cell therapy
ccatgtgcagcatgagggtt

SEQ ID NO: 15173 - DNA, 20 bp, Artificial Sequence
  Artificial sequence related to HLA knockouts in cell therapy
catgtgcagcatgagggttt

SEQ ID NO: 15174 - DNA, 20 bp, Artificial Sequence
  Artificial sequence related to HLA knockouts in cell therapy
atgtgcagcatgagggtttg

SEQ ID NO: 15175 - DNA, 20 bp, Artificial Sequence
  Artificial sequence related to HLA knockouts in cell therapy
tgtgcagcatgagggtttgc

SEQ ID NO: 15176 - DNA, 20 bp, Artificial Sequence
  Artificial sequence related to HLA knockouts in cell therapy
cagcatgagggtttgcccaa

SEQ ID NO: 15177 - DNA, 20 bp, Artificial Sequence
  Artificial sequence related to HLA knockouts in cell therapy
agcatgagggtttgcccaag

SEQ ID NO: 15178 - DNA, 20 bp, Artificial Sequence
  Artificial sequence related to HLA knockouts in cell therapy
ccatcgtgggcatcattgct

SEQ ID NO: 15179 - DNA, 20 bp, Artificial Sequence
  Artificial sequence related to HLA knockouts in cell therapy
catcgtgggcatcattgctg

SEQ ID NO: 15180 - DNA, 20 bp, Artificial Sequence
  Artificial sequence related to HLA knockouts in cell therapy
atcgtgggcatcattgctgg

SEQ ID NO: 15181 - DNA, 20 bp, Artificial Sequence
  Artificial sequence related to HLA knockouts in cell therapy
gcatcattgctggcctggtt

SEQ ID NO: 15182 - DNA, 20 bp, Artificial Sequence
  Artificial sequence related to HLA knockouts in cell therapy
catcattgctggcctggttc

SEQ ID NO: 15183 - DNA, 20 bp, Artificial Sequence
  Artificial sequence related to HLA knockouts in cell therapy
atcattgctggcctggttct

SEQ ID NO: 15184 - DNA, 20 bp, Artificial Sequence
  Artificial sequence related to HLA knockouts in cell therapy
tcattgctggcctggttctc

SEQ ID NO: 15185 - DNA, 20 bp, Artificial Sequence
  Artificial sequence related to HLA knockouts in cell therapy
cattgctggcctggttctct

SEQ ID NO: 15186 - DNA, 20 bp, Artificial Sequence
  Artificial sequence related to HLA knockouts in cell therapy
attgctggcctggttctctt

SEQ ID NO: 15187 - DNA, 20 bp, Artificial Sequence
  Artificial sequence related to HLA knockouts in cell therapy
ttgctggcctggttctcttt

SEQ ID NO: 15188 - DNA, 20 bp, Artificial Sequence
  Artificial sequence related to HLA knockouts in cell therapy
tgctggcctggttctctttg

SEQ ID NO: 15189 - DNA, 20 bp, Artificial Sequence
  Artificial sequence related to HLA knockouts in cell therapy
ctggcctggttctctttgga

SEQ ID NO: 15190 - DNA, 20 bp, Artificial Sequence
  Artificial sequence related to HLA knockouts in cell therapy
tggcctggttctctttggag

SEQ ID NO: 15191 - DNA, 20 bp, Artificial Sequence
  Artificial sequence related to HLA knockouts in cell therapy
gcctggttctctttggagct

SEQ ID NO: 15192 - DNA, 20 bp, Artificial Sequence
  Artificial sequence related to HLA knockouts in cell therapy
cctggttctctttggagctg

SEQ ID NO: 15193 - DNA, 20 bp, Artificial Sequence
  Artificial sequence related to HLA knockouts in cell therapy
ctggttctctttggagctgt

SEQ ID NO: 15194 - DNA, 20 bp, Artificial Sequence
  Artificial sequence related to HLA knockouts in cell therapy
tggttctctttggagctgtg

SEQ ID NO: 15195 - DNA, 20 bp, Artificial Sequence
  Artificial sequence related to HLA knockouts in cell therapy
ggttctctttggagctgtga

SEQ ID NO: 15196 - DNA, 20 bp, Artificial Sequence
  Artificial sequence related to HLA knockouts in cell therapy
gttctctttggagctgtgat

SEQ ID NO: 15197 - DNA, 20 bp, Artificial Sequence
  Artificial sequence related to HLA knockouts in cell therapy
ttctctttggagctgtgatc

SEQ ID NO: 15198 - DNA, 20 bp, Artificial Sequence
  Artificial sequence related to HLA knockouts in cell therapy
tctctttggagctgtgatca

SEQ ID NO: 15199 - DNA, 20 bp, Artificial Sequence
  Artificial sequence related to HLA knockouts in cell therapy
ctctttggagctgtgatcac

SEQ ID NO: 15200 - DNA, 20 bp, Artificial Sequence
  Artificial sequence related to HLA knockouts in cell therapy
tctttggagctgtgatcact

SEQ ID NO: 15201 - DNA, 20 bp, Artificial Sequence
  Artificial sequence related to HLA knockouts in cell therapy
ctttggagctgtgatcactg

SEQ ID NO: 15202 - DNA, 20 bp, Artificial Sequence
  Artificial sequence related to HLA knockouts in cell therapy
tttggagctgtgatcactgg

SEQ ID NO: 15203 - DNA, 20 bp, Artificial Sequence
  Artificial sequence related to HLA knockouts in cell therapy
ttggagctgtgatcactgga

SEQ ID NO: 15204 - DNA, 20 bp, Artificial Sequence
  Artificial sequence related to HLA knockouts in cell therapy
tggagctgtgatcactggag

SEQ ID NO: 15205 - DNA, 20 bp, Artificial Sequence
  Artificial sequence related to HLA knockouts in cell therapy
gagctgtgatcactggagct

SEQ ID NO: 15206 - DNA, 20 bp, Artificial Sequence
  Artificial sequence related to HLA knockouts in cell therapy
agctgtgatcactggagctg

SEQ ID NO: 15207 - DNA, 20 bp, Artificial Sequence
  Artificial sequence related to HLA knockouts in cell therapy
gctgtgatcactggagctgt

SEQ ID NO: 15208 - DNA, 20 bp, Artificial Sequence
  Artificial sequence related to HLA knockouts in cell therapy
ctgtgatcactggagctgtg

SEQ ID NO: 15209 - DNA, 20 bp, Artificial Sequence
  Artificial sequence related to HLA knockouts in cell therapy
tgtgatcactggagctgtgg

SEQ ID NO: 15210 - DNA, 20 bp, Artificial Sequence
  Artificial sequence related to HLA knockouts in cell therapy
gtgatcactggagctgtggt

SEQ ID NO: 15211 - DNA, 20 bp, Artificial Sequence
  Artificial sequence related to HLA knockouts in cell therapy
tgatcactggagctgtggtc

SEQ ID NO: 15212 - DNA, 20 bp, Artificial Sequence
  Artificial sequence related to HLA knockouts in cell therapy
tgtggtcgctgctgtgatgt

SEQ ID NO: 15213 - DNA, 20 bp, Artificial Sequence
  Artificial sequence related to HLA knockouts in cell therapy
tgctgtgatgtggaggagga

SEQ ID NO: 15214 - DNA, 20 bp, Artificial Sequence
  Artificial sequence related to HLA knockouts in cell therapy
gctgtgatgtggaggaggaa

SEQ ID NO: 15215 - DNA, 20 bp, Artificial Sequence
  Artificial sequence related to HLA knockouts in cell therapy
ctgtgatgtggaggaggaag

SEQ ID NO: 15216 - DNA, 20 bp, Artificial Sequence
  Artificial sequence related to HLA knockouts in cell therapy
tgtgatgtggaggaggaaga

SEQ ID NO: 15217 - DNA, 20 bp, Artificial Sequence
  Artificial sequence related to HLA knockouts in cell therapy
gtgatgtggaggaggaagag

SEQ ID NO: 15218 - DNA, 20 bp, Artificial Sequence
  Artificial sequence related to HLA knockouts in cell therapy
tgatgtggaggaggaagagc

SEQ ID NO: 15219 - DNA, 20 bp, Artificial Sequence
  Artificial sequence related to HLA knockouts in cell therapy
gatgtggaggaggaagagct

SEQ ID NO: 15220 - DNA, 20 bp, Artificial Sequence
  Artificial sequence related to HLA knockouts in cell therapy
atgtggaggaggaagagctc

SEQ ID NO: 15221 - DNA, 20 bp, Artificial Sequence
  Artificial sequence related to HLA knockouts in cell therapy
tgtggaggaggaagagctca

SEQ ID NO: 15222 - DNA, 20 bp, Artificial Sequence
  Artificial sequence related to HLA knockouts in cell therapy
tggaggaggaagagctcaga

SEQ ID NO: 15223 - DNA, 20 bp, Artificial Sequence
  Artificial sequence related to HLA knockouts in cell therapy
ggaggaggaagagctcagat

SEQ ID NO: 15224 - DNA, 20 bp, Artificial Sequence
  Artificial sequence related to HLA knockouts in cell therapy
gaggaggaagagctcagata

SEQ ID NO: 15225 - DNA, 20 bp, Artificial Sequence
  Artificial sequence related to HLA knockouts in cell therapy
aggaggaagagctcagatag

SEQ ID NO: 15226 - DNA, 20 bp, Artificial Sequence
  Artificial sequence related to HLA knockouts in cell therapy
ggaggaagagctcagataga

SEQ ID NO: 15227 - DNA, 20 bp, Artificial Sequence
  Artificial sequence related to HLA knockouts in cell therapy
gaggaagagctcagatagaa

SEQ ID NO: 15228 - DNA, 20 bp, Artificial Sequence
  Artificial sequence related to HLA knockouts in cell therapy
aggaagagctcagatagaaa

SEQ ID NO: 15229 - DNA, 20 bp, Artificial Sequence
  Artificial sequence related to HLA knockouts in cell therapy
aaaggagggagctactctca

SEQ ID NO: 15230 - DNA, 20 bp, Artificial Sequence
  Artificial sequence related to HLA knockouts in cell therapy
aaggagggagctactctcag

SEQ ID NO: 15231 - DNA, 20 bp, Artificial Sequence
  Artificial sequence related to HLA knockouts in cell therapy
gagctactctcaggctgcaa

SEQ ID NO: 15232 - DNA, 20 bp, Artificial Sequence
  Artificial sequence related to HLA knockouts in cell therapy
agctactctcaggctgcaag

SEQ ID NO: 15233 - DNA, 20 bp, Artificial Sequence
  Artificial sequence related to HLA knockouts in cell therapy
ctactctcaggctgcaagca

SEQ ID NO: 15234 - DNA, 20 bp, Artificial Sequence
  Artificial sequence related to HLA knockouts in cell therapy
tactctcaggctgcaagcag

SEQ ID NO: 15235 - DNA, 20 bp, Artificial Sequence
  Artificial sequence related to HLA knockouts in cell therapy
actctcaggctgcaagcagt

SEQ ID NO: 15236 - DNA, 20 bp, Artificial Sequence
  Artificial sequence related to HLA knockouts in cell therapy
tctcaggctgcaagcagtga

SEQ ID NO: 15237 - DNA, 20 bp, Artificial Sequence
  Artificial sequence related to HLA knockouts in cell therapy
tcaggctgcaagcagtgaca

SEQ ID NO: 15238 - DNA, 20 bp, Artificial Sequence
  Artificial sequence related to HLA knockouts in cell therapy
aggctgcaagcagtgacagt

SEQ ID NO: 15239 - DNA, 20 bp, Artificial Sequence
  Artificial sequence related to HLA knockouts in cell therapy
cagggctctgatgtgtctct

SEQ ID NO: 15240 - DNA, 20 bp, Artificial Sequence
  Artificial sequence related to HLA knockouts in cell therapy
agggctctgatgtgtctctc

SEQ ID NO: 15241 - DNA, 20 bp, Artificial Sequence
  Artificial sequence related to HLA knockouts in cell therapy
gggctctgatgtgtctctca

SEQ ID NO: 15242 - DNA, 20 bp, Artificial Sequence
  Artificial sequence related to HLA knockouts in cell therapy
ggctctgatgtgtctctcac

SEQ ID NO: 15243 - DNA, 20 bp, Artificial Sequence
  Artificial sequence related to HLA knockouts in cell therapy
gctctgatgtgtctctcaca

SEQ ID NO: 15244 - DNA, 20 bp, Artificial Sequence
  Artificial sequence related to HLA knockouts in cell therapy
ctctgatgtgtctctcacag

SEQ ID NO: 15245 - DNA, 20 bp, Artificial Sequence
  Artificial sequence related to HLA knockouts in cell therapy
tctgatgtgtctctcacagc

SEQ ID NO: 15246 - DNA, 20 bp, Artificial Sequence
  Artificial sequence related to HLA knockouts in cell therapy
ctgatgtgtctctcacagct

SEQ ID NO: 15247 - DNA, 20 bp, Artificial Sequence
  Artificial sequence related to HLA knockouts in cell therapy
tgatgtgtctctcacagctt

SEQ ID NO: 15248 - DNA, 20 bp, Artificial Sequence
  Artificial sequence related to HLA knockouts in cell therapy
gatgtgtctctcacagcttg

SEQ ID NO: 15249 - DNA, 20 bp, Artificial Sequence
  Artificial sequence related to HLA knockouts in cell therapy
atgtgtctctcacagcttgt

SEQ ID NO: 15250 - DNA, 20 bp, Artificial Sequence
  Artificial sequence related to HLA knockouts in cell therapy
tgtgtctctcacagcttgta

SEQ ID NO: 15251 - DNA, 20 bp, Artificial Sequence
  Artificial sequence related to HLA knockouts in cell therapy
gtgtctctcacagcttgtaa

SEQ ID NO: 15252 - DNA, 20 bp, Artificial Sequence
  Artificial sequence related to HLA knockouts in cell therapy
tgtctctcacagcttgtaaa

SEQ ID NO: 15253 - DNA, 20 bp, Artificial Sequence
  Artificial sequence related to HLA knockouts in cell therapy
gtctctcacagcttgtaaag

SEQ ID NO: 15254 - DNA, 20 bp, Artificial Sequence
  Artificial sequence related to HLA knockouts in cell therapy
tctctcacagcttgtaaagt

SEQ ID NO: 15255 - DNA, 20 bp, Artificial Sequence
  Artificial sequence related to HLA knockouts in cell therapy
ctctcacagcttgtaaagtg

SEQ ID NO: 15256 - DNA, 20 bp, Artificial Sequence
  Artificial sequence related to HLA knockouts in cell therapy
tctcacagcttgtaaagtgt

SEQ ID NO: 15257 - DNA, 20 bp, Artificial Sequence
  Artificial sequence related to HLA knockouts in cell therapy
ctcacagcttgtaaagtgtg

SEQ ID NO: 15258 - DNA, 20 bp, Artificial Sequence
  Artificial sequence related to HLA knockouts in cell therapy
tcacagcttgtaaagtgtga

SEQ ID NO: 15259 - DNA, 20 bp, Artificial Sequence
  Artificial sequence related to HLA knockouts in cell therapy
cacagcttgtaaagtgtgag

SEQ ID NO: 15260 - DNA, 20 bp, Artificial Sequence
  Artificial sequence related to HLA knockouts in cell therapy
acagcttgtaaagtgtgaga

SEQ ID NO: 15261 - DNA, 20 bp, Artificial Sequence
  Artificial sequence related to HLA knockouts in cell therapy
cagcttgtaaagtgtgagac

SEQ ID NO: 15262 - DNA, 20 bp, Artificial Sequence
  Artificial sequence related to HLA knockouts in cell therapy
agcttgtaaagtgtgagaca

SEQ ID NO: 15263 - DNA, 20 bp, Artificial Sequence
  Artificial sequence related to HLA knockouts in cell therapy
gcttgtaaagtgtgagacag

SEQ ID NO: 15264 - DNA, 20 bp, Artificial Sequence
  Artificial sequence related to HLA knockouts in cell therapy
cttgtaaagtgtgagacagc

SEQ ID NO: 15265 - DNA, 20 bp, Artificial Sequence
  Artificial sequence related to HLA knockouts in cell therapy
ttgtaaagtgtgagacagct

SEQ ID NO: 15266 - DNA, 20 bp, Artificial Sequence
  Artificial sequence related to HLA knockouts in cell therapy
tgtaaagtgtgagacagctg

SEQ ID NO: 15267 - DNA, 20 bp, Artificial Sequence
  Artificial sequence related to HLA knockouts in cell therapy
gtaaagtgtgagacagctgc

SEQ ID NO: 15268 - DNA, 20 bp, Artificial Sequence
  Artificial sequence related to HLA knockouts in cell therapy
taaagtgtgagacagctgcc

SEQ ID NO: 15269 - DNA, 20 bp, Artificial Sequence
  Artificial sequence related to HLA knockouts in cell therapy
aaagtgtgagacagctgcct

SEQ ID NO: 15270 - DNA, 20 bp, Artificial Sequence
  Artificial sequence related to HLA knockouts in cell therapy
aagtgtgagacagctgcctt

SEQ ID NO: 15271 - DNA, 20 bp, Artificial Sequence
  Artificial sequence related to HLA knockouts in cell therapy
agtgtgagacagctgccttg

SEQ ID NO: 15272 - DNA, 20 bp, Artificial Sequence
  Artificial sequence related to HLA knockouts in cell therapy
gtgtgagacagctgccttgt

SEQ ID NO: 15273 - DNA, 20 bp, Artificial Sequence
  Artificial sequence related to HLA knockouts in cell therapy
tgtgagacagctgccttgtg

SEQ ID NO: 15274 - DNA, 20 bp, Artificial Sequence
  Artificial sequence related to HLA knockouts in cell therapy
gtgagacagctgccttgtgt

SEQ ID NO: 15275 - DNA, 20 bp, Artificial Sequence
  Artificial sequence related to HLA knockouts in cell therapy
tgagacagctgccttgtgtg

SEQ ID NO: 15276 - DNA, 20 bp, Artificial Sequence
  Artificial sequence related to HLA knockouts in cell therapy
tgccttgtgtgggactgaga

SEQ ID NO: 15277 - DNA, 20 bp, Artificial Sequence
  Artificial sequence related to HLA knockouts in cell therapy
ttgtgtgggactgagaggca

SEQ ID NO: 15278 - DNA, 20 bp, Artificial Sequence
  Artificial sequence related to HLA knockouts in cell therapy
tgtgtgggactgagaggcaa

SEQ ID NO: 15279 - DNA, 20 bp, Artificial Sequence
  Artificial sequence related to HLA knockouts in cell therapy
tgtgggactgagaggcaaga

SEQ ID NO: 15280 - DNA, 20 bp, Artificial Sequence
  Artificial sequence related to HLA knockouts in cell therapy
tgggactgagaggcaagagt

SEQ ID NO: 15281 - DNA, 20 bp, Artificial Sequence
  Artificial sequence related to HLA knockouts in cell therapy
gggactgagaggcaagagtt

SEQ ID NO: 15282 - DNA, 20 bp, Artificial Sequence
  Artificial sequence related to HLA knockouts in cell therapy
ggactgagaggcaagagttg

SEQ ID NO: 15283 - DNA, 20 bp, Artificial Sequence
  Artificial sequence related to HLA knockouts in cell therapy
gactgagaggcaagagttgt

SEQ ID NO: 15284 - DNA, 20 bp, Artificial Sequence
  Artificial sequence related to HLA knockouts in cell therapy
actgagaggcaagagttgtt

SEQ ID NO: 15285 - DNA, 20 bp, Artificial Sequence
  Artificial sequence related to HLA knockouts in cell therapy
ctgagaggcaagagttgttc

SEQ ID NO: 15286 - DNA, 20 bp, Artificial Sequence
  Artificial sequence related to HLA knockouts in cell therapy
tgagaggcaagagttgttcc

SEQ ID NO: 15287 - DNA, 20 bp, Artificial Sequence
  Artificial sequence related to HLA knockouts in cell therapy
gagaggcaagagttgttcct

SEQ ID NO: 15288 - DNA, 20 bp, Artificial Sequence
  Artificial sequence related to HLA knockouts in cell therapy
agaggcaagagttgttcctg

SEQ ID NO: 15289 - DNA, 20 bp, Artificial Sequence
  Artificial sequence related to HLA knockouts in cell therapy
gaggcaagagttgttcctgc

SEQ ID NO: 15290 - DNA, 20 bp, Artificial Sequence
  Artificial sequence related to HLA knockouts in cell therapy
aggcaagagttgttcctgcc

SEQ ID NO: 15291 - DNA, 20 bp, Artificial Sequence
  Artificial sequence related to HLA knockouts in cell therapy
gcaagagttgttcctgccct

SEQ ID NO: 15292 - DNA, 20 bp, Artificial Sequence
  Artificial sequence related to HLA knockouts in cell therapy
caagagttgttcctgccctt

SEQ ID NO: 15293 - DNA, 20 bp, Artificial Sequence
  Artificial sequence related to HLA knockouts in cell therapy
aagagttgttcctgcccttc

SEQ ID NO: 15294 - DNA, 20 bp, Artificial Sequence
  Artificial sequence related to HLA knockouts in cell therapy
agagttgttcctgcccttcc

SEQ ID NO: 15295 - DNA, 20 bp, Artificial Sequence
  Artificial sequence related to HLA knockouts in cell therapy
agttgttcctgcccttccct

SEQ ID NO: 15296 - DNA, 20 bp, Artificial Sequence
  Artificial sequence related to HLA knockouts in cell therapy
gttgttcctgcccttccctt

SEQ ID NO: 15297 - DNA, 20 bp, Artificial Sequence
  Artificial sequence related to HLA knockouts in cell therapy
ttgttcctgcccttcccttt

SEQ ID NO: 15298 - DNA, 20 bp, Artificial Sequence
  Artificial sequence related to HLA knockouts in cell therapy
tgttcctgcccttccctttg

SEQ ID NO: 15299 - DNA, 20 bp, Artificial Sequence
  Artificial sequence related to HLA knockouts in cell therapy
gttcctgcccttccctttgt

SEQ ID NO: 15300 - DNA, 20 bp, Artificial Sequence
  Artificial sequence related to HLA knockouts in cell therapy
ttcctgcccttccctttgtg

SEQ ID NO: 15301 - DNA, 20 bp, Artificial Sequence
  Artificial sequence related to HLA knockouts in cell therapy
tcctgcccttccctttgtga

SEQ ID NO: 15302 - DNA, 20 bp, Artificial Sequence
  Artificial sequence related to HLA knockouts in cell therapy
ctgcccttccctttgtgact

SEQ ID NO: 15303 - DNA, 20 bp, Artificial Sequence
  Artificial sequence related to HLA knockouts in cell therapy
tgcccttccctttgtgactt

SEQ ID NO: 15304 - DNA, 20 bp, Artificial Sequence
  Artificial sequence related to HLA knockouts in cell therapy
gcccttccctttgtgacttg

SEQ ID NO: 15305 - DNA, 20 bp, Artificial Sequence
  Artificial sequence related to HLA knockouts in cell therapy
cccttccctttgtgacttga

SEQ ID NO: 15306 - DNA, 20 bp, Artificial Sequence
  Artificial sequence related to HLA knockouts in cell therapy
ccttccctttgtgacttgaa

SEQ ID NO: 15307 - DNA, 20 bp, Artificial Sequence
  Artificial sequence related to HLA knockouts in cell therapy
cttccctttgtgacttgaag

SEQ ID NO: 15308 - DNA, 20 bp, Artificial Sequence
  Artificial sequence related to HLA knockouts in cell therapy
ttccctttgtgacttgaaga

SEQ ID NO: 15309 - DNA, 20 bp, Artificial Sequence
  Artificial sequence related to HLA knockouts in cell therapy
tccctttgtgacttgaagaa

SEQ ID NO: 15310 - DNA, 20 bp, Artificial Sequence
  Artificial sequence related to HLA knockouts in cell therapy
ccctttgtgacttgaagaac

SEQ ID NO: 15311 - DNA, 20 bp, Artificial Sequence
  Artificial sequence related to HLA knockouts in cell therapy
cctttgtgacttgaagaacc

SEQ ID NO: 15312 - DNA, 20 bp, Artificial Sequence
  Artificial sequence related to HLA knockouts in cell therapy
ctttgtgacttgaagaaccc

SEQ ID NO: 15313 - DNA, 20 bp, Artificial Sequence
  Artificial sequence related to HLA knockouts in cell therapy
tttgtgacttgaagaaccct

SEQ ID NO: 15314 - DNA, 20 bp, Artificial Sequence
  Artificial sequence related to HLA knockouts in cell therapy
ttgtgacttgaagaaccctg

SEQ ID NO: 15315 - DNA, 20 bp, Artificial Sequence
  Artificial sequence related to HLA knockouts in cell therapy
tgtgacttgaagaaccctga

SEQ ID NO: 15316 - DNA, 20 bp, Artificial Sequence
  Artificial sequence related to HLA knockouts in cell therapy
gtgacttgaagaaccctgac

SEQ ID NO: 15317 - DNA, 20 bp, Artificial Sequence
  Artificial sequence related to HLA knockouts in cell therapy
tgacttgaagaaccctgact

SEQ ID NO: 15318 - DNA, 20 bp, Artificial Sequence
  Artificial sequence related to HLA knockouts in cell therapy
gacttgaagaaccctgactt

SEQ ID NO: 15319 - DNA, 20 bp, Artificial Sequence
  Artificial sequence related to HLA knockouts in cell therapy
acttgaagaaccctgacttt

SEQ ID NO: 15320 - DNA, 20 bp, Artificial Sequence
  Artificial sequence related to HLA knockouts in cell therapy
cttgaagaaccctgactttg

SEQ ID NO: 15321 - DNA, 20 bp, Artificial Sequence
  Artificial sequence related to HLA knockouts in cell therapy
ttgaagaaccctgactttgt

SEQ ID NO: 15322 - DNA, 20 bp, Artificial Sequence
  Artificial sequence related to HLA knockouts in cell therapy
tgaagaaccctgactttgtt

SEQ ID NO: 15323 - DNA, 20 bp, Artificial Sequence
  Artificial sequence related to HLA knockouts in cell therapy
gaagaaccctgactttgttt

SEQ ID NO: 15324 - DNA, 20 bp, Artificial Sequence
  Artificial sequence related to HLA knockouts in cell therapy
aagaaccctgactttgtttc

SEQ ID NO: 15325 - DNA, 20 bp, Artificial Sequence
  Artificial sequence related to HLA knockouts in cell therapy
agaaccctgactttgtttct

SEQ ID NO: 15326 - DNA, 20 bp, Artificial Sequence
  Artificial sequence related to HLA knockouts in cell therapy
gaaccctgactttgtttctg

SEQ ID NO: 15327 - DNA, 20 bp, Artificial Sequence
  Artificial sequence related to HLA knockouts in cell therapy
aaccctgactttgtttctgc

SEQ ID NO: 15328 - DNA, 20 bp, Artificial Sequence
  Artificial sequence related to HLA knockouts in cell therapy
accctgactttgtttctgca

SEQ ID NO: 15329 - DNA, 20 bp, Artificial Sequence
  Artificial sequence related to HLA knockouts in cell therapy
ccctgactttgtttctgcaa

SEQ ID NO: 15330 - DNA, 20 bp, Artificial Sequence
  Artificial sequence related to HLA knockouts in cell therapy
cctgactttgtttctgcaaa

SEQ ID NO: 15331 - DNA, 20 bp, Artificial Sequence
  Artificial sequence related to HLA knockouts in cell therapy
ctgactttgtttctgcaaag

SEQ ID NO: 15332 - DNA, 20 bp, Artificial Sequence
  Artificial sequence related to HLA knockouts in cell therapy
tgactttgtttctgcaaagg

SEQ ID NO: 15333 - DNA, 20 bp, Artificial Sequence
  Artificial sequence related to HLA knockouts in cell therapy
gactttgtttctgcaaaggc

SEQ ID NO: 15334 - DNA, 20 bp, Artificial Sequence
  Artificial sequence related to HLA knockouts in cell therapy
actttgtttctgcaaaggca

SEQ ID NO: 15335 - DNA, 20 bp, Artificial Sequence
  Artificial sequence related to HLA knockouts in cell therapy
ctttgtttctgcaaaggcac

SEQ ID NO: 15336 - DNA, 20 bp, Artificial Sequence
  Artificial sequence related to HLA knockouts in cell therapy
tttgtttctgcaaaggcacc

SEQ ID NO: 15337 - DNA, 20 bp, Artificial Sequence
  Artificial sequence related to HLA knockouts in cell therapy
ttgtttctgcaaaggcacct

SEQ ID NO: 15338 - DNA, 20 bp, Artificial Sequence
  Artificial sequence related to HLA knockouts in cell therapy
tgtttctgcaaaggcacctg

SEQ ID NO: 15339 - DNA, 20 bp, Artificial Sequence
  Artificial sequence related to HLA knockouts in cell therapy
gtttctgcaaaggcacctgc

SEQ ID NO: 15340 - DNA, 20 bp, Artificial Sequence
  Artificial sequence related to HLA knockouts in cell therapy
tttctgcaaaggcacctgca

SEQ ID NO: 15341 - DNA, 20 bp, Artificial Sequence
  Artificial sequence related to HLA knockouts in cell therapy
ttctgcaaaggcacctgcat

SEQ ID NO: 15342 - DNA, 20 bp, Artificial Sequence
  Artificial sequence related to HLA knockouts in cell therapy
tctgcaaaggcacctgcatg

SEQ ID NO: 15343 - DNA, 20 bp, Artificial Sequence
  Artificial sequence related to HLA knockouts in cell therapy
ctgcaaaggcacctgcatgt

SEQ ID NO: 15344 - DNA, 20 bp, Artificial Sequence
  Artificial sequence related to HLA knockouts in cell therapy
tgcaaaggcacctgcatgtg

SEQ ID NO: 15345 - DNA, 20 bp, Artificial Sequence
  Artificial sequence related to HLA knockouts in cell therapy
gcaaaggcacctgcatgtgt

SEQ ID NO: 15346 - DNA, 20 bp, Artificial Sequence
  Artificial sequence related to HLA knockouts in cell therapy
caaaggcacctgcatgtgtc

SEQ ID NO: 15347 - DNA, 20 bp, Artificial Sequence
  Artificial sequence related to HLA knockouts in cell therapy
aaaggcacctgcatgtgtct

SEQ ID NO: 15348 - DNA, 20 bp, Artificial Sequence
  Artificial sequence related to HLA knockouts in cell therapy
aaggcacctgcatgtgtctg

SEQ ID NO: 15349 - DNA, 20 bp, Artificial Sequence
  Artificial sequence related to HLA knockouts in cell therapy
aggcacctgcatgtgtctgt

SEQ ID NO: 15350 - DNA, 20 bp, Artificial Sequence
  Artificial sequence related to HLA knockouts in cell therapy
gcacctgcatgtgtctgtgt

SEQ ID NO: 15351 - DNA, 20 bp, Artificial Sequence
  Artificial sequence related to HLA knockouts in cell therapy
cacctgcatgtgtctgtgtt

SEQ ID NO: 15352 - DNA, 20 bp, Artificial Sequence
  Artificial sequence related to HLA knockouts in cell therapy
acctgcatgtgtctgtgttc

SEQ ID NO: 15353 - DNA, 20 bp, Artificial Sequence
  Artificial sequence related to HLA knockouts in cell therapy
cctgcatgtgtctgtgttcg

SEQ ID NO: 15354 - DNA, 20 bp, Artificial Sequence
  Artificial sequence related to HLA knockouts in cell therapy
ctgcatgtgtctgtgttcgt

SEQ ID NO: 15355 - DNA, 20 bp, Artificial Sequence
  Artificial sequence related to HLA knockouts in cell therapy
tgcatgtgtctgtgttcgtg

SEQ ID NO: 15356 - DNA, 20 bp, Artificial Sequence
  Artificial sequence related to HLA knockouts in cell therapy
gcatgtgtctgtgttcgtgt

SEQ ID NO: 15357 - DNA, 20 bp, Artificial Sequence
  Artificial sequence related to HLA knockouts in cell therapy
catgtgtctgtgttcgtgta

SEQ ID NO: 15358 - DNA, 20 bp, Artificial Sequence
  Artificial sequence related to HLA knockouts in cell therapy
atgtgtctgtgttcgtgtag

SEQ ID NO: 15359 - DNA, 20 bp, Artificial Sequence
  Artificial sequence related to HLA knockouts in cell therapy
tgtgtctgtgttcgtgtagg

SEQ ID NO: 15360 - DNA, 20 bp, Artificial Sequence
  Artificial sequence related to HLA knockouts in cell therapy
gtgtctgtgttcgtgtaggc

SEQ ID NO: 15361 - DNA, 20 bp, Artificial Sequence
  Artificial sequence related to HLA knockouts in cell therapy
tgtctgtgttcgtgtaggca

SEQ ID NO: 15362 - DNA, 20 bp, Artificial Sequence
  Artificial sequence related to HLA knockouts in cell therapy
gtctgtgttcgtgtaggcat

SEQ ID NO: 15363 - DNA, 20 bp, Artificial Sequence
  Artificial sequence related to HLA knockouts in cell therapy
tctgtgttcgtgtaggcata

SEQ ID NO: 15364 - DNA, 20 bp, Artificial Sequence
  Artificial sequence related to HLA knockouts in cell therapy
ctgtgttcgtgtaggcataa

SEQ ID NO: 15365 - DNA, 20 bp, Artificial Sequence
  Artificial sequence related to HLA knockouts in cell therapy
tgtgttcgtgtaggcataat

SEQ ID NO: 15366 - DNA, 20 bp, Artificial Sequence
  Artificial sequence related to HLA knockouts in cell therapy
gtgttcgtgtaggcataatg

SEQ ID NO: 15367 - DNA, 20 bp, Artificial Sequence
  Artificial sequence related to HLA knockouts in cell therapy
tgttcgtgtaggcataatgt

SEQ ID NO: 15368 - DNA, 20 bp, Artificial Sequence
  Artificial sequence related to HLA knockouts in cell therapy
gttcgtgtaggcataatgtg

SEQ ID NO: 15369 - DNA, 20 bp, Artificial Sequence
  Artificial sequence related to HLA knockouts in cell therapy
ttcgtgtaggcataatgtga

SEQ ID NO: 15370 - DNA, 20 bp, Artificial Sequence
  Artificial sequence related to HLA knockouts in cell therapy
tcgtgtaggcataatgtgag

SEQ ID NO: 15371 - DNA, 20 bp, Artificial Sequence
  Artificial sequence related to HLA knockouts in cell therapy
cgtgtaggcataatgtgagg

SEQ ID NO: 15372 - DNA, 20 bp, Artificial Sequence
  Artificial sequence related to HLA knockouts in cell therapy
gtgtaggcataatgtgagga

SEQ ID NO: 15373 - DNA, 20 bp, Artificial Sequence
  Artificial sequence related to HLA knockouts in cell therapy
tgtaggcataatgtgaggag

SEQ ID NO: 15374 - DNA, 20 bp, Artificial Sequence
  Artificial sequence related to HLA knockouts in cell therapy
gtaggcataatgtgaggagg

SEQ ID NO: 15375 - DNA, 20 bp, Artificial Sequence
  Artificial sequence related to HLA knockouts in cell therapy
taggcataatgtgaggaggt

SEQ ID NO: 15376 - DNA, 20 bp, Artificial Sequence
  Artificial sequence related to HLA knockouts in cell therapy
aggcataatgtgaggaggtg

SEQ ID NO: 15377 - DNA, 20 bp, Artificial Sequence
  Artificial sequence related to HLA knockouts in cell therapy
ggcataatgtgaggaggtgg

SEQ ID NO: 15378 - DNA, 20 bp, Artificial Sequence
  Artificial sequence related to HLA knockouts in cell therapy
gcataatgtgaggaggtggg

SEQ ID NO: 15379 - DNA, 20 bp, Artificial Sequence
  Artificial sequence related to HLA knockouts in cell therapy
catgtccaccatgaccctct

SEQ ID NO: 15380 - DNA, 20 bp, Artificial Sequence
  Artificial sequence related to HLA knockouts in cell therapy
atgtccaccatgaccctctt

SEQ ID NO: 15381 - DNA, 20 bp, Artificial Sequence
  Artificial sequence related to HLA knockouts in cell therapy
tgtccaccatgaccctcttc

SEQ ID NO: 15382 - DNA, 20 bp, Artificial Sequence
  Artificial sequence related to HLA knockouts in cell therapy
cccaatcatctttcctgttc

SEQ ID NO: 15383 - DNA, 20 bp, Artificial Sequence
  Artificial sequence related to HLA knockouts in cell therapy
ccaatcatctttcctgttcc

SEQ ID NO: 15384 - DNA, 20 bp, Artificial Sequence
  Artificial sequence related to HLA knockouts in cell therapy
caatcatctttcctgttcca

SEQ ID NO: 15385 - DNA, 20 bp, Artificial Sequence
  Artificial sequence related to HLA knockouts in cell therapy
aatcatctttcctgttccag

SEQ ID NO: 15386 - DNA, 20 bp, Artificial Sequence
  Artificial sequence related to HLA knockouts in cell therapy
atcatctttcctgttccaga

SEQ ID NO: 15387 - DNA, 20 bp, Artificial Sequence
  Artificial sequence related to HLA knockouts in cell therapy
tcatctttcctgttccagag

SEQ ID NO: 15388 - DNA, 20 bp, Artificial Sequence
  Artificial sequence related to HLA knockouts in cell therapy
catctttcctgttccagaga

SEQ ID NO: 15389 - DNA, 20 bp, Artificial Sequence
  Artificial sequence related to HLA knockouts in cell therapy
atctttcctgttccagagag

SEQ ID NO: 15390 - DNA, 20 bp, Artificial Sequence
  Artificial sequence related to HLA knockouts in cell therapy
tctttcctgttccagagagg

SEQ ID NO: 15391 - DNA, 20 bp, Artificial Sequence
  Artificial sequence related to HLA knockouts in cell therapy
ctttcctgttccagagaggt

SEQ ID NO: 15392 - DNA, 20 bp, Artificial Sequence
  Artificial sequence related to HLA knockouts in cell therapy
tttcctgttccagagaggtg

SEQ ID NO: 15393 - DNA, 20 bp, Artificial Sequence
  Artificial sequence related to HLA knockouts in cell therapy
ttcctgttccagagaggtgg

SEQ ID NO: 15394 - DNA, 20 bp, Artificial Sequence
  Artificial sequence related to HLA knockouts in cell therapy
gctgaggtgtctccatctct

SEQ ID NO: 15395 - DNA, 20 bp, Artificial Sequence
  Artificial sequence related to HLA knockouts in cell therapy
ctgaggtgtctccatctctg

SEQ ID NO: 15396 - DNA, 20 bp, Artificial Sequence
  Artificial sequence related to HLA knockouts in cell therapy
tgaggtgtctccatctctgt

SEQ ID NO: 15397 - DNA, 20 bp, Artificial Sequence
  Artificial sequence related to HLA knockouts in cell therapy
gaggtgtctccatctctgtc

SEQ ID NO: 15398 - DNA, 20 bp, Artificial Sequence
  Artificial sequence related to HLA knockouts in cell therapy
aggtgtctccatctctgtct

SEQ ID NO: 15399 - DNA, 20 bp, Artificial Sequence
  Artificial sequence related to HLA knockouts in cell therapy
ggtgtctccatctctgtctc

SEQ ID NO: 15400 - DNA, 20 bp, Artificial Sequence
  Artificial sequence related to HLA knockouts in cell therapy
gtgtctccatctctgtctca

SEQ ID NO: 15401 - DNA, 20 bp, Artificial Sequence
  Artificial sequence related to HLA knockouts in cell therapy
tgtctccatctctgtctcaa

SEQ ID NO: 15402 - DNA, 20 bp, Artificial Sequence
  Artificial sequence related to HLA knockouts in cell therapy
gtctccatctctgtctcaac

SEQ ID NO: 15403 - DNA, 20 bp, Artificial Sequence
  Artificial sequence related to HLA knockouts in cell therapy
tctccatctctgtctcaact

SEQ ID NO: 15404 - DNA, 20 bp, Artificial Sequence
  Artificial sequence related to HLA knockouts in cell therapy
ctccatctctgtctcaactt

SEQ ID NO: 15405 - DNA, 20 bp, Artificial Sequence
  Artificial sequence related to HLA knockouts in cell therapy
tccatctctgtctcaacttc

SEQ ID NO: 15406 - DNA, 20 bp, Artificial Sequence
  Artificial sequence related to HLA knockouts in cell therapy
ccatctctgtctcaacttca

SEQ ID NO: 15407 - DNA, 20 bp, Artificial Sequence
  Artificial sequence related to HLA knockouts in cell therapy
catctctgtctcaacttcat

SEQ ID NO: 15408 - DNA, 20 bp, Artificial Sequence
  Artificial sequence related to HLA knockouts in cell therapy
atctctgtctcaacttcatg

SEQ ID NO: 15409 - DNA, 20 bp, Artificial Sequence
  Artificial sequence related to HLA knockouts in cell therapy
tctctgtctcaacttcatgg

SEQ ID NO: 15410 - DNA, 20 bp, Artificial Sequence
  Artificial sequence related to HLA knockouts in cell therapy
ctctgtctcaacttcatggt

SEQ ID NO: 15411 - DNA, 20 bp, Artificial Sequence
  Artificial sequence related to HLA knockouts in cell therapy
tctgtctcaacttcatggtg

SEQ ID NO: 15412 - DNA, 20 bp, Artificial Sequence
  Artificial sequence related to HLA knockouts in cell therapy
ctgtctcaacttcatggtgc

SEQ ID NO: 15413 - DNA, 20 bp, Artificial Sequence
  Artificial sequence related to HLA knockouts in cell therapy
tgtctcaacttcatggtgca

SEQ ID NO: 15414 - DNA, 20 bp, Artificial Sequence
  Artificial sequence related to HLA knockouts in cell therapy
gtctcaacttcatggtgcac

SEQ ID NO: 15415 - DNA, 20 bp, Artificial Sequence
  Artificial sequence related to HLA knockouts in cell therapy
tctcaacttcatggtgcact

SEQ ID NO: 15416 - DNA, 20 bp, Artificial Sequence
  Artificial sequence related to HLA knockouts in cell therapy
ctcaacttcatggtgcactg

SEQ ID NO: 15417 - DNA, 20 bp, Artificial Sequence
  Artificial sequence related to HLA knockouts in cell therapy
tcaacttcatggtgcactga

SEQ ID NO: 15418 - DNA, 20 bp, Artificial Sequence
  Artificial sequence related to HLA knockouts in cell therapy
caacttcatggtgcactgag

SEQ ID NO: 15419 - DNA, 20 bp, Artificial Sequence
  Artificial sequence related to HLA knockouts in cell therapy
aacttcatggtgcactgagc

SEQ ID NO: 15420 - DNA, 20 bp, Artificial Sequence
  Artificial sequence related to HLA knockouts in cell therapy
acttcatggtgcactgagct

SEQ ID NO: 15421 - DNA, 20 bp, Artificial Sequence
  Artificial sequence related to HLA knockouts in cell therapy
cttcatggtgcactgagctg

SEQ ID NO: 15422 - DNA, 20 bp, Artificial Sequence
  Artificial sequence related to HLA knockouts in cell therapy
ttcatggtgcactgagctgt

SEQ ID NO: 15423 - DNA, 20 bp, Artificial Sequence
  Artificial sequence related to HLA knockouts in cell therapy
tcatggtgcactgagctgta

SEQ ID NO: 15424 - DNA, 20 bp, Artificial Sequence
  Artificial sequence related to HLA knockouts in cell therapy
catggtgcactgagctgtaa

SEQ ID NO: 15425 - DNA, 20 bp, Artificial Sequence
  Artificial sequence related to HLA knockouts in cell therapy
atggtgcactgagctgtaac

SEQ ID NO: 15426 - DNA, 20 bp, Artificial Sequence
  Artificial sequence related to HLA knockouts in cell therapy
tggtgcactgagctgtaact

SEQ ID NO: 15427 - DNA, 20 bp, Artificial Sequence
  Artificial sequence related to HLA knockouts in cell therapy
ggtgcactgagctgtaactt

SEQ ID NO: 15428 - DNA, 20 bp, Artificial Sequence
  Artificial sequence related to HLA knockouts in cell therapy
gtgcactgagctgtaacttc

SEQ ID NO: 15429 - DNA, 20 bp, Artificial Sequence
  Artificial sequence related to HLA knockouts in cell therapy
tgcactgagctgtaacttct

SEQ ID NO: 15430 - DNA, 20 bp, Artificial Sequence
  Artificial sequence related to HLA knockouts in cell therapy
gcactgagctgtaacttctt

SEQ ID NO: 15431 - DNA, 20 bp, Artificial Sequence
  Artificial sequence related to HLA knockouts in cell therapy
cactgagctgtaacttcttc

SEQ ID NO: 15432 - DNA, 20 bp, Artificial Sequence
  Artificial sequence related to HLA knockouts in cell therapy
actgagctgtaacttcttcc

SEQ ID NO: 15433 - DNA, 20 bp, Artificial Sequence
  Artificial sequence related to HLA knockouts in cell therapy
ctgagctgtaacttcttcct

SEQ ID NO: 15434 - DNA, 20 bp, Artificial Sequence
  Artificial sequence related to HLA knockouts in cell therapy
tgagctgtaacttcttcctt

SEQ ID NO: 15435 - DNA, 20 bp, Artificial Sequence
  Artificial sequence related to HLA knockouts in cell therapy
gagctgtaacttcttccttc

SEQ ID NO: 15436 - DNA, 20 bp, Artificial Sequence
  Artificial sequence related to HLA knockouts in cell therapy
agctgtaacttcttccttcc

SEQ ID NO: 15437 - DNA, 20 bp, Artificial Sequence
  Artificial sequence related to HLA knockouts in cell therapy
gctgtaacttcttccttccc

SEQ ID NO: 15438 - DNA, 20 bp, Artificial Sequence
  Artificial sequence related to HLA knockouts in cell therapy
ctgtaacttcttccttccct

SEQ ID NO: 15439 - DNA, 20 bp, Artificial Sequence
  Artificial sequence related to HLA knockouts in cell therapy
tgtaacttcttccttcccta

SEQ ID NO: 15440 - DNA, 20 bp, Artificial Sequence
  Artificial sequence related to HLA knockouts in cell therapy
gtaacttcttccttccctat

SEQ ID NO: 15441 - DNA, 20 bp, Artificial Sequence
  Artificial sequence related to HLA knockouts in cell therapy
taacttcttccttccctatt

SEQ ID NO: 15442 - DNA, 20 bp, Artificial Sequence
  Artificial sequence related to HLA knockouts in cell therapy
aacttcttccttccctatta

SEQ ID NO: 15443 - DNA, 20 bp, Artificial Sequence
  Artificial sequence related to HLA knockouts in cell therapy
acttcttccttccctattaa

SEQ ID NO: 15444 - DNA, 20 bp, Artificial Sequence
  Artificial sequence related to HLA knockouts in cell therapy
cttcttccttccctattaaa

SEQ ID NO: 15445 - DNA, 21 bp, Artificial Sequence
  Artificial sequence related to HLA knockouts in cell therapy
cccgaaggcggtgtatggatt

SEQ ID NO: 15446 - DNA, 21 bp, Artificial Sequence
  Artificial sequence related to HLA knockouts in cell therapy
ccgaaggcggtgtatggattg

SEQ ID NO: 15447 - DNA, 21 bp, Artificial Sequence
  Artificial sequence related to HLA knockouts in cell therapy
cgaaggcggtgtatggattgg

SEQ ID NO: 15448 - DNA, 21 bp, Artificial Sequence
  Artificial sequence related to HLA knockouts in cell therapy
gaaggcggtgtatggattggg

SEQ ID NO: 15449 - DNA, 21 bp, Artificial Sequence
  Artificial sequence related to HLA knockouts in cell therapy
ccctctcccaacctatgtagg

SEQ ID NO: 15450 - DNA, 21 bp, Artificial Sequence
  Artificial sequence related to HLA knockouts in cell therapy
cctctcccaacctatgtaggg

SEQ ID NO: 15451 - DNA, 21 bp, Artificial Sequence
  Artificial sequence related to HLA knockouts in cell therapy
ctctcccaacctatgtagggt

SEQ ID NO: 15452 - DNA, 21 bp, Artificial Sequence
  Artificial sequence related to HLA knockouts in cell therapy
tctcccaacctatgtagggtc

SEQ ID NO: 15453 - DNA, 21 bp, Artificial Sequence
  Artificial sequence related to HLA knockouts in cell therapy
ctcccaacctatgtagggtcc

SEQ ID NO: 15454 - DNA, 21 bp, Artificial Sequence
  Artificial sequence related to HLA knockouts in cell therapy
tcccaacctatgtagggtcct

SEQ ID NO: 15455 - DNA, 21 bp, Artificial Sequence
  Artificial sequence related to HLA knockouts in cell therapy
aacctatgtagggtccttctt

SEQ ID NO: 15456 - DNA, 21 bp, Artificial Sequence
  Artificial sequence related to HLA knockouts in cell therapy
atgtagggtccttcttcctgg

SEQ ID NO: 15457 - DNA, 21 bp, Artificial Sequence
  Artificial sequence related to HLA knockouts in cell therapy
tgtagggtccttcttcctgga

SEQ ID NO: 15458 - DNA, 21 bp, Artificial Sequence
  Artificial sequence related to HLA knockouts in cell therapy
ccttcttcctggatactcacg

SEQ ID NO: 15459 - DNA, 21 bp, Artificial Sequence
  Artificial sequence related to HLA knockouts in cell therapy
ttcttcctggatactcacgac

SEQ ID NO: 15460 - DNA, 21 bp, Artificial Sequence
  Artificial sequence related to HLA knockouts in cell therapy
tcttcctggatactcacgacg

SEQ ID NO: 15461 - DNA, 21 bp, Artificial Sequence
  Artificial sequence related to HLA knockouts in cell therapy
cttcctggatactcacgacgc

SEQ ID NO: 15462 - DNA, 21 bp, Artificial Sequence
  Artificial sequence related to HLA knockouts in cell therapy
ttcctggatactcacgacgcg

SEQ ID NO: 15463 - DNA, 21 bp, Artificial Sequence
  Artificial sequence related to HLA knockouts in cell therapy
ggacccagttctcactcccat

SEQ ID NO: 15464 - DNA, 21 bp, Artificial Sequence
  Artificial sequence related to HLA knockouts in cell therapy
cccagttctcactcccattgg

SEQ ID NO: 15465 - DNA, 21 bp, Artificial Sequence
  Artificial sequence related to HLA knockouts in cell therapy
ccagttctcactcccattggg

SEQ ID NO: 15466 - DNA, 21 bp, Artificial Sequence
  Artificial sequence related to HLA knockouts in cell therapy
cagttctcactcccattgggt

SEQ ID NO: 15467 - DNA, 21 bp, Artificial Sequence
  Artificial sequence related to HLA knockouts in cell therapy
agttctcactcccattgggtg

SEQ ID NO: 15468 - DNA, 21 bp, Artificial Sequence
  Artificial sequence related to HLA knockouts in cell therapy
gttctcactcccattgggtgt

SEQ ID NO: 15469 - DNA, 21 bp, Artificial Sequence
  Artificial sequence related to HLA knockouts in cell therapy
tctcactcccattgggtgtcg

SEQ ID NO: 15470 - DNA, 21 bp, Artificial Sequence
  Artificial sequence related to HLA knockouts in cell therapy
actcccattgggtgtcgggtt

SEQ ID NO: 15471 - DNA, 21 bp, Artificial Sequence
  Artificial sequence related to HLA knockouts in cell therapy
ctcccattgggtgtcgggttt

SEQ ID NO: 15472 - DNA, 21 bp, Artificial Sequence
  Artificial sequence related to HLA knockouts in cell therapy
tcccattgggtgtcgggtttc

SEQ ID NO: 15473 - DNA, 21 bp, Artificial Sequence
  Artificial sequence related to HLA knockouts in cell therapy
ccattgggtgtcgggtttcca

SEQ ID NO: 15474 - DNA, 21 bp, Artificial Sequence
  Artificial sequence related to HLA knockouts in cell therapy
cattgggtgtcgggtttccag

SEQ ID NO: 15475 - DNA, 21 bp, Artificial Sequence
  Artificial sequence related to HLA knockouts in cell therapy
ttgggtgtcgggtttccagag

SEQ ID NO: 15476 - DNA, 21 bp, Artificial Sequence
  Artificial sequence related to HLA knockouts in cell therapy
tgggtgtcgggtttccagaga

SEQ ID NO: 15477 - DNA, 21 bp, Artificial Sequence
  Artificial sequence related to HLA knockouts in cell therapy
gggtgtcgggtttccagagaa

SEQ ID NO: 15478 - DNA, 21 bp, Artificial Sequence
  Artificial sequence related to HLA knockouts in cell therapy
ggtgtcgggtttccagagaag

SEQ ID NO: 15479 - DNA, 21 bp, Artificial Sequence
  Artificial sequence related to HLA knockouts in cell therapy
gtgtcgggtttccagagaagc

SEQ ID NO: 15480 - DNA, 21 bp, Artificial Sequence
  Artificial sequence related to HLA knockouts in cell therapy
tgtcgggtttccagagaagcc

SEQ ID NO: 15481 - DNA, 21 bp, Artificial Sequence
  Artificial sequence related to HLA knockouts in cell therapy
gtcgggtttccagagaagcca

SEQ ID NO: 15482 - DNA, 21 bp, Artificial Sequence
  Artificial sequence related to HLA knockouts in cell therapy
cagagaagccaatcagtgtcg

SEQ ID NO: 15483 - DNA, 21 bp, Artificial Sequence
  Artificial sequence related to HLA knockouts in cell therapy
gagaagccaatcagtgtcgtc

SEQ ID NO: 15484 - DNA, 21 bp, Artificial Sequence
  Artificial sequence related to HLA knockouts in cell therapy
agaagccaatcagtgtcgtcg

SEQ ID NO: 15485 - DNA, 21 bp, Artificial Sequence
  Artificial sequence related to HLA knockouts in cell therapy
gaagccaatcagtgtcgtcgc

SEQ ID NO: 15486 - DNA, 21 bp, Artificial Sequence
  Artificial sequence related to HLA knockouts in cell therapy
tcgcggtcgcggttctaaagt

SEQ ID NO: 15487 - DNA, 21 bp, Artificial Sequence
  Artificial sequence related to HLA knockouts in cell therapy
gtcgcggttctaaagtccgca

SEQ ID NO: 15488 - DNA, 21 bp, Artificial Sequence
  Artificial sequence related to HLA knockouts in cell therapy
tcgcggttctaaagtccgcac

SEQ ID NO: 15489 - DNA, 21 bp, Artificial Sequence
  Artificial sequence related to HLA knockouts in cell therapy
cggttctaaagtccgcacgca

SEQ ID NO: 15490 - DNA, 21 bp, Artificial Sequence
  Artificial sequence related to HLA knockouts in cell therapy
ggttctaaagtccgcacgcac

SEQ ID NO: 15491 - DNA, 21 bp, Artificial Sequence
  Artificial sequence related to HLA knockouts in cell therapy
gttctaaagtccgcacgcacc

SEQ ID NO: 15492 - DNA, 21 bp, Artificial Sequence
  Artificial sequence related to HLA knockouts in cell therapy
ttctaaagtccgcacgcaccc

SEQ ID NO: 15493 - DNA, 21 bp, Artificial Sequence
  Artificial sequence related to HLA knockouts in cell therapy
tctaaagtccgcacgcaccca

SEQ ID NO: 15494 - DNA, 21 bp, Artificial Sequence
  Artificial sequence related to HLA knockouts in cell therapy
acccaccgggactcagattct

SEQ ID NO: 15495 - DNA, 21 bp, Artificial Sequence
  Artificial sequence related to HLA knockouts in cell therapy
gaaccctcgtcctgctactct

SEQ ID NO: 15496 - DNA, 21 bp, Artificial Sequence
  Artificial sequence related to HLA knockouts in cell therapy
aaccctcgtcctgctactctc

SEQ ID NO: 15497 - DNA, 21 bp, Artificial Sequence
  Artificial sequence related to HLA knockouts in cell therapy
gggctctcactccatgaggta

SEQ ID NO: 15498 - DNA, 21 bp, Artificial Sequence
  Artificial sequence related to HLA knockouts in cell therapy
tgaggtatttcttcacatccg

SEQ ID NO: 15499 - DNA, 21 bp, Artificial Sequence
  Artificial sequence related to HLA knockouts in cell therapy
gaggtatttcttcacatccgt

SEQ ID NO: 15500 - DNA, 21 bp, Artificial Sequence
  Artificial sequence related to HLA knockouts in cell therapy
aggtatttcttcacatccgtg

SEQ ID NO: 15501 - DNA, 21 bp, Artificial Sequence
  Artificial sequence related to HLA knockouts in cell therapy
ggtatttcttcacatccgtgt

SEQ ID NO: 15502 - DNA, 21 bp, Artificial Sequence
  Artificial sequence related to HLA knockouts in cell therapy
tatttcttcacatccgtgtcc

SEQ ID NO: 15503 - DNA, 21 bp, Artificial Sequence
  Artificial sequence related to HLA knockouts in cell therapy
atttcttcacatccgtgtccc

SEQ ID NO: 15504 - DNA, 21 bp, Artificial Sequence
  Artificial sequence related to HLA knockouts in cell therapy
tttcttcacatccgtgtcccg

SEQ ID NO: 15505 - DNA, 21 bp, Artificial Sequence
  Artificial sequence related to HLA knockouts in cell therapy
ttcttcacatccgtgtcccgg

SEQ ID NO: 15506 - DNA, 21 bp, Artificial Sequence
  Artificial sequence related to HLA knockouts in cell therapy
cttcatcgcagtgggctacgt

SEQ ID NO: 15507 - DNA, 21 bp, Artificial Sequence
  Artificial sequence related to HLA knockouts in cell therapy
ttcatcgcagtgggctacgtg

SEQ ID NO: 15508 - DNA, 21 bp, Artificial Sequence
  Artificial sequence related to HLA knockouts in cell therapy
ctacgtggacgacacgcagtt

SEQ ID NO: 15509 - DNA, 21 bp, Artificial Sequence
  Artificial sequence related to HLA knockouts in cell therapy
tacgtggacgacacgcagttc

SEQ ID NO: 15510 - DNA, 21 bp, Artificial Sequence
  Artificial sequence related to HLA knockouts in cell therapy
gggagacacggaaagtgaagg

SEQ ID NO: 15511 - DNA, 21 bp, Artificial Sequence
  Artificial sequence related to HLA knockouts in cell therapy
ggagacacggaaagtgaaggc

SEQ ID NO: 15512 - DNA, 21 bp, Artificial Sequence
  Artificial sequence related to HLA knockouts in cell therapy
gagacacggaaagtgaaggcc

SEQ ID NO: 15513 - DNA, 21 bp, Artificial Sequence
  Artificial sequence related to HLA knockouts in cell therapy
agacacggaaagtgaaggccc

SEQ ID NO: 15514 - DNA, 21 bp, Artificial Sequence
  Artificial sequence related to HLA knockouts in cell therapy
gacacggaaagtgaaggccca

SEQ ID NO: 15515 - DNA, 21 bp, Artificial Sequence
  Artificial sequence related to HLA knockouts in cell therapy
acacggaaagtgaaggcccac

SEQ ID NO: 15516 - DNA, 21 bp, Artificial Sequence
  Artificial sequence related to HLA knockouts in cell therapy
cacggaaagtgaaggcccact

SEQ ID NO: 15517 - DNA, 21 bp, Artificial Sequence
  Artificial sequence related to HLA knockouts in cell therapy
acggaaagtgaaggcccactc

SEQ ID NO: 15518 - DNA, 21 bp, Artificial Sequence
  Artificial sequence related to HLA knockouts in cell therapy
cggaaagtgaaggcccactca

SEQ ID NO: 15519 - DNA, 21 bp, Artificial Sequence
  Artificial sequence related to HLA knockouts in cell therapy
ggaaagtgaaggcccactcac

SEQ ID NO: 15520 - DNA, 21 bp, Artificial Sequence
  Artificial sequence related to HLA knockouts in cell therapy
aaagtgaaggcccactcacag

SEQ ID NO: 15521 - DNA, 21 bp, Artificial Sequence
  Artificial sequence related to HLA knockouts in cell therapy
aagtgaaggcccactcacaga

SEQ ID NO: 15522 - DNA, 21 bp, Artificial Sequence
  Artificial sequence related to HLA knockouts in cell therapy
agtgaaggcccactcacagac

SEQ ID NO: 15523 - DNA, 21 bp, Artificial Sequence
  Artificial sequence related to HLA knockouts in cell therapy
gtgaaggcccactcacagact

SEQ ID NO: 15524 - DNA, 21 bp, Artificial Sequence
  Artificial sequence related to HLA knockouts in cell therapy
tgaaggcccactcacagactc

SEQ ID NO: 15525 - DNA, 21 bp, Artificial Sequence
  Artificial sequence related to HLA knockouts in cell therapy
gaaggcccactcacagactca

SEQ ID NO: 15526 - DNA, 21 bp, Artificial Sequence
  Artificial sequence related to HLA knockouts in cell therapy
aaggcccactcacagactcac

SEQ ID NO: 15527 - DNA, 21 bp, Artificial Sequence
  Artificial sequence related to HLA knockouts in cell therapy
ccactcacagactcaccgagt

SEQ ID NO: 15528 - DNA, 21 bp, Artificial Sequence
  Artificial sequence related to HLA knockouts in cell therapy
cactcacagactcaccgagtg

SEQ ID NO: 15529 - DNA, 21 bp, Artificial Sequence
  Artificial sequence related to HLA knockouts in cell therapy
actcacagactcaccgagtgg

SEQ ID NO: 15530 - DNA, 21 bp, Artificial Sequence
  Artificial sequence related to HLA knockouts in cell therapy
ctcacagactcaccgagtgga

SEQ ID NO: 15531 - DNA, 21 bp, Artificial Sequence
  Artificial sequence related to HLA knockouts in cell therapy
tcacagactcaccgagtggac

SEQ ID NO: 15532 - DNA, 21 bp, Artificial Sequence
  Artificial sequence related to HLA knockouts in cell therapy
acagactcaccgagtggacct

SEQ ID NO: 15533 - DNA, 21 bp, Artificial Sequence
  Artificial sequence related to HLA knockouts in cell therapy
cggctactacaaccagagcga

SEQ ID NO: 15534 - DNA, 21 bp, Artificial Sequence
  Artificial sequence related to HLA knockouts in cell therapy
ggctactacaaccagagcgag

SEQ ID NO: 15535 - DNA, 21 bp, Artificial Sequence
  Artificial sequence related to HLA knockouts in cell therapy
gctactacaaccagagcgagg

SEQ ID NO: 15536 - DNA, 21 bp, Artificial Sequence
  Artificial sequence related to HLA knockouts in cell therapy
ctactacaaccagagcgaggc

SEQ ID NO: 15537 - DNA, 21 bp, Artificial Sequence
  Artificial sequence related to HLA knockouts in cell therapy
tactacaaccagagcgaggcc

SEQ ID NO: 15538 - DNA, 21 bp, Artificial Sequence
  Artificial sequence related to HLA knockouts in cell therapy
gttctcacaccgtccagagga

SEQ ID NO: 15539 - DNA, 21 bp, Artificial Sequence
  Artificial sequence related to HLA knockouts in cell therapy
tctcacaccgtccagaggatg

SEQ ID NO: 15540 - DNA, 21 bp, Artificial Sequence
  Artificial sequence related to HLA knockouts in cell therapy
ctcacaccgtccagaggatgt

SEQ ID NO: 15541 - DNA, 21 bp, Artificial Sequence
  Artificial sequence related to HLA knockouts in cell therapy
caccgtccagaggatgtatgg

SEQ ID NO: 15542 - DNA, 21 bp, Artificial Sequence
  Artificial sequence related to HLA knockouts in cell therapy
accgtccagaggatgtatggc

SEQ ID NO: 15543 - DNA, 21 bp, Artificial Sequence
  Artificial sequence related to HLA knockouts in cell therapy
ccgtccagaggatgtatggct

SEQ ID NO: 15544 - DNA, 21 bp, Artificial Sequence
  Artificial sequence related to HLA knockouts in cell therapy
cgtccagaggatgtatggctg

SEQ ID NO: 15545 - DNA, 21 bp, Artificial Sequence
  Artificial sequence related to HLA knockouts in cell therapy
gtccagaggatgtatggctgc

SEQ ID NO: 15546 - DNA, 21 bp, Artificial Sequence
  Artificial sequence related to HLA knockouts in cell therapy
tccagaggatgtatggctgcg

SEQ ID NO: 15547 - DNA, 21 bp, Artificial Sequence
  Artificial sequence related to HLA knockouts in cell therapy
ccagaggatgtatggctgcga

SEQ ID NO: 15548 - DNA, 21 bp, Artificial Sequence
  Artificial sequence related to HLA knockouts in cell therapy
cagaggatgtatggctgcgac

SEQ ID NO: 15549 - DNA, 21 bp, Artificial Sequence
  Artificial sequence related to HLA knockouts in cell therapy
agaggatgtatggctgcgacg

SEQ ID NO: 15550 - DNA, 21 bp, Artificial Sequence
  Artificial sequence related to HLA knockouts in cell therapy
gaggatgtatggctgcgacgt

SEQ ID NO: 15551 - DNA, 21 bp, Artificial Sequence
  Artificial sequence related to HLA knockouts in cell therapy
aggatgtatggctgcgacgtg

SEQ ID NO: 15552 - DNA, 21 bp, Artificial Sequence
  Artificial sequence related to HLA knockouts in cell therapy
gtaccaccagtacgcctacga

SEQ ID NO: 15553 - DNA, 21 bp, Artificial Sequence
  Artificial sequence related to HLA knockouts in cell therapy
taccaccagtacgcctacgac

SEQ ID NO: 15554 - DNA, 21 bp, Artificial Sequence
  Artificial sequence related to HLA knockouts in cell therapy
tacgcctacgacggcaaggat

SEQ ID NO: 15555 - DNA, 21 bp, Artificial Sequence
  Artificial sequence related to HLA knockouts in cell therapy
acgcctacgacggcaaggatt

SEQ ID NO: 15556 - DNA, 21 bp, Artificial Sequence
  Artificial sequence related to HLA knockouts in cell therapy
cgacggcaaggattacatcgc

SEQ ID NO: 15557 - DNA, 21 bp, Artificial Sequence
  Artificial sequence related to HLA knockouts in cell therapy
gacggcaaggattacatcgcc

SEQ ID NO: 15558 - DNA, 21 bp, Artificial Sequence
  Artificial sequence related to HLA knockouts in cell therapy
acggcaaggattacatcgccc

SEQ ID NO: 15559 - DNA, 21 bp, Artificial Sequence
  Artificial sequence related to HLA knockouts in cell therapy
cggcaaggattacatcgccct

SEQ ID NO: 15560 - DNA, 21 bp, Artificial Sequence
  Artificial sequence related to HLA knockouts in cell therapy
ggcaaggattacatcgccctg

SEQ ID NO: 15561 - DNA, 21 bp, Artificial Sequence
  Artificial sequence related to HLA knockouts in cell therapy
gcaaggattacatcgccctga

SEQ ID NO: 15562 - DNA, 21 bp, Artificial Sequence
  Artificial sequence related to HLA knockouts in cell therapy
aaggattacatcgccctgaaa

SEQ ID NO: 15563 - DNA, 21 bp, Artificial Sequence
  Artificial sequence related to HLA knockouts in cell therapy
tacatcgccctgaaagaggac

SEQ ID NO: 15564 - DNA, 21 bp, Artificial Sequence
  Artificial sequence related to HLA knockouts in cell therapy
acatcgccctgaaagaggacc

SEQ ID NO: 15565 - DNA, 21 bp, Artificial Sequence
  Artificial sequence related to HLA knockouts in cell therapy
catcgccctgaaagaggacct

SEQ ID NO: 15566 - DNA, 21 bp, Artificial Sequence
  Artificial sequence related to HLA knockouts in cell therapy
atcgccctgaaagaggacctg

SEQ ID NO: 15567 - DNA, 21 bp, Artificial Sequence
  Artificial sequence related to HLA knockouts in cell therapy
ctgaaagaggacctgcgctct

SEQ ID NO: 15568 - DNA, 21 bp, Artificial Sequence
  Artificial sequence related to HLA knockouts in cell therapy
tgaaagaggacctgcgctctt

SEQ ID NO: 15569 - DNA, 21 bp, Artificial Sequence
  Artificial sequence related to HLA knockouts in cell therapy
gaaagaggacctgcgctcttg

SEQ ID NO: 15570 - DNA, 21 bp, Artificial Sequence
  Artificial sequence related to HLA knockouts in cell therapy
acatggcagctcagaccacca

SEQ ID NO: 15571 - DNA, 21 bp, Artificial Sequence
  Artificial sequence related to HLA knockouts in cell therapy
catggcagctcagaccaccaa

SEQ ID NO: 15572 - DNA, 21 bp, Artificial Sequence
  Artificial sequence related to HLA knockouts in cell therapy
atggcagctcagaccaccaag

SEQ ID NO: 15573 - DNA, 21 bp, Artificial Sequence
  Artificial sequence related to HLA knockouts in cell therapy
cagctcagaccaccaagcaca

SEQ ID NO: 15574 - DNA, 21 bp, Artificial Sequence
  Artificial sequence related to HLA knockouts in cell therapy
gctcagaccaccaagcacaag

SEQ ID NO: 15575 - DNA, 21 bp, Artificial Sequence
  Artificial sequence related to HLA knockouts in cell therapy
cagaccaccaagcacaagtgg

SEQ ID NO: 15576 - DNA, 21 bp, Artificial Sequence
  Artificial sequence related to HLA knockouts in cell therapy
agaccaccaagcacaagtggg

SEQ ID NO: 15577 - DNA, 21 bp, Artificial Sequence
  Artificial sequence related to HLA knockouts in cell therapy
gaccaccaagcacaagtggga

SEQ ID NO: 15578 - DNA, 21 bp, Artificial Sequence
  Artificial sequence related to HLA knockouts in cell therapy
accaccaagcacaagtgggag

SEQ ID NO: 15579 - DNA, 21 bp, Artificial Sequence
  Artificial sequence related to HLA knockouts in cell therapy
catgtggcggagcagttgaga

SEQ ID NO: 15580 - DNA, 21 bp, Artificial Sequence
  Artificial sequence related to HLA knockouts in cell therapy
atgtggcggagcagttgagag

SEQ ID NO: 15581 - DNA, 21 bp, Artificial Sequence
  Artificial sequence related to HLA knockouts in cell therapy
ggagcagttgagagcctacct

SEQ ID NO: 15582 - DNA, 21 bp, Artificial Sequence
  Artificial sequence related to HLA knockouts in cell therapy
gagcagttgagagcctacctg

SEQ ID NO: 15583 - DNA, 21 bp, Artificial Sequence
  Artificial sequence related to HLA knockouts in cell therapy
agcagttgagagcctacctgg

SEQ ID NO: 15584 - DNA, 21 bp, Artificial Sequence
  Artificial sequence related to HLA knockouts in cell therapy
gcagttgagagcctacctgga

SEQ ID NO: 15585 - DNA, 21 bp, Artificial Sequence
  Artificial sequence related to HLA knockouts in cell therapy
cagttgagagcctacctggag

SEQ ID NO: 15586 - DNA, 21 bp, Artificial Sequence
  Artificial sequence related to HLA knockouts in cell therapy
agttgagagcctacctggagg

SEQ ID NO: 15587 - DNA, 21 bp, Artificial Sequence
  Artificial sequence related to HLA knockouts in cell therapy
gctccgcagatacctggagaa

SEQ ID NO: 15588 - DNA, 21 bp, Artificial Sequence
  Artificial sequence related to HLA knockouts in cell therapy
ctccgcagatacctggagaac

SEQ ID NO: 15589 - DNA, 21 bp, Artificial Sequence
  Artificial sequence related to HLA knockouts in cell therapy
tccgcagatacctggagaacg

SEQ ID NO: 15590 - DNA, 21 bp, Artificial Sequence
  Artificial sequence related to HLA knockouts in cell therapy
gcagatacctggagaacggga

SEQ ID NO: 15591 - DNA, 21 bp, Artificial Sequence
  Artificial sequence related to HLA knockouts in cell therapy
cagatacctggagaacgggaa

SEQ ID NO: 15592 - DNA, 21 bp, Artificial Sequence
  Artificial sequence related to HLA knockouts in cell therapy
gatacctggagaacgggaagg

SEQ ID NO: 15593 - DNA, 21 bp, Artificial Sequence
  Artificial sequence related to HLA knockouts in cell therapy
tacctggagaacgggaaggag

SEQ ID NO: 15594 - DNA, 21 bp, Artificial Sequence
  Artificial sequence related to HLA knockouts in cell therapy
acctggagaacgggaaggaga

SEQ ID NO: 15595 - DNA, 21 bp, Artificial Sequence
  Artificial sequence related to HLA knockouts in cell therapy
aacgcatatgactcaccacgc

SEQ ID NO: 15596 - DNA, 21 bp, Artificial Sequence
  Artificial sequence related to HLA knockouts in cell therapy
acgcatatgactcaccacgct

SEQ ID NO: 15597 - DNA, 21 bp, Artificial Sequence
  Artificial sequence related to HLA knockouts in cell therapy
cgcatatgactcaccacgctg

SEQ ID NO: 15598 - DNA, 21 bp, Artificial Sequence
  Artificial sequence related to HLA knockouts in cell therapy
gcatatgactcaccacgctgt

SEQ ID NO: 15599 - DNA, 21 bp, Artificial Sequence
  Artificial sequence related to HLA knockouts in cell therapy
catatgactcaccacgctgtc

SEQ ID NO: 15600 - DNA, 21 bp, Artificial Sequence
  Artificial sequence related to HLA knockouts in cell therapy
tgactcaccacgctgtctctg

SEQ ID NO: 15601 - DNA, 21 bp, Artificial Sequence
  Artificial sequence related to HLA knockouts in cell therapy
gactcaccacgctgtctctga

SEQ ID NO: 15602 - DNA, 21 bp, Artificial Sequence
  Artificial sequence related to HLA knockouts in cell therapy
actcaccacgctgtctctgac

SEQ ID NO: 15603 - DNA, 21 bp, Artificial Sequence
  Artificial sequence related to HLA knockouts in cell therapy
tcaccacgctgtctctgacca

SEQ ID NO: 15604 - DNA, 21 bp, Artificial Sequence
  Artificial sequence related to HLA knockouts in cell therapy
caccacgctgtctctgaccat

SEQ ID NO: 15605 - DNA, 21 bp, Artificial Sequence
  Artificial sequence related to HLA knockouts in cell therapy
accacgctgtctctgaccatg

SEQ ID NO: 15606 - DNA, 21 bp, Artificial Sequence
  Artificial sequence related to HLA knockouts in cell therapy
ccacgctgtctctgaccatga

SEQ ID NO: 15607 - DNA, 21 bp, Artificial Sequence
  Artificial sequence related to HLA knockouts in cell therapy
cgctgtctctgaccatgaagc

SEQ ID NO: 15608 - DNA, 21 bp, Artificial Sequence
  Artificial sequence related to HLA knockouts in cell therapy
gctgtctctgaccatgaagcc

SEQ ID NO: 15609 - DNA, 21 bp, Artificial Sequence
  Artificial sequence related to HLA knockouts in cell therapy
ctgtctctgaccatgaagcca

SEQ ID NO: 15610 - DNA, 21 bp, Artificial Sequence
  Artificial sequence related to HLA knockouts in cell therapy
tgtctctgaccatgaagccac

SEQ ID NO: 15611 - DNA, 21 bp, Artificial Sequence
  Artificial sequence related to HLA knockouts in cell therapy
gtctctgaccatgaagccacc

SEQ ID NO: 15612 - DNA, 21 bp, Artificial Sequence
  Artificial sequence related to HLA knockouts in cell therapy
tctctgaccatgaagccaccc

SEQ ID NO: 15613 - DNA, 21 bp, Artificial Sequence
  Artificial sequence related to HLA knockouts in cell therapy
ctctgaccatgaagccaccct

SEQ ID NO: 15614 - DNA, 21 bp, Artificial Sequence
  Artificial sequence related to HLA knockouts in cell therapy
tctgaccatgaagccaccctg

SEQ ID NO: 15615 - DNA, 21 bp, Artificial Sequence
  Artificial sequence related to HLA knockouts in cell therapy
ctgaccatgaagccaccctga

SEQ ID NO: 15616 - DNA, 21 bp, Artificial Sequence
  Artificial sequence related to HLA knockouts in cell therapy
tgaccatgaagccaccctgag

SEQ ID NO: 15617 - DNA, 21 bp, Artificial Sequence
  Artificial sequence related to HLA knockouts in cell therapy
accatgaagccaccctgaggt

SEQ ID NO: 15618 - DNA, 21 bp, Artificial Sequence
  Artificial sequence related to HLA knockouts in cell therapy
atgaagccaccctgaggtgct

SEQ ID NO: 15619 - DNA, 21 bp, Artificial Sequence
  Artificial sequence related to HLA knockouts in cell therapy
tgagcttctaccctgcggaga

SEQ ID NO: 15620 - DNA, 21 bp, Artificial Sequence
  Artificial sequence related to HLA knockouts in cell therapy
gagcttctaccctgcggagat

SEQ ID NO: 15621 - DNA, 21 bp, Artificial Sequence
  Artificial sequence related to HLA knockouts in cell therapy
agcttctaccctgcggagatc

SEQ ID NO: 15622 - DNA, 21 bp, Artificial Sequence
  Artificial sequence related to HLA knockouts in cell therapy
gcttctaccctgcggagatca

SEQ ID NO: 15623 - DNA, 21 bp, Artificial Sequence
  Artificial sequence related to HLA knockouts in cell therapy
cttctaccctgcggagatcac

SEQ ID NO: 15624 - DNA, 21 bp, Artificial Sequence
  Artificial sequence related to HLA knockouts in cell therapy
tctaccctgcggagatcacac

SEQ ID NO: 15625 - DNA, 21 bp, Artificial Sequence
  Artificial sequence related to HLA knockouts in cell therapy
ctaccctgcggagatcacact

SEQ ID NO: 15626 - DNA, 21 bp, Artificial Sequence
  Artificial sequence related to HLA knockouts in cell therapy
taccctgcggagatcacactg

SEQ ID NO: 15627 - DNA, 21 bp, Artificial Sequence
  Artificial sequence related to HLA knockouts in cell therapy
accctgcggagatcacactga

SEQ ID NO: 15628 - DNA, 21 bp, Artificial Sequence
  Artificial sequence related to HLA knockouts in cell therapy
ctgcggagatcacactgacct

SEQ ID NO: 15629 - DNA, 21 bp, Artificial Sequence
  Artificial sequence related to HLA knockouts in cell therapy
tgcggagatcacactgacctg

SEQ ID NO: 15630 - DNA, 21 bp, Artificial Sequence
  Artificial sequence related to HLA knockouts in cell therapy
gagatcacactgacctggcag

SEQ ID NO: 15631 - DNA, 21 bp, Artificial Sequence
  Artificial sequence related to HLA knockouts in cell therapy
agatcacactgacctggcagc

SEQ ID NO: 15632 - DNA, 21 bp, Artificial Sequence
  Artificial sequence related to HLA knockouts in cell therapy
atggaaccttccagaagtggg

SEQ ID NO: 15633 - DNA, 21 bp, Artificial Sequence
  Artificial sequence related to HLA knockouts in cell therapy
tggaaccttccagaagtgggc

SEQ ID NO: 15634 - DNA, 21 bp, Artificial Sequence
  Artificial sequence related to HLA knockouts in cell therapy
tgtggtggtgccttctggaca

SEQ ID NO: 15635 - DNA, 21 bp, Artificial Sequence
  Artificial sequence related to HLA knockouts in cell therapy
tgccttctggacaggagcaga

SEQ ID NO: 15636 - DNA, 21 bp, Artificial Sequence
  Artificial sequence related to HLA knockouts in cell therapy
ccttctggacaggagcagaga

SEQ ID NO: 15637 - DNA, 21 bp, Artificial Sequence
  Artificial sequence related to HLA knockouts in cell therapy
ggacaggagcagagatacacc

SEQ ID NO: 15638 - DNA, 21 bp, Artificial Sequence
  Artificial sequence related to HLA knockouts in cell therapy
acaggagcagagatacacctg

SEQ ID NO: 15639 - DNA, 21 bp, Artificial Sequence
  Artificial sequence related to HLA knockouts in cell therapy
caggagcagagatacacctgc

SEQ ID NO: 15640 - DNA, 21 bp, Artificial Sequence
  Artificial sequence related to HLA knockouts in cell therapy
aggagcagagatacacctgcc

SEQ ID NO: 15641 - DNA, 21 bp, Artificial Sequence
  Artificial sequence related to HLA knockouts in cell therapy
ggagcagagatacacctgcca

SEQ ID NO: 15642 - DNA, 21 bp, Artificial Sequence
  Artificial sequence related to HLA knockouts in cell therapy
agcagagatacacctgccatg

SEQ ID NO: 15643 - DNA, 21 bp, Artificial Sequence
  Artificial sequence related to HLA knockouts in cell therapy
agatacacctgccatgtgcag

SEQ ID NO: 15644 - DNA, 21 bp, Artificial Sequence
  Artificial sequence related to HLA knockouts in cell therapy
gatacacctgccatgtgcagc

SEQ ID NO: 15645 - DNA, 21 bp, Artificial Sequence
  Artificial sequence related to HLA knockouts in cell therapy
atacacctgccatgtgcagca

SEQ ID NO: 15646 - DNA, 21 bp, Artificial Sequence
  Artificial sequence related to HLA knockouts in cell therapy
acacctgccatgtgcagcatg

SEQ ID NO: 15647 - DNA, 21 bp, Artificial Sequence
  Artificial sequence related to HLA knockouts in cell therapy
acctgccatgtgcagcatgag

SEQ ID NO: 15648 - DNA, 21 bp, Artificial Sequence
  Artificial sequence related to HLA knockouts in cell therapy
tgccatgtgcagcatgagggt

SEQ ID NO: 15649 - DNA, 21 bp, Artificial Sequence
  Artificial sequence related to HLA knockouts in cell therapy
gccatgtgcagcatgagggtt

SEQ ID NO: 15650 - DNA, 21 bp, Artificial Sequence
  Artificial sequence related to HLA knockouts in cell therapy
tgtgcagcatgagggtttgcc

SEQ ID NO: 15651 - DNA, 21 bp, Artificial Sequence
  Artificial sequence related to HLA knockouts in cell therapy
tgcagcatgagggtttgccca

SEQ ID NO: 15652 - DNA, 21 bp, Artificial Sequence
  Artificial sequence related to HLA knockouts in cell therapy
gcagcatgagggtttgcccaa

SEQ ID NO: 15653 - DNA, 21 bp, Artificial Sequence
  Artificial sequence related to HLA knockouts in cell therapy
cagcatgagggtttgcccaag

SEQ ID NO: 15654 - DNA, 21 bp, Artificial Sequence
  Artificial sequence related to HLA knockouts in cell therapy
agcatgagggtttgcccaagc

SEQ ID NO: 15655 - DNA, 21 bp, Artificial Sequence
  Artificial sequence related to HLA knockouts in cell therapy
cccatcgtgggcatcattgct

SEQ ID NO: 15656 - DNA, 21 bp, Artificial Sequence
  Artificial sequence related to HLA knockouts in cell therapy
ccatcgtgggcatcattgctg

SEQ ID NO: 15657 - DNA, 21 bp, Artificial Sequence
  Artificial sequence related to HLA knockouts in cell therapy
catcgtgggcatcattgctgg

SEQ ID NO: 15658 - DNA, 21 bp, Artificial Sequence
  Artificial sequence related to HLA knockouts in cell therapy
atcgtgggcatcattgctggc

SEQ ID NO: 15659 - DNA, 21 bp, Artificial Sequence
  Artificial sequence related to HLA knockouts in cell therapy
ggcatcattgctggcctggtt

SEQ ID NO: 15660 - DNA, 21 bp, Artificial Sequence
  Artificial sequence related to HLA knockouts in cell therapy
gcatcattgctggcctggttc

SEQ ID NO: 15661 - DNA, 21 bp, Artificial Sequence
  Artificial sequence related to HLA knockouts in cell therapy
tgctggcctggttctctttgg

SEQ ID NO: 15662 - DNA, 21 bp, Artificial Sequence
  Artificial sequence related to HLA knockouts in cell therapy
gctggcctggttctctttgga

SEQ ID NO: 15663 - DNA, 21 bp, Artificial Sequence
  Artificial sequence related to HLA knockouts in cell therapy
ctggcctggttctctttggag

SEQ ID NO: 15664 - DNA, 21 bp, Artificial Sequence
  Artificial sequence related to HLA knockouts in cell therapy
tggcctggttctctttggagc

SEQ ID NO: 15665 - DNA, 21 bp, Artificial Sequence
  Artificial sequence related to HLA knockouts in cell therapy
ggcctggttctctttggagct

SEQ ID NO: 15666 - DNA, 21 bp, Artificial Sequence
  Artificial sequence related to HLA knockouts in cell therapy
gcctggttctctttggagctg

SEQ ID NO: 15667 - DNA, 21 bp, Artificial Sequence
  Artificial sequence related to HLA knockouts in cell therapy
ctggttctctttggagctgtg

SEQ ID NO: 15668 - DNA, 21 bp, Artificial Sequence
  Artificial sequence related to HLA knockouts in cell therapy
ctttggagctgtgatcactgg

SEQ ID NO: 15669 - DNA, 21 bp, Artificial Sequence
  Artificial sequence related to HLA knockouts in cell therapy
ttggagctgtgatcactggag

SEQ ID NO: 15670 - DNA, 21 bp, Artificial Sequence
  Artificial sequence related to HLA knockouts in cell therapy
tggagctgtgatcactggagc

SEQ ID NO: 15671 - DNA, 21 bp, Artificial Sequence
  Artificial sequence related to HLA knockouts in cell therapy
ggagctgtgatcactggagct

SEQ ID NO: 15672 - DNA, 21 bp, Artificial Sequence
  Artificial sequence related to HLA knockouts in cell therapy
gagctgtgatcactggagctg

SEQ ID NO: 15673 - DNA, 21 bp, Artificial Sequence
  Artificial sequence related to HLA knockouts in cell therapy
gctgtgatcactggagctgtg

SEQ ID NO: 15674 - DNA, 21 bp, Artificial Sequence
  Artificial sequence related to HLA knockouts in cell therapy
ctgtgatcactggagctgtgg

SEQ ID NO: 15675 - DNA, 21 bp, Artificial Sequence
  Artificial sequence related to HLA knockouts in cell therapy
gtgatcactggagctgtggtc

SEQ ID NO: 15676 - DNA, 21 bp, Artificial Sequence
  Artificial sequence related to HLA knockouts in cell therapy
tgatcactggagctgtggtcg

SEQ ID NO: 15677 - DNA, 21 bp, Artificial Sequence
  Artificial sequence related to HLA knockouts in cell therapy
atcactggagctgtggtcgct

SEQ ID NO: 15678 - DNA, 21 bp, Artificial Sequence
  Artificial sequence related to HLA knockouts in cell therapy
agctgtggtcgctgctgtgat

SEQ ID NO: 15679 - DNA, 21 bp, Artificial Sequence
  Artificial sequence related to HLA knockouts in cell therapy
ctgtggtcgctgctgtgatgt

SEQ ID NO: 15680 - DNA, 21 bp, Artificial Sequence
  Artificial sequence related to HLA knockouts in cell therapy
tgtggtcgctgctgtgatgtg

SEQ ID NO: 15681 - DNA, 21 bp, Artificial Sequence
  Artificial sequence related to HLA knockouts in cell therapy
tggtcgctgctgtgatgtgga

SEQ ID NO: 15682 - DNA, 21 bp, Artificial Sequence
  Artificial sequence related to HLA knockouts in cell therapy
tcgctgctgtgatgtggagga

SEQ ID NO: 15683 - DNA, 21 bp, Artificial Sequence
  Artificial sequence related to HLA knockouts in cell therapy
ctgctgtgatgtggaggagga

SEQ ID NO: 15684 - DNA, 21 bp, Artificial Sequence
  Artificial sequence related to HLA knockouts in cell therapy
gctgtgatgtggaggaggaag

SEQ ID NO: 15685 - DNA, 21 bp, Artificial Sequence
  Artificial sequence related to HLA knockouts in cell therapy
gtgatgtggaggaggaagagc

SEQ ID NO: 15686 - DNA, 21 bp, Artificial Sequence
  Artificial sequence related to HLA knockouts in cell therapy
gatgtggaggaggaagagctc

SEQ ID NO: 15687 - DNA, 21 bp, Artificial Sequence
  Artificial sequence related to HLA knockouts in cell therapy
tgtggaggaggaagagctcag

SEQ ID NO: 15688 - DNA, 21 bp, Artificial Sequence
  Artificial sequence related to HLA knockouts in cell therapy
gtggaggaggaagagctcaga

SEQ ID NO: 15689 - DNA, 21 bp, Artificial Sequence
  Artificial sequence related to HLA knockouts in cell therapy
aaaggagggagctactctcag

SEQ ID NO: 15690 - DNA, 21 bp, Artificial Sequence
  Artificial sequence related to HLA knockouts in cell therapy
aaggagggagctactctcagg

SEQ ID NO: 15691 - DNA, 21 bp, Artificial Sequence
  Artificial sequence related to HLA knockouts in cell therapy
ggagctactctcaggctgcaa

SEQ ID NO: 15692 - DNA, 21 bp, Artificial Sequence
  Artificial sequence related to HLA knockouts in cell therapy
gagctactctcaggctgcaag

SEQ ID NO: 15693 - DNA, 21 bp, Artificial Sequence
  Artificial sequence related to HLA knockouts in cell therapy
agctactctcaggctgcaagc

SEQ ID NO: 15694 - DNA, 21 bp, Artificial Sequence
  Artificial sequence related to HLA knockouts in cell therapy
gctactctcaggctgcaagca

SEQ ID NO: 15695 - DNA, 21 bp, Artificial Sequence
  Artificial sequence related to HLA knockouts in cell therapy
ctactctcaggctgcaagcag

SEQ ID NO: 15696 - DNA, 21 bp, Artificial Sequence
  Artificial sequence related to HLA knockouts in cell therapy
actctcaggctgcaagcagtg

SEQ ID NO: 15697 - DNA, 21 bp, Artificial Sequence
  Artificial sequence related to HLA knockouts in cell therapy
ctctcaggctgcaagcagtga

SEQ ID NO: 15698 - DNA, 21 bp, Artificial Sequence
  Artificial sequence related to HLA knockouts in cell therapy
tctcaggctgcaagcagtgac

SEQ ID NO: 15699 - DNA, 21 bp, Artificial Sequence
  Artificial sequence related to HLA knockouts in cell therapy
ctcaggctgcaagcagtgaca

SEQ ID NO: 15700 - DNA, 21 bp, Artificial Sequence
  Artificial sequence related to HLA knockouts in cell therapy
tcaggctgcaagcagtgacag

SEQ ID NO: 15701 - DNA, 21 bp, Artificial Sequence
  Artificial sequence related to HLA knockouts in cell therapy
caggctgcaagcagtgacagt

SEQ ID NO: 15702 - DNA, 21 bp, Artificial Sequence
  Artificial sequence related to HLA knockouts in cell therapy
aggctgcaagcagtgacagtg

SEQ ID NO: 15703 - DNA, 21 bp, Artificial Sequence
  Artificial sequence related to HLA knockouts in cell therapy
tgcaagcagtgacagtgccca

SEQ ID NO: 15704 - DNA, 21 bp, Artificial Sequence
  Artificial sequence related to HLA knockouts in cell therapy
ccagggctctgatgtgtctct

SEQ ID NO: 15705 - DNA, 21 bp, Artificial Sequence
  Artificial sequence related to HLA knockouts in cell therapy
cagggctctgatgtgtctctc

SEQ ID NO: 15706 - DNA, 21 bp, Artificial Sequence
  Artificial sequence related to HLA knockouts in cell therapy
gggctctgatgtgtctctcac

SEQ ID NO: 15707 - DNA, 21 bp, Artificial Sequence
  Artificial sequence related to HLA knockouts in cell therapy
ctctgatgtgtctctcacagc

SEQ ID NO: 15708 - DNA, 21 bp, Artificial Sequence
  Artificial sequence related to HLA knockouts in cell therapy
ctcacagcttgtaaagtgtga

SEQ ID NO: 15709 - DNA, 21 bp, Artificial Sequence
  Artificial sequence related to HLA knockouts in cell therapy
tcacagcttgtaaagtgtgag

SEQ ID NO: 15710 - DNA, 21 bp, Artificial Sequence
  Artificial sequence related to HLA knockouts in cell therapy
gcttgtaaagtgtgagacagc

SEQ ID NO: 15711 - DNA, 21 bp, Artificial Sequence
  Artificial sequence related to HLA knockouts in cell therapy
ttgtaaagtgtgagacagctg

SEQ ID NO: 15712 - DNA, 21 bp, Artificial Sequence
  Artificial sequence related to HLA knockouts in cell therapy
tgtaaagtgtgagacagctgc

SEQ ID NO: 15713 - DNA, 21 bp, Artificial Sequence
  Artificial sequence related to HLA knockouts in cell therapy
gtaaagtgtgagacagctgcc

SEQ ID NO: 15714 - DNA, 21 bp, Artificial Sequence
  Artificial sequence related to HLA knockouts in cell therapy
taaagtgtgagacagctgcct

SEQ ID NO: 15715 - DNA, 21 bp, Artificial Sequence
  Artificial sequence related to HLA knockouts in cell therapy
aaagtgtgagacagctgcctt

SEQ ID NO: 15716 - DNA, 21 bp, Artificial Sequence
  Artificial sequence related to HLA knockouts in cell therapy
gtgtgagacagctgccttgtg

SEQ ID NO: 15717 - DNA, 21 bp, Artificial Sequence
  Artificial sequence related to HLA knockouts in cell therapy
gtgagacagctgccttgtgtg

SEQ ID NO: 15718 - DNA, 21 bp, Artificial Sequence
  Artificial sequence related to HLA knockouts in cell therapy
tgagacagctgccttgtgtgg

SEQ ID NO: 15719 - DNA, 21 bp, Artificial Sequence
  Artificial sequence related to HLA knockouts in cell therapy
agacagctgccttgtgtggga

SEQ ID NO: 15720 - DNA, 21 bp, Artificial Sequence
  Artificial sequence related to HLA knockouts in cell therapy
acagctgccttgtgtgggact

SEQ ID NO: 15721 - DNA, 21 bp, Artificial Sequence
  Artificial sequence related to HLA knockouts in cell therapy
agctgccttgtgtgggactga

SEQ ID NO: 15722 - DNA, 21 bp, Artificial Sequence
  Artificial sequence related to HLA knockouts in cell therapy
ctgccttgtgtgggactgaga

SEQ ID NO: 15723 - DNA, 21 bp, Artificial Sequence
  Artificial sequence related to HLA knockouts in cell therapy
tgccttgtgtgggactgagag

SEQ ID NO: 15724 - DNA, 21 bp, Artificial Sequence
  Artificial sequence related to HLA knockouts in cell therapy
cttgtgtgggactgagaggca

SEQ ID NO: 15725 - DNA, 21 bp, Artificial Sequence
  Artificial sequence related to HLA knockouts in cell therapy
tgtgtgggactgagaggcaag

SEQ ID NO: 15726 - DNA, 21 bp, Artificial Sequence
  Artificial sequence related to HLA knockouts in cell therapy
gtgtgggactgagaggcaaga

SEQ ID NO: 15727 - DNA, 21 bp, Artificial Sequence
  Artificial sequence related to HLA knockouts in cell therapy
tgtgggactgagaggcaagag

SEQ ID NO: 15728 - DNA, 21 bp, Artificial Sequence
  Artificial sequence related to HLA knockouts in cell therapy
gtgggactgagaggcaagagt

SEQ ID NO: 15729 - DNA, 21 bp, Artificial Sequence
  Artificial sequence related to HLA knockouts in cell therapy
gggactgagaggcaagagttg

SEQ ID NO: 15730 - DNA, 21 bp, Artificial Sequence
  Artificial sequence related to HLA knockouts in cell therapy
agaggcaagagttgttcctgc

SEQ ID NO: 15731 - DNA, 21 bp, Artificial Sequence
  Artificial sequence related to HLA knockouts in cell therapy
gaggcaagagttgttcctgcc

SEQ ID NO: 15732 - DNA, 21 bp, Artificial Sequence
  Artificial sequence related to HLA knockouts in cell therapy
aggcaagagttgttcctgccc

SEQ ID NO: 15733 - DNA, 21 bp, Artificial Sequence
  Artificial sequence related to HLA knockouts in cell therapy
ggcaagagttgttcctgccct

SEQ ID NO: 15734 - DNA, 21 bp, Artificial Sequence
  Artificial sequence related to HLA knockouts in cell therapy
gcaagagttgttcctgccctt

SEQ ID NO: 15735 - DNA, 21 bp, Artificial Sequence
  Artificial sequence related to HLA knockouts in cell therapy
caagagttgttcctgcccttc

SEQ ID NO: 15736 - DNA, 21 bp, Artificial Sequence
  Artificial sequence related to HLA knockouts in cell therapy
aagagttgttcctgcccttcc

SEQ ID NO: 15737 - DNA, 21 bp, Artificial Sequence
  Artificial sequence related to HLA knockouts in cell therapy
agagttgttcctgcccttccc

SEQ ID NO: 15738 - DNA, 21 bp, Artificial Sequence
  Artificial sequence related to HLA knockouts in cell therapy
gagttgttcctgcccttccct

SEQ ID NO: 15739 - DNA, 21 bp, Artificial Sequence
  Artificial sequence related to HLA knockouts in cell therapy
gttcctgcccttccctttgtg

SEQ ID NO: 15740 - DNA, 21 bp, Artificial Sequence
  Artificial sequence related to HLA knockouts in cell therapy
tcctgcccttccctttgtgac

SEQ ID NO: 15741 - DNA, 21 bp, Artificial Sequence
  Artificial sequence related to HLA knockouts in cell therapy
cctgcccttccctttgtgact

SEQ ID NO: 15742 - DNA, 21 bp, Artificial Sequence
  Artificial sequence related to HLA knockouts in cell therapy
cctttgtgacttgaagaaccc

SEQ ID NO: 15743 - DNA, 21 bp, Artificial Sequence
  Artificial sequence related to HLA knockouts in cell therapy
ctttgtgacttgaagaaccct

SEQ ID NO: 15744 - DNA, 21 bp, Artificial Sequence
  Artificial sequence related to HLA knockouts in cell therapy
tttgtgacttgaagaaccctg

SEQ ID NO: 15745 - DNA, 21 bp, Artificial Sequence
  Artificial sequence related to HLA knockouts in cell therapy
ttgtgacttgaagaaccctga

SEQ ID NO: 15746 - DNA, 21 bp, Artificial Sequence
  Artificial sequence related to HLA knockouts in cell therapy
tgtgacttgaagaaccctgac

SEQ ID NO: 15747 - DNA, 21 bp, Artificial Sequence
  Artificial sequence related to HLA knockouts in cell therapy
aagaaccctgactttgtttct

SEQ ID NO: 15748 - DNA, 21 bp, Artificial Sequence
  Artificial sequence related to HLA knockouts in cell therapy
aaccctgactttgtttctgca

SEQ ID NO: 15749 - DNA, 21 bp, Artificial Sequence
  Artificial sequence related to HLA knockouts in cell therapy
cctgactttgtttctgcaaag

SEQ ID NO: 15750 - DNA, 21 bp, Artificial Sequence
  Artificial sequence related to HLA knockouts in cell therapy
ctgactttgtttctgcaaagg

SEQ ID NO: 15751 - DNA, 21 bp, Artificial Sequence
  Artificial sequence related to HLA knockouts in cell therapy
tgactttgtttctgcaaaggc

SEQ ID NO: 15752 - DNA, 21 bp, Artificial Sequence
  Artificial sequence related to HLA knockouts in cell therapy
gactttgtttctgcaaaggca

SEQ ID NO: 15753 - DNA, 21 bp, Artificial Sequence
  Artificial sequence related to HLA knockouts in cell therapy
actttgtttctgcaaaggcac

SEQ ID NO: 15754 - DNA, 21 bp, Artificial Sequence
  Artificial sequence related to HLA knockouts in cell therapy
ctttgtttctgcaaaggcacc

SEQ ID NO: 15755 - DNA, 21 bp, Artificial Sequence
  Artificial sequence related to HLA knockouts in cell therapy
tttgtttctgcaaaggcacct

SEQ ID NO: 15756 - DNA, 21 bp, Artificial Sequence
  Artificial sequence related to HLA knockouts in cell therapy
ttgtttctgcaaaggcacctg

SEQ ID NO: 15757 - DNA, 21 bp, Artificial Sequence
  Artificial sequence related to HLA knockouts in cell therapy
tgtttctgcaaaggcacctgc

SEQ ID NO: 15758 - DNA, 21 bp, Artificial Sequence
  Artificial sequence related to HLA knockouts in cell therapy
gtttctgcaaaggcacctgca

SEQ ID NO: 15759 - DNA, 21 bp, Artificial Sequence
  Artificial sequence related to HLA knockouts in cell therapy
ctgcaaaggcacctgcatgtg

SEQ ID NO: 15760 - DNA, 21 bp, Artificial Sequence
  Artificial sequence related to HLA knockouts in cell therapy
gcaaaggcacctgcatgtgtc

SEQ ID NO: 15761 - DNA, 21 bp, Artificial Sequence
  Artificial sequence related to HLA knockouts in cell therapy
aggcacctgcatgtgtctgtg

SEQ ID NO: 15762 - DNA, 21 bp, Artificial Sequence
  Artificial sequence related to HLA knockouts in cell therapy
ggcacctgcatgtgtctgtgt

SEQ ID NO: 15763 - DNA, 21 bp, Artificial Sequence
  Artificial sequence related to HLA knockouts in cell therapy
tgtgtctgtgttcgtgtaggc

SEQ ID NO: 15764 - DNA, 21 bp, Artificial Sequence
  Artificial sequence related to HLA knockouts in cell therapy
gtgtctgtgttcgtgtaggca

SEQ ID NO: 15765 - DNA, 21 bp, Artificial Sequence
  Artificial sequence related to HLA knockouts in cell therapy
tcgtgtaggcataatgtgagg

SEQ ID NO: 15766 - DNA, 21 bp, Artificial Sequence
  Artificial sequence related to HLA knockouts in cell therapy
gtgtaggcataatgtgaggag

SEQ ID NO: 15767 - DNA, 21 bp, Artificial Sequence
  Artificial sequence related to HLA knockouts in cell therapy
tgtaggcataatgtgaggagg

SEQ ID NO: 15768 - DNA, 21 bp, Artificial Sequence
  Artificial sequence related to HLA knockouts in cell therapy
gtaggcataatgtgaggaggt

SEQ ID NO: 15769 - DNA, 21 bp, Artificial Sequence
  Artificial sequence related to HLA knockouts in cell therapy
taggcataatgtgaggaggtg

SEQ ID NO: 15770 - DNA, 21 bp, Artificial Sequence
  Artificial sequence related to HLA knockouts in cell therapy
aggcataatgtgaggaggtgg

SEQ ID NO: 15771 - DNA, 21 bp, Artificial Sequence
  Artificial sequence related to HLA knockouts in cell therapy
ggcataatgtgaggaggtggg

SEQ ID NO: 15772 - DNA, 21 bp, Artificial Sequence
  Artificial sequence related to HLA knockouts in cell therapy
ccatgtccaccatgaccctct

SEQ ID NO: 15773 - DNA, 21 bp, Artificial Sequence
  Artificial sequence related to HLA knockouts in cell therapy
tgtccaccatgaccctcttcc

SEQ ID NO: 15774 - DNA, 21 bp, Artificial Sequence
  Artificial sequence related to HLA knockouts in cell therapy
tccaccatgaccctcttccca

SEQ ID NO: 15775 - DNA, 21 bp, Artificial Sequence
  Artificial sequence related to HLA knockouts in cell therapy
atgaccctcttcccacgctga

SEQ ID NO: 15776 - DNA, 21 bp, Artificial Sequence
  Artificial sequence related to HLA knockouts in cell therapy
atcatctttcctgttccagag

SEQ ID NO: 15777 - DNA, 21 bp, Artificial Sequence
  Artificial sequence related to HLA knockouts in cell therapy
atctttcctgttccagagagg

SEQ ID NO: 15778 - DNA, 21 bp, Artificial Sequence
  Artificial sequence related to HLA knockouts in cell therapy
ctttcctgttccagagaggtg

SEQ ID NO: 15779 - DNA, 21 bp, Artificial Sequence
  Artificial sequence related to HLA knockouts in cell therapy
tttcctgttccagagaggtgg

SEQ ID NO: 15780 - DNA, 21 bp, Artificial Sequence
  Artificial sequence related to HLA knockouts in cell therapy
ttcctgttccagagaggtggg

SEQ ID NO: 15781 - DNA, 21 bp, Artificial Sequence
  Artificial sequence related to HLA knockouts in cell therapy
ggctgaggtgtctccatctct

SEQ ID NO: 15782 - DNA, 21 bp, Artificial Sequence
  Artificial sequence related to HLA knockouts in cell therapy
gctgaggtgtctccatctctg

SEQ ID NO: 15783 - DNA, 21 bp, Artificial Sequence
  Artificial sequence related to HLA knockouts in cell therapy
tctgtctcaacttcatggtgc

SEQ ID NO: 15784 - DNA, 21 bp, Artificial Sequence
  Artificial sequence related to HLA knockouts in cell therapy
ctgtctcaacttcatggtgca

SEQ ID NO: 15785 - DNA, 21 bp, Artificial Sequence
  Artificial sequence related to HLA knockouts in cell therapy
tgtctcaacttcatggtgcac

SEQ ID NO: 15786 - DNA, 21 bp, Artificial Sequence
  Artificial sequence related to HLA knockouts in cell therapy
tctcaacttcatggtgcactg

SEQ ID NO: 15787 - DNA, 21 bp, Artificial Sequence
  Artificial sequence related to HLA knockouts in cell therapy
caacttcatggtgcactgagc

SEQ ID NO: 15788 - DNA, 21 bp, Artificial Sequence
  Artificial sequence related to HLA knockouts in cell therapy
aacttcatggtgcactgagct

SEQ ID NO: 15789 - DNA, 21 bp, Artificial Sequence
  Artificial sequence related to HLA knockouts in cell therapy
acttcatggtgcactgagctg

SEQ ID NO: 15790 - DNA, 21 bp, Artificial Sequence
  Artificial sequence related to HLA knockouts in cell therapy
gagctgtaacttcttccttcc

SEQ ID NO: 15791 - DNA, 21 bp, Artificial Sequence
  Artificial sequence related to HLA knockouts in cell therapy
agctgtaacttcttccttccc

SEQ ID NO: 15792 - DNA, 21 bp, Artificial Sequence
  Artificial sequence related to HLA knockouts in cell therapy
gctgtaacttcttccttccct

SEQ ID NO: 15793 - DNA, 21 bp, Artificial Sequence
  Artificial sequence related to HLA knockouts in cell therapy
aacttcttccttccctattaa

SEQ ID NO: 15794 - DNA, 22 bp, Artificial Sequence
  Artificial sequence related to HLA knockouts in cell therapy
cccgaaggcggtgtatggattg

SEQ ID NO: 15795 - DNA, 22 bp, Artificial Sequence
  Artificial sequence related to HLA knockouts in cell therapy
ccgaaggcggtgtatggattgg

SEQ ID NO: 15796 - DNA, 22 bp, Artificial Sequence
  Artificial sequence related to HLA knockouts in cell therapy
cgaaggcggtgtatggattggg

SEQ ID NO: 15797 - DNA, 22 bp, Artificial Sequence
  Artificial sequence related to HLA knockouts in cell therapy
tttctccctctcccaacctatg

SEQ ID NO: 15798 - DNA, 22 bp, Artificial Sequence
  Artificial sequence related to HLA knockouts in cell therapy
ttctccctctcccaacctatgt

SEQ ID NO: 15799 - DNA, 22 bp, Artificial Sequence
  Artificial sequence related to HLA knockouts in cell therapy
tctccctctcccaacctatgta

SEQ ID NO: 15800 - DNA, 22 bp, Artificial Sequence
  Artificial sequence related to HLA knockouts in cell therapy
ctccctctcccaacctatgtag

SEQ ID NO: 15801 - DNA, 22 bp, Artificial Sequence
  Artificial sequence related to HLA knockouts in cell therapy
tccctctcccaacctatgtagg

SEQ ID NO: 15802 - DNA, 22 bp, Artificial Sequence
  Artificial sequence related to HLA knockouts in cell therapy
ccctctcccaacctatgtaggg

SEQ ID NO: 15803 - DNA, 22 bp, Artificial Sequence
  Artificial sequence related to HLA knockouts in cell therapy
cctctcccaacctatgtagggt

SEQ ID NO: 15804 - DNA, 22 bp, Artificial Sequence
  Artificial sequence related to HLA knockouts in cell therapy
ctctcccaacctatgtagggtc

SEQ ID NO: 15805 - DNA, 22 bp, Artificial Sequence
  Artificial sequence related to HLA knockouts in cell therapy
tctcccaacctatgtagggtcc

SEQ ID NO: 15806 - DNA, 22 bp, Artificial Sequence
  Artificial sequence related to HLA knockouts in cell therapy
ctcccaacctatgtagggtcct

SEQ ID NO: 15807 - DNA, 22 bp, Artificial Sequence
  Artificial sequence related to HLA knockouts in cell therapy
tcccaacctatgtagggtcctt

SEQ ID NO: 15808 - DNA, 22 bp, Artificial Sequence
  Artificial sequence related to HLA knockouts in cell therapy
cccaacctatgtagggtccttc

SEQ ID NO: 15809 - DNA, 22 bp, Artificial Sequence
  Artificial sequence related to HLA knockouts in cell therapy
ccaacctatgtagggtccttct

SEQ ID NO: 15810 - DNA, 22 bp, Artificial Sequence
  Artificial sequence related to HLA knockouts in cell therapy
caacctatgtagggtccttctt

SEQ ID NO: 15811 - DNA, 22 bp, Artificial Sequence
  Artificial sequence related to HLA knockouts in cell therapy
aacctatgtagggtccttcttc

SEQ ID NO: 15812 - DNA, 22 bp, Artificial Sequence
  Artificial sequence related to HLA knockouts in cell therapy
acctatgtagggtccttcttcc

SEQ ID NO: 15813 - DNA, 22 bp, Artificial Sequence
  Artificial sequence related to HLA knockouts in cell therapy
cctatgtagggtccttcttcct

SEQ ID NO: 15814 - DNA, 22 bp, Artificial Sequence
  Artificial sequence related to HLA knockouts in cell therapy
ctatgtagggtccttcttcctg

SEQ ID NO: 15815 - DNA, 22 bp, Artificial Sequence
  Artificial sequence related to HLA knockouts in cell therapy
tatgtagggtccttcttcctgg

SEQ ID NO: 15816 - DNA, 22 bp, Artificial Sequence
  Artificial sequence related to HLA knockouts in cell therapy
atgtagggtccttcttcctgga

SEQ ID NO: 15817 - DNA, 22 bp, Artificial Sequence
  Artificial sequence related to HLA knockouts in cell therapy
tgtagggtccttcttcctggat

SEQ ID NO: 15818 - DNA, 22 bp, Artificial Sequence
  Artificial sequence related to HLA knockouts in cell therapy
gtagggtccttcttcctggata

SEQ ID NO: 15819 - DNA, 22 bp, Artificial Sequence
  Artificial sequence related to HLA knockouts in cell therapy
tagggtccttcttcctggatac

SEQ ID NO: 15820 - DNA, 22 bp, Artificial Sequence
  Artificial sequence related to HLA knockouts in cell therapy
agggtccttcttcctggatact

SEQ ID NO: 15821 - DNA, 22 bp, Artificial Sequence
  Artificial sequence related to HLA knockouts in cell therapy
gggtccttcttcctggatactc

SEQ ID NO: 15822 - DNA, 22 bp, Artificial Sequence
  Artificial sequence related to HLA knockouts in cell therapy
ggtccttcttcctggatactca

SEQ ID NO: 15823 - DNA, 22 bp, Artificial Sequence
  Artificial sequence related to HLA knockouts in cell therapy
gtccttcttcctggatactcac

SEQ ID NO: 15824 - DNA, 22 bp, Artificial Sequence
  Artificial sequence related to HLA knockouts in cell therapy
tccttcttcctggatactcacg

SEQ ID NO: 15825 - DNA, 22 bp, Artificial Sequence
  Artificial sequence related to HLA knockouts in cell therapy
ccttcttcctggatactcacga

SEQ ID NO: 15826 - DNA, 22 bp, Artificial Sequence
  Artificial sequence related to HLA knockouts in cell therapy
cttcttcctggatactcacgac

SEQ ID NO: 15827 - DNA, 22 bp, Artificial Sequence
  Artificial sequence related to HLA knockouts in cell therapy
ttcttcctggatactcacgacg

SEQ ID NO: 15828 - DNA, 22 bp, Artificial Sequence
  Artificial sequence related to HLA knockouts in cell therapy
tcttcctggatactcacgacgc

SEQ ID NO: 15829 - DNA, 22 bp, Artificial Sequence
  Artificial sequence related to HLA knockouts in cell therapy
cttcctggatactcacgacgcg

SEQ ID NO: 15830 - DNA, 22 bp, Artificial Sequence
  Artificial sequence related to HLA knockouts in cell therapy
ttcctggatactcacgacgcgg

SEQ ID NO: 15831 - DNA, 22 bp, Artificial Sequence
  Artificial sequence related to HLA knockouts in cell therapy
tcctggatactcacgacgcgga

SEQ ID NO: 15832 - DNA, 22 bp, Artificial Sequence
  Artificial sequence related to HLA knockouts in cell therapy
atactcacgacgcggacccagt

SEQ ID NO: 15833 - DNA, 22 bp, Artificial Sequence
  Artificial sequence related to HLA knockouts in cell therapy
tactcacgacgcggacccagtt

SEQ ID NO: 15834 - DNA, 22 bp, Artificial Sequence
  Artificial sequence related to HLA knockouts in cell therapy
cggacccagttctcactcccat

SEQ ID NO: 15835 - DNA, 22 bp, Artificial Sequence
  Artificial sequence related to HLA knockouts in cell therapy
ggacccagttctcactcccatt

SEQ ID NO: 15836 - DNA, 22 bp, Artificial Sequence
  Artificial sequence related to HLA knockouts in cell therapy
gacccagttctcactcccattg

SEQ ID NO: 15837 - DNA, 22 bp, Artificial Sequence
  Artificial sequence related to HLA knockouts in cell therapy
acccagttctcactcccattgg

SEQ ID NO: 15838 - DNA, 22 bp, Artificial Sequence
  Artificial sequence related to HLA knockouts in cell therapy
cccagttctcactcccattggg

SEQ ID NO: 15839 - DNA, 22 bp, Artificial Sequence
  Artificial sequence related to HLA knockouts in cell therapy
ccagttctcactcccattgggt

SEQ ID NO: 15840 - DNA, 22 bp, Artificial Sequence
  Artificial sequence related to HLA knockouts in cell therapy
cagttctcactcccattgggtg

SEQ ID NO: 15841 - DNA, 22 bp, Artificial Sequence
  Artificial sequence related to HLA knockouts in cell therapy
agttctcactcccattgggtgt

SEQ ID NO: 15842 - DNA, 22 bp, Artificial Sequence
  Artificial sequence related to HLA knockouts in cell therapy
gttctcactcccattgggtgtc

SEQ ID NO: 15843 - DNA, 22 bp, Artificial Sequence
  Artificial sequence related to HLA knockouts in cell therapy
ttctcactcccattgggtgtcg

SEQ ID NO: 15844 - DNA, 22 bp, Artificial Sequence
  Artificial sequence related to HLA knockouts in cell therapy
tctcactcccattgggtgtcgg

SEQ ID NO: 15845 - DNA, 22 bp, Artificial Sequence
  Artificial sequence related to HLA knockouts in cell therapy
tcactcccattgggtgtcgggt

SEQ ID NO: 15846 - DNA, 22 bp, Artificial Sequence
  Artificial sequence related to HLA knockouts in cell therapy
cactcccattgggtgtcgggtt

SEQ ID NO: 15847 - DNA, 22 bp, Artificial Sequence
  Artificial sequence related to HLA knockouts in cell therapy
actcccattgggtgtcgggttt

SEQ ID NO: 15848 - DNA, 22 bp, Artificial Sequence
  Artificial sequence related to HLA knockouts in cell therapy
ctcccattgggtgtcgggtttc

SEQ ID NO: 15849 - DNA, 22 bp, Artificial Sequence
  Artificial sequence related to HLA knockouts in cell therapy
tcccattgggtgtcgggtttcc

SEQ ID NO: 15850 - DNA, 22 bp, Artificial Sequence
  Artificial sequence related to HLA knockouts in cell therapy
cccattgggtgtcgggtttcca

SEQ ID NO: 15851 - DNA, 22 bp, Artificial Sequence
  Artificial sequence related to HLA knockouts in cell therapy
ccattgggtgtcgggtttccag

SEQ ID NO: 15852 - DNA, 22 bp, Artificial Sequence
  Artificial sequence related to HLA knockouts in cell therapy
cattgggtgtcgggtttccaga

SEQ ID NO: 15853 - DNA, 22 bp, Artificial Sequence
  Artificial sequence related to HLA knockouts in cell therapy
attgggtgtcgggtttccagag

SEQ ID NO: 15854 - DNA, 22 bp, Artificial Sequence
  Artificial sequence related to HLA knockouts in cell therapy
ttgggtgtcgggtttccagaga

SEQ ID NO: 15855 - DNA, 22 bp, Artificial Sequence
  Artificial sequence related to HLA knockouts in cell therapy
tgggtgtcgggtttccagagaa

SEQ ID NO: 15856 - DNA, 22 bp, Artificial Sequence
  Artificial sequence related to HLA knockouts in cell therapy
gggtgtcgggtttccagagaag

SEQ ID NO: 15857 - DNA, 22 bp, Artificial Sequence
  Artificial sequence related to HLA knockouts in cell therapy
ggtgtcgggtttccagagaagc

SEQ ID NO: 15858 - DNA, 22 bp, Artificial Sequence
  Artificial sequence related to HLA knockouts in cell therapy
gtgtcgggtttccagagaagcc

SEQ ID NO: 15859 - DNA, 22 bp, Artificial Sequence
  Artificial sequence related to HLA knockouts in cell therapy
tgtcgggtttccagagaagcca

SEQ ID NO: 15860 - DNA, 22 bp, Artificial Sequence
  Artificial sequence related to HLA knockouts in cell therapy
gtcgggtttccagagaagccaa

SEQ ID NO: 15861 - DNA, 22 bp, Artificial Sequence
  Artificial sequence related to HLA knockouts in cell therapy
tcgggtttccagagaagccaat

SEQ ID NO: 15862 - DNA, 22 bp, Artificial Sequence
  Artificial sequence related to HLA knockouts in cell therapy
cgggtttccagagaagccaatc

SEQ ID NO: 15863 - DNA, 22 bp, Artificial Sequence
  Artificial sequence related to HLA knockouts in cell therapy
gggtttccagagaagccaatca

SEQ ID NO: 15864 - DNA, 22 bp, Artificial Sequence
  Artificial sequence related to HLA knockouts in cell therapy
ggtttccagagaagccaatcag

SEQ ID NO: 15865 - DNA, 22 bp, Artificial Sequence
  Artificial sequence related to HLA knockouts in cell therapy
gtttccagagaagccaatcagt

SEQ ID NO: 15866 - DNA, 22 bp, Artificial Sequence
  Artificial sequence related to HLA knockouts in cell therapy
tttccagagaagccaatcagtg

SEQ ID NO: 15867 - DNA, 22 bp, Artificial Sequence
  Artificial sequence related to HLA knockouts in cell therapy
ttccagagaagccaatcagtgt

SEQ ID NO: 15868 - DNA, 22 bp, Artificial Sequence
  Artificial sequence related to HLA knockouts in cell therapy
tccagagaagccaatcagtgtc

SEQ ID NO: 15869 - DNA, 22 bp, Artificial Sequence
  Artificial sequence related to HLA knockouts in cell therapy
ccagagaagccaatcagtgtcg

SEQ ID NO: 15870 - DNA, 22 bp, Artificial Sequence
  Artificial sequence related to HLA knockouts in cell therapy
cagagaagccaatcagtgtcgt

SEQ ID NO: 15871 - DNA, 22 bp, Artificial Sequence
  Artificial sequence related to HLA knockouts in cell therapy
agagaagccaatcagtgtcgtc

SEQ ID NO: 15872 - DNA, 22 bp, Artificial Sequence
  Artificial sequence related to HLA knockouts in cell therapy
gagaagccaatcagtgtcgtcg

SEQ ID NO: 15873 - DNA, 22 bp, Artificial Sequence
  Artificial sequence related to HLA knockouts in cell therapy
agaagccaatcagtgtcgtcgc

SEQ ID NO: 15874 - DNA, 22 bp, Artificial Sequence
  Artificial sequence related to HLA knockouts in cell therapy
gaagccaatcagtgtcgtcgcg

SEQ ID NO: 15875 - DNA, 22 bp, Artificial Sequence
  Artificial sequence related to HLA knockouts in cell therapy
aagccaatcagtgtcgtcgcgg

SEQ ID NO: 15876 - DNA, 22 bp, Artificial Sequence
  Artificial sequence related to HLA knockouts in cell therapy
agccaatcagtgtcgtcgcggt

SEQ ID NO: 15877 - DNA, 22 bp, Artificial Sequence
  Artificial sequence related to HLA knockouts in cell therapy
tcgtcgcggtcgcggttctaaa

SEQ ID NO: 15878 - DNA, 22 bp, Artificial Sequence
  Artificial sequence related to HLA knockouts in cell therapy
gtcgcggtcgcggttctaaagt

SEQ ID NO: 15879 - DNA, 22 bp, Artificial Sequence
  Artificial sequence related to HLA knockouts in cell therapy
tcgcggtcgcggttctaaagtc

SEQ ID NO: 15880 - DNA, 22 bp, Artificial Sequence
  Artificial sequence related to HLA knockouts in cell therapy
ggtcgcggttctaaagtccgca

SEQ ID NO: 15881 - DNA, 22 bp, Artificial Sequence
  Artificial sequence related to HLA knockouts in cell therapy
gtcgcggttctaaagtccgcac

SEQ ID NO: 15882 - DNA, 22 bp, Artificial Sequence
  Artificial sequence related to HLA knockouts in cell therapy
tcgcggttctaaagtccgcacg

SEQ ID NO: 15883 - DNA, 22 bp, Artificial Sequence
  Artificial sequence related to HLA knockouts in cell therapy
gcggttctaaagtccgcacgca

SEQ ID NO: 15884 - DNA, 22 bp, Artificial Sequence
  Artificial sequence related to HLA knockouts in cell therapy
cggttctaaagtccgcacgcac

SEQ ID NO: 15885 - DNA, 22 bp, Artificial Sequence
  Artificial sequence related to HLA knockouts in cell therapy
ggttctaaagtccgcacgcacc

SEQ ID NO: 15886 - DNA, 22 bp, Artificial Sequence
  Artificial sequence related to HLA knockouts in cell therapy
gttctaaagtccgcacgcaccc

SEQ ID NO: 15887 - DNA, 22 bp, Artificial Sequence
  Artificial sequence related to HLA knockouts in cell therapy
ttctaaagtccgcacgcaccca

SEQ ID NO: 15888 - DNA, 22 bp, Artificial Sequence
  Artificial sequence related to HLA knockouts in cell therapy
tctaaagtccgcacgcacccac

SEQ ID NO: 15889 - DNA, 22 bp, Artificial Sequence
  Artificial sequence related to HLA knockouts in cell therapy
cacccaccgggactcagattct

SEQ ID NO: 15890 - DNA, 22 bp, Artificial Sequence
  Artificial sequence related to HLA knockouts in cell therapy
acccaccgggactcagattctc

SEQ ID NO: 15891 - DNA, 22 bp, Artificial Sequence
  Artificial sequence related to HLA knockouts in cell therapy
cgaaccctcgtcctgctactct

SEQ ID NO: 15892 - DNA, 22 bp, Artificial Sequence
  Artificial sequence related to HLA knockouts in cell therapy
gaaccctcgtcctgctactctc

SEQ ID NO: 15893 - DNA, 22 bp, Artificial Sequence
  Artificial sequence related to HLA knockouts in cell therapy
aaccctcgtcctgctactctcg

SEQ ID NO: 15894 - DNA, 22 bp, Artificial Sequence
  Artificial sequence related to HLA knockouts in cell therapy
cgggctctcactccatgaggta

SEQ ID NO: 15895 - DNA, 22 bp, Artificial Sequence
  Artificial sequence related to HLA knockouts in cell therapy
gggctctcactccatgaggtat

SEQ ID NO: 15896 - DNA, 22 bp, Artificial Sequence
  Artificial sequence related to HLA knockouts in cell therapy
ggctctcactccatgaggtatt

SEQ ID NO: 15897 - DNA, 22 bp, Artificial Sequence
  Artificial sequence related to HLA knockouts in cell therapy
gctctcactccatgaggtattt

SEQ ID NO: 15898 - DNA, 22 bp, Artificial Sequence
  Artificial sequence related to HLA knockouts in cell therapy
ctctcactccatgaggtatttc

SEQ ID NO: 15899 - DNA, 22 bp, Artificial Sequence
  Artificial sequence related to HLA knockouts in cell therapy
tctcactccatgaggtatttct

SEQ ID NO: 15900 - DNA, 22 bp, Artificial Sequence
  Artificial sequence related to HLA knockouts in cell therapy
ctcactccatgaggtatttctt

SEQ ID NO: 15901 - DNA, 22 bp, Artificial Sequence
  Artificial sequence related to HLA knockouts in cell therapy
tcactccatgaggtatttcttc

SEQ ID NO: 15902 - DNA, 22 bp, Artificial Sequence
  Artificial sequence related to HLA knockouts in cell therapy
cactccatgaggtatttcttca

SEQ ID NO: 15903 - DNA, 22 bp, Artificial Sequence
  Artificial sequence related to HLA knockouts in cell therapy
actccatgaggtatttcttcac

SEQ ID NO: 15904 - DNA, 22 bp, Artificial Sequence
  Artificial sequence related to HLA knockouts in cell therapy
ctccatgaggtatttcttcaca

SEQ ID NO: 15905 - DNA, 22 bp, Artificial Sequence
  Artificial sequence related to HLA knockouts in cell therapy
tccatgaggtatttcttcacat

SEQ ID NO: 15906 - DNA, 22 bp, Artificial Sequence
  Artificial sequence related to HLA knockouts in cell therapy
ccatgaggtatttcttcacatc

SEQ ID NO: 15907 - DNA, 22 bp, Artificial Sequence
  Artificial sequence related to HLA knockouts in cell therapy
catgaggtatttcttcacatcc

SEQ ID NO: 15908 - DNA, 22 bp, Artificial Sequence
  Artificial sequence related to HLA knockouts in cell therapy
atgaggtatttcttcacatccg

SEQ ID NO: 15909 - DNA, 22 bp, Artificial Sequence
  Artificial sequence related to HLA knockouts in cell therapy
tgaggtatttcttcacatccgt

SEQ ID NO: 15910 - DNA, 22 bp, Artificial Sequence
  Artificial sequence related to HLA knockouts in cell therapy
gaggtatttcttcacatccgtg

SEQ ID NO: 15911 - DNA, 22 bp, Artificial Sequence
  Artificial sequence related to HLA knockouts in cell therapy
aggtatttcttcacatccgtgt

SEQ ID NO: 15912 - DNA, 22 bp, Artificial Sequence
  Artificial sequence related to HLA knockouts in cell therapy
ggtatttcttcacatccgtgtc

SEQ ID NO: 15913 - DNA, 22 bp, Artificial Sequence
  Artificial sequence related to HLA knockouts in cell therapy
gtatttcttcacatccgtgtcc

SEQ ID NO: 15914 - DNA, 22 bp, Artificial Sequence
  Artificial sequence related to HLA knockouts in cell therapy
tatttcttcacatccgtgtccc

SEQ ID NO: 15915 - DNA, 22 bp, Artificial Sequence
  Artificial sequence related to HLA knockouts in cell therapy
atttcttcacatccgtgtcccg

SEQ ID NO: 15916 - DNA, 22 bp, Artificial Sequence
  Artificial sequence related to HLA knockouts in cell therapy
tttcttcacatccgtgtcccgg

SEQ ID NO: 15917 - DNA, 22 bp, Artificial Sequence
  Artificial sequence related to HLA knockouts in cell therapy
ttcttcacatccgtgtcccggc

SEQ ID NO: 15918 - DNA, 22 bp, Artificial Sequence
  Artificial sequence related to HLA knockouts in cell therapy
gcttcatcgcagtgggctacgt

SEQ ID NO: 15919 - DNA, 22 bp, Artificial Sequence
  Artificial sequence related to HLA knockouts in cell therapy
cttcatcgcagtgggctacgtg

SEQ ID NO: 15920 - DNA, 22 bp, Artificial Sequence
  Artificial sequence related to HLA knockouts in cell therapy
ttcatcgcagtgggctacgtgg

SEQ ID NO: 15921 - DNA, 22 bp, Artificial Sequence
  Artificial sequence related to HLA knockouts in cell therapy
tcatcgcagtgggctacgtgga

SEQ ID NO: 15922 - DNA, 22 bp, Artificial Sequence
  Artificial sequence related to HLA knockouts in cell therapy
gctacgtggacgacacgcagtt

SEQ ID NO: 15923 - DNA, 22 bp, Artificial Sequence
  Artificial sequence related to HLA knockouts in cell therapy
ctacgtggacgacacgcagttc

SEQ ID NO: 15924 - DNA, 22 bp, Artificial Sequence
  Artificial sequence related to HLA knockouts in cell therapy
tacgtggacgacacgcagttcg

SEQ ID NO: 15925 - DNA, 22 bp, Artificial Sequence
  Artificial sequence related to HLA knockouts in cell therapy
acgtggacgacacgcagttcgt

SEQ ID NO: 15926 - DNA, 22 bp, Artificial Sequence
  Artificial sequence related to HLA knockouts in cell therapy
acgacacgcagttcgtgcggtt

SEQ ID NO: 15927 - DNA, 22 bp, Artificial Sequence
  Artificial sequence related to HLA knockouts in cell therapy
acacgcagttcgtgcggttcga

SEQ ID NO: 15928 - DNA, 22 bp, Artificial Sequence
  Artificial sequence related to HLA knockouts in cell therapy
acgcagttcgtgcggttcgaca

SEQ ID NO: 15929 - DNA, 22 bp, Artificial Sequence
  Artificial sequence related to HLA knockouts in cell therapy
agttcgtgcggttcgacagcga

SEQ ID NO: 15930 - DNA, 22 bp, Artificial Sequence
  Artificial sequence related to HLA knockouts in cell therapy
atagagcaggagggtccggagt

SEQ ID NO: 15931 - DNA, 22 bp, Artificial Sequence
  Artificial sequence related to HLA knockouts in cell therapy
tagagcaggagggtccggagta

SEQ ID NO: 15932 - DNA, 22 bp, Artificial Sequence
  Artificial sequence related to HLA knockouts in cell therapy
agagcaggagggtccggagtat

SEQ ID NO: 15933 - DNA, 22 bp, Artificial Sequence
  Artificial sequence related to HLA knockouts in cell therapy
gagcaggagggtccggagtatt

SEQ ID NO: 15934 - DNA, 22 bp, Artificial Sequence
  Artificial sequence related to HLA knockouts in cell therapy
agcaggagggtccggagtattg

SEQ ID NO: 15935 - DNA, 22 bp, Artificial Sequence
  Artificial sequence related to HLA knockouts in cell therapy
aggagggtccggagtattggga

SEQ ID NO: 15936 - DNA, 22 bp, Artificial Sequence
  Artificial sequence related to HLA knockouts in cell therapy
gggagacacggaaagtgaaggc

SEQ ID NO: 15937 - DNA, 22 bp, Artificial Sequence
  Artificial sequence related to HLA knockouts in cell therapy
ggagacacggaaagtgaaggcc

SEQ ID NO: 15938 - DNA, 22 bp, Artificial Sequence
  Artificial sequence related to HLA knockouts in cell therapy
gagacacggaaagtgaaggccc

SEQ ID NO: 15939 - DNA, 22 bp, Artificial Sequence
  Artificial sequence related to HLA knockouts in cell therapy
agacacggaaagtgaaggccca

SEQ ID NO: 15940 - DNA, 22 bp, Artificial Sequence
  Artificial sequence related to HLA knockouts in cell therapy
gacacggaaagtgaaggcccac

SEQ ID NO: 15941 - DNA, 22 bp, Artificial Sequence
  Artificial sequence related to HLA knockouts in cell therapy
acacggaaagtgaaggcccact

SEQ ID NO: 15942 - DNA, 22 bp, Artificial Sequence
  Artificial sequence related to HLA knockouts in cell therapy
cacggaaagtgaaggcccactc

SEQ ID NO: 15943 - DNA, 22 bp, Artificial Sequence
  Artificial sequence related to HLA knockouts in cell therapy
acggaaagtgaaggcccactca

SEQ ID NO: 15944 - DNA, 22 bp, Artificial Sequence
  Artificial sequence related to HLA knockouts in cell therapy
cggaaagtgaaggcccactcac

SEQ ID NO: 15945 - DNA, 22 bp, Artificial Sequence
  Artificial sequence related to HLA knockouts in cell therapy
ggaaagtgaaggcccactcaca

SEQ ID NO: 15946 - DNA, 22 bp, Artificial Sequence
  Artificial sequence related to HLA knockouts in cell therapy
gaaagtgaaggcccactcacag

SEQ ID NO: 15947 - DNA, 22 bp, Artificial Sequence
  Artificial sequence related to HLA knockouts in cell therapy
aaagtgaaggcccactcacaga

SEQ ID NO: 15948 - DNA, 22 bp, Artificial Sequence
  Artificial sequence related to HLA knockouts in cell therapy
aagtgaaggcccactcacagac

SEQ ID NO: 15949 - DNA, 22 bp, Artificial Sequence
  Artificial sequence related to HLA knockouts in cell therapy
agtgaaggcccactcacagact

SEQ ID NO: 15950 - DNA, 22 bp, Artificial Sequence
  Artificial sequence related to HLA knockouts in cell therapy
gtgaaggcccactcacagactc

SEQ ID NO: 15951 - DNA, 22 bp, Artificial Sequence
  Artificial sequence related to HLA knockouts in cell therapy
tgaaggcccactcacagactca

SEQ ID NO: 15952 - DNA, 22 bp, Artificial Sequence
  Artificial sequence related to HLA knockouts in cell therapy
gaaggcccactcacagactcac

SEQ ID NO: 15953 - DNA, 22 bp, Artificial Sequence
  Artificial sequence related to HLA knockouts in cell therapy
aaggcccactcacagactcacc

SEQ ID NO: 15954 - DNA, 22 bp, Artificial Sequence
  Artificial sequence related to HLA knockouts in cell therapy
cccactcacagactcaccgagt

SEQ ID NO: 15955 - DNA, 22 bp, Artificial Sequence
  Artificial sequence related to HLA knockouts in cell therapy
ccactcacagactcaccgagtg

SEQ ID NO: 15956 - DNA, 22 bp, Artificial Sequence
  Artificial sequence related to HLA knockouts in cell therapy
cactcacagactcaccgagtgg

SEQ ID NO: 15957 - DNA, 22 bp, Artificial Sequence
  Artificial sequence related to HLA knockouts in cell therapy
actcacagactcaccgagtgga

SEQ ID NO: 15958 - DNA, 22 bp, Artificial Sequence
  Artificial sequence related to HLA knockouts in cell therapy
ctcacagactcaccgagtggac

SEQ ID NO: 15959 - DNA, 22 bp, Artificial Sequence
  Artificial sequence related to HLA knockouts in cell therapy
tcacagactcaccgagtggacc

SEQ ID NO: 15960 - DNA, 22 bp, Artificial Sequence
  Artificial sequence related to HLA knockouts in cell therapy
cacagactcaccgagtggacct

SEQ ID NO: 15961 - DNA, 22 bp, Artificial Sequence
  Artificial sequence related to HLA knockouts in cell therapy
acagactcaccgagtggacctg

SEQ ID NO: 15962 - DNA, 22 bp, Artificial Sequence
  Artificial sequence related to HLA knockouts in cell therapy
gcggctactacaaccagagcga

SEQ ID NO: 15963 - DNA, 22 bp, Artificial Sequence
  Artificial sequence related to HLA knockouts in cell therapy
cggctactacaaccagagcgag

SEQ ID NO: 15964 - DNA, 22 bp, Artificial Sequence
  Artificial sequence related to HLA knockouts in cell therapy
ggctactacaaccagagcgagg

SEQ ID NO: 15965 - DNA, 22 bp, Artificial Sequence
  Artificial sequence related to HLA knockouts in cell therapy
gctactacaaccagagcgaggc

SEQ ID NO: 15966 - DNA, 22 bp, Artificial Sequence
  Artificial sequence related to HLA knockouts in cell therapy
ctactacaaccagagcgaggcc

SEQ ID NO: 15967 - DNA, 22 bp, Artificial Sequence
  Artificial sequence related to HLA knockouts in cell therapy
tactacaaccagagcgaggccg

SEQ ID NO: 15968 - DNA, 22 bp, Artificial Sequence
  Artificial sequence related to HLA knockouts in cell therapy
tacaaccagagcgaggccggtt

SEQ ID NO: 15969 - DNA, 22 bp, Artificial Sequence
  Artificial sequence related to HLA knockouts in cell therapy
ggttctcacaccgtccagagga

SEQ ID NO: 15970 - DNA, 22 bp, Artificial Sequence
  Artificial sequence related to HLA knockouts in cell therapy
gttctcacaccgtccagaggat

SEQ ID NO: 15971 - DNA, 22 bp, Artificial Sequence
  Artificial sequence related to HLA knockouts in cell therapy
ttctcacaccgtccagaggatg

SEQ ID NO: 15972 - DNA, 22 bp, Artificial Sequence
  Artificial sequence related to HLA knockouts in cell therapy
tctcacaccgtccagaggatgt

SEQ ID NO: 15973 - DNA, 22 bp, Artificial Sequence
  Artificial sequence related to HLA knockouts in cell therapy
ctcacaccgtccagaggatgta

SEQ ID NO: 15974 - DNA, 22 bp, Artificial Sequence
  Artificial sequence related to HLA knockouts in cell therapy
tcacaccgtccagaggatgtat

SEQ ID NO: 15975 - DNA, 22 bp, Artificial Sequence
  Artificial sequence related to HLA knockouts in cell therapy
cacaccgtccagaggatgtatg

SEQ ID NO: 15976 - DNA, 22 bp, Artificial Sequence
  Artificial sequence related to HLA knockouts in cell therapy
acaccgtccagaggatgtatgg

SEQ ID NO: 15977 - DNA, 22 bp, Artificial Sequence
  Artificial sequence related to HLA knockouts in cell therapy
caccgtccagaggatgtatggc

SEQ ID NO: 15978 - DNA, 22 bp, Artificial Sequence
  Artificial sequence related to HLA knockouts in cell therapy
accgtccagaggatgtatggct

SEQ ID NO: 15979 - DNA, 22 bp, Artificial Sequence
  Artificial sequence related to HLA knockouts in cell therapy
ccgtccagaggatgtatggctg

SEQ ID NO: 15980 - DNA, 22 bp, Artificial Sequence
  Artificial sequence related to HLA knockouts in cell therapy
cgtccagaggatgtatggctgc

SEQ ID NO: 15981 - DNA, 22 bp, Artificial Sequence
  Artificial sequence related to HLA knockouts in cell therapy
gtccagaggatgtatggctgcg

SEQ ID NO: 15982 - DNA, 22 bp, Artificial Sequence
  Artificial sequence related to HLA knockouts in cell therapy
tccagaggatgtatggctgcga

SEQ ID NO: 15983 - DNA, 22 bp, Artificial Sequence
  Artificial sequence related to HLA knockouts in cell therapy
ccagaggatgtatggctgcgac

SEQ ID NO: 15984 - DNA, 22 bp, Artificial Sequence
  Artificial sequence related to HLA knockouts in cell therapy
cagaggatgtatggctgcgacg

SEQ ID NO: 15985 - DNA, 22 bp, Artificial Sequence
  Artificial sequence related to HLA knockouts in cell therapy
agaggatgtatggctgcgacgt

SEQ ID NO: 15986 - DNA, 22 bp, Artificial Sequence
  Artificial sequence related to HLA knockouts in cell therapy
gaggatgtatggctgcgacgtg

SEQ ID NO: 15987 - DNA, 22 bp, Artificial Sequence
  Artificial sequence related to HLA knockouts in cell therapy
aggatgtatggctgcgacgtgg

SEQ ID NO: 15988 - DNA, 22 bp, Artificial Sequence
  Artificial sequence related to HLA knockouts in cell therapy
ggtaccaccagtacgcctacga

SEQ ID NO: 15989 - DNA, 22 bp, Artificial Sequence
  Artificial sequence related to HLA knockouts in cell therapy
gtaccaccagtacgcctacgac

SEQ ID NO: 15990 - DNA, 22 bp, Artificial Sequence
  Artificial sequence related to HLA knockouts in cell therapy
taccaccagtacgcctacgacg

SEQ ID NO: 15991 - DNA, 22 bp, Artificial Sequence
  Artificial sequence related to HLA knockouts in cell therapy
accagtacgcctacgacggcaa

SEQ ID NO: 15992 - DNA, 22 bp, Artificial Sequence
  Artificial sequence related to HLA knockouts in cell therapy
agtacgcctacgacggcaagga

SEQ ID NO: 15993 - DNA, 22 bp, Artificial Sequence
  Artificial sequence related to HLA knockouts in cell therapy
gtacgcctacgacggcaaggat

SEQ ID NO: 15994 - DNA, 22 bp, Artificial Sequence
  Artificial sequence related to HLA knockouts in cell therapy
tacgcctacgacggcaaggatt

SEQ ID NO: 15995 - DNA, 22 bp, Artificial Sequence
  Artificial sequence related to HLA knockouts in cell therapy
acgcctacgacggcaaggatta

SEQ ID NO: 15996 - DNA, 22 bp, Artificial Sequence
  Artificial sequence related to HLA knockouts in cell therapy
cgcctacgacggcaaggattac

SEQ ID NO: 15997 - DNA, 22 bp, Artificial Sequence
  Artificial sequence related to HLA knockouts in cell therapy
gcctacgacggcaaggattaca

SEQ ID NO: 15998 - DNA, 22 bp, Artificial Sequence
  Artificial sequence related to HLA knockouts in cell therapy
cctacgacggcaaggattacat

SEQ ID NO: 15999 - DNA, 22 bp, Artificial Sequence
  Artificial sequence related to HLA knockouts in cell therapy
ctacgacggcaaggattacatc

SEQ ID NO: 16000 - DNA, 22 bp, Artificial Sequence
  Artificial sequence related to HLA knockouts in cell therapy
tacgacggcaaggattacatcg

SEQ ID NO: 16001 - DNA, 22 bp, Artificial Sequence
  Artificial sequence related to HLA knockouts in cell therapy
acgacggcaaggattacatcgc

SEQ ID NO: 16002 - DNA, 22 bp, Artificial Sequence
  Artificial sequence related to HLA knockouts in cell therapy
cgacggcaaggattacatcgcc

SEQ ID NO: 16003 - DNA, 22 bp, Artificial Sequence
  Artificial sequence related to HLA knockouts in cell therapy
gacggcaaggattacatcgccc

SEQ ID NO: 16004 - DNA, 22 bp, Artificial Sequence
  Artificial sequence related to HLA knockouts in cell therapy
acggcaaggattacatcgccct

SEQ ID NO: 16005 - DNA, 22 bp, Artificial Sequence
  Artificial sequence related to HLA knockouts in cell therapy
cggcaaggattacatcgccctg

SEQ ID NO: 16006 - DNA, 22 bp, Artificial Sequence
  Artificial sequence related to HLA knockouts in cell therapy
ggcaaggattacatcgccctga

SEQ ID NO: 16007 - DNA, 22 bp, Artificial Sequence
  Artificial sequence related to HLA knockouts in cell therapy
gcaaggattacatcgccctgaa

SEQ ID NO: 16008 - DNA, 22 bp, Artificial Sequence
  Artificial sequence related to HLA knockouts in cell therapy
caaggattacatcgccctgaaa

SEQ ID NO: 16009 - DNA, 22 bp, Artificial Sequence
  Artificial sequence related to HLA knockouts in cell therapy
aaggattacatcgccctgaaag

SEQ ID NO: 16010 - DNA, 22 bp, Artificial Sequence
  Artificial sequence related to HLA knockouts in cell therapy
aggattacatcgccctgaaaga

SEQ ID NO: 16011 - DNA, 22 bp, Artificial Sequence
  Artificial sequence related to HLA knockouts in cell therapy
ggattacatcgccctgaaagag

SEQ ID NO: 16012 - DNA, 22 bp, Artificial Sequence
  Artificial sequence related to HLA knockouts in cell therapy
gattacatcgccctgaaagagg

SEQ ID NO: 16013 - DNA, 22 bp, Artificial Sequence
  Artificial sequence related to HLA knockouts in cell therapy
attacatcgccctgaaagagga

SEQ ID NO: 16014 - DNA, 22 bp, Artificial Sequence
  Artificial sequence related to HLA knockouts in cell therapy
ttacatcgccctgaaagaggac

SEQ ID NO: 16015 - DNA, 22 bp, Artificial Sequence
  Artificial sequence related to HLA knockouts in cell therapy
tacatcgccctgaaagaggacc

SEQ ID NO: 16016 - DNA, 22 bp, Artificial Sequence
  Artificial sequence related to HLA knockouts in cell therapy
acatcgccctgaaagaggacct

SEQ ID NO: 16017 - DNA, 22 bp, Artificial Sequence
  Artificial sequence related to HLA knockouts in cell therapy
catcgccctgaaagaggacctg

SEQ ID NO: 16018 - DNA, 22 bp, Artificial Sequence
  Artificial sequence related to HLA knockouts in cell therapy
atcgccctgaaagaggacctgc

SEQ ID NO: 16019 - DNA, 22 bp, Artificial Sequence
  Artificial sequence related to HLA knockouts in cell therapy
cctgaaagaggacctgcgctct

SEQ ID NO: 16020 - DNA, 22 bp, Artificial Sequence
  Artificial sequence related to HLA knockouts in cell therapy
ctgaaagaggacctgcgctctt

SEQ ID NO: 16021 - DNA, 22 bp, Artificial Sequence
  Artificial sequence related to HLA knockouts in cell therapy
tgaaagaggacctgcgctcttg

SEQ ID NO: 16022 - DNA, 22 bp, Artificial Sequence
  Artificial sequence related to HLA knockouts in cell therapy
gaaagaggacctgcgctcttgg

SEQ ID NO: 16023 - DNA, 22 bp, Artificial Sequence
  Artificial sequence related to HLA knockouts in cell therapy
aaagaggacctgcgctcttgga

SEQ ID NO: 16024 - DNA, 22 bp, Artificial Sequence
  Artificial sequence related to HLA knockouts in cell therapy
aagaggacctgcgctcttggac

SEQ ID NO: 16025 - DNA, 22 bp, Artificial Sequence
  Artificial sequence related to HLA knockouts in cell therapy
gacatggcagctcagaccacca

SEQ ID NO: 16026 - DNA, 22 bp, Artificial Sequence
  Artificial sequence related to HLA knockouts in cell therapy
acatggcagctcagaccaccaa

SEQ ID NO: 16027 - DNA, 22 bp, Artificial Sequence
  Artificial sequence related to HLA knockouts in cell therapy
catggcagctcagaccaccaag

SEQ ID NO: 16028 - DNA, 22 bp, Artificial Sequence
  Artificial sequence related to HLA knockouts in cell therapy
atggcagctcagaccaccaagc

SEQ ID NO: 16029 - DNA, 22 bp, Artificial Sequence
  Artificial sequence related to HLA knockouts in cell therapy
tggcagctcagaccaccaagca

SEQ ID NO: 16030 - DNA, 22 bp, Artificial Sequence
  Artificial sequence related to HLA knockouts in cell therapy
gcagctcagaccaccaagcaca

SEQ ID NO: 16031 - DNA, 22 bp, Artificial Sequence
  Artificial sequence related to HLA knockouts in cell therapy
cagctcagaccaccaagcacaa

SEQ ID NO: 16032 - DNA, 22 bp, Artificial Sequence
  Artificial sequence related to HLA knockouts in cell therapy
agctcagaccaccaagcacaag

SEQ ID NO: 16033 - DNA, 22 bp, Artificial Sequence
  Artificial sequence related to HLA knockouts in cell therapy
gctcagaccaccaagcacaagt

SEQ ID NO: 16034 - DNA, 22 bp, Artificial Sequence
  Artificial sequence related to HLA knockouts in cell therapy
ctcagaccaccaagcacaagtg

SEQ ID NO: 16035 - DNA, 22 bp, Artificial Sequence
  Artificial sequence related to HLA knockouts in cell therapy
tcagaccaccaagcacaagtgg

SEQ ID NO: 16036 - DNA, 22 bp, Artificial Sequence
  Artificial sequence related to HLA knockouts in cell therapy
cagaccaccaagcacaagtggg

SEQ ID NO: 16037 - DNA, 22 bp, Artificial Sequence
  Artificial sequence related to HLA knockouts in cell therapy
agaccaccaagcacaagtggga

SEQ ID NO: 16038 - DNA, 22 bp, Artificial Sequence
  Artificial sequence related to HLA knockouts in cell therapy
gaccaccaagcacaagtgggag

SEQ ID NO: 16039 - DNA, 22 bp, Artificial Sequence
  Artificial sequence related to HLA knockouts in cell therapy
accaccaagcacaagtgggagg

SEQ ID NO: 16040 - DNA, 22 bp, Artificial Sequence
  Artificial sequence related to HLA knockouts in cell therapy
ccatgtggcggagcagttgaga

SEQ ID NO: 16041 - DNA, 22 bp, Artificial Sequence
  Artificial sequence related to HLA knockouts in cell therapy
catgtggcggagcagttgagag

SEQ ID NO: 16042 - DNA, 22 bp, Artificial Sequence
  Artificial sequence related to HLA knockouts in cell therapy
atgtggcggagcagttgagagc

SEQ ID NO: 16043 - DNA, 22 bp, Artificial Sequence
  Artificial sequence related to HLA knockouts in cell therapy
tggcggagcagttgagagccta

SEQ ID NO: 16044 - DNA, 22 bp, Artificial Sequence
  Artificial sequence related to HLA knockouts in cell therapy
cggagcagttgagagcctacct

SEQ ID NO: 16045 - DNA, 22 bp, Artificial Sequence
  Artificial sequence related to HLA knockouts in cell therapy
ggagcagttgagagcctacctg

SEQ ID NO: 16046 - DNA, 22 bp, Artificial Sequence
  Artificial sequence related to HLA knockouts in cell therapy
gagcagttgagagcctacctgg

SEQ ID NO: 16047 - DNA, 22 bp, Artificial Sequence
  Artificial sequence related to HLA knockouts in cell therapy
agcagttgagagcctacctgga

SEQ ID NO: 16048 - DNA, 22 bp, Artificial Sequence
  Artificial sequence related to HLA knockouts in cell therapy
gcagttgagagcctacctggag

SEQ ID NO: 16049 - DNA, 22 bp, Artificial Sequence
  Artificial sequence related to HLA knockouts in cell therapy
cagttgagagcctacctggagg

SEQ ID NO: 16050 - DNA, 22 bp, Artificial Sequence
  Artificial sequence related to HLA knockouts in cell therapy
agttgagagcctacctggaggg

SEQ ID NO: 16051 - DNA, 22 bp, Artificial Sequence
  Artificial sequence related to HLA knockouts in cell therapy
ttgagagcctacctggagggca

SEQ ID NO: 16052 - DNA, 22 bp, Artificial Sequence
  Artificial sequence related to HLA knockouts in cell therapy
tggagtggctccgcagatacct

SEQ ID NO: 16053 - DNA, 22 bp, Artificial Sequence
  Artificial sequence related to HLA knockouts in cell therapy
agtggctccgcagatacctgga

SEQ ID NO: 16054 - DNA, 22 bp, Artificial Sequence
  Artificial sequence related to HLA knockouts in cell therapy
tggctccgcagatacctggaga

SEQ ID NO: 16055 - DNA, 22 bp, Artificial Sequence
  Artificial sequence related to HLA knockouts in cell therapy
ggctccgcagatacctggagaa

SEQ ID NO: 16056 - DNA, 22 bp, Artificial Sequence
  Artificial sequence related to HLA knockouts in cell therapy
gctccgcagatacctggagaac

SEQ ID NO: 16057 - DNA, 22 bp, Artificial Sequence
  Artificial sequence related to HLA knockouts in cell therapy
ctccgcagatacctggagaacg

SEQ ID NO: 16058 - DNA, 22 bp, Artificial Sequence
  Artificial sequence related to HLA knockouts in cell therapy
tccgcagatacctggagaacgg

SEQ ID NO: 16059 - DNA, 22 bp, Artificial Sequence
  Artificial sequence related to HLA knockouts in cell therapy
cgcagatacctggagaacggga

SEQ ID NO: 16060 - DNA, 22 bp, Artificial Sequence
  Artificial sequence related to HLA knockouts in cell therapy
gcagatacctggagaacgggaa

SEQ ID NO: 16061 - DNA, 22 bp, Artificial Sequence
  Artificial sequence related to HLA knockouts in cell therapy
cagatacctggagaacgggaag

SEQ ID NO: 16062 - DNA, 22 bp, Artificial Sequence
  Artificial sequence related to HLA knockouts in cell therapy
agatacctggagaacgggaagg

SEQ ID NO: 16063 - DNA, 22 bp, Artificial Sequence
  Artificial sequence related to HLA knockouts in cell therapy
gatacctggagaacgggaagga

SEQ ID NO: 16064 - DNA, 22 bp, Artificial Sequence
  Artificial sequence related to HLA knockouts in cell therapy
atacctggagaacgggaaggag

SEQ ID NO: 16065 - DNA, 22 bp, Artificial Sequence
  Artificial sequence related to HLA knockouts in cell therapy
tacctggagaacgggaaggaga

SEQ ID NO: 16066 - DNA, 22 bp, Artificial Sequence
  Artificial sequence related to HLA knockouts in cell therapy
acctggagaacgggaaggagac

SEQ ID NO: 16067 - DNA, 22 bp, Artificial Sequence
  Artificial sequence related to HLA knockouts in cell therapy
tggagaacgggaaggagacgct

SEQ ID NO: 16068 - DNA, 22 bp, Artificial Sequence
  Artificial sequence related to HLA knockouts in cell therapy
agaacgggaaggagacgctgca

SEQ ID NO: 16069 - DNA, 22 bp, Artificial Sequence
  Artificial sequence related to HLA knockouts in cell therapy
aaacgcatatgactcaccacgc

SEQ ID NO: 16070 - DNA, 22 bp, Artificial Sequence
  Artificial sequence related to HLA knockouts in cell therapy
aacgcatatgactcaccacgct

SEQ ID NO: 16071 - DNA, 22 bp, Artificial Sequence
  Artificial sequence related to HLA knockouts in cell therapy
acgcatatgactcaccacgctg

SEQ ID NO: 16072 - DNA, 22 bp, Artificial Sequence
  Artificial sequence related to HLA knockouts in cell therapy
cgcatatgactcaccacgctgt

SEQ ID NO: 16073 - DNA, 22 bp, Artificial Sequence
  Artificial sequence related to HLA knockouts in cell therapy
gcatatgactcaccacgctgtc

SEQ ID NO: 16074 - DNA, 22 bp, Artificial Sequence
  Artificial sequence related to HLA knockouts in cell therapy
catatgactcaccacgctgtct

SEQ ID NO: 16075 - DNA, 22 bp, Artificial Sequence
  Artificial sequence related to HLA knockouts in cell therapy
atatgactcaccacgctgtctc

SEQ ID NO: 16076 - DNA, 22 bp, Artificial Sequence
  Artificial sequence related to HLA knockouts in cell therapy
tatgactcaccacgctgtctct

SEQ ID NO: 16077 - DNA, 22 bp, Artificial Sequence
  Artificial sequence related to HLA knockouts in cell therapy
atgactcaccacgctgtctctg

SEQ ID NO: 16078 - DNA, 22 bp, Artificial Sequence
  Artificial sequence related to HLA knockouts in cell therapy
tgactcaccacgctgtctctga

SEQ ID NO: 16079 - DNA, 22 bp, Artificial Sequence
  Artificial sequence related to HLA knockouts in cell therapy
gactcaccacgctgtctctgac

SEQ ID NO: 16080 - DNA, 22 bp, Artificial Sequence
  Artificial sequence related to HLA knockouts in cell therapy
actcaccacgctgtctctgacc

SEQ ID NO: 16081 - DNA, 22 bp, Artificial Sequence
  Artificial sequence related to HLA knockouts in cell therapy
ctcaccacgctgtctctgacca

SEQ ID NO: 16082 - DNA, 22 bp, Artificial Sequence
  Artificial sequence related to HLA knockouts in cell therapy
tcaccacgctgtctctgaccat

SEQ ID NO: 16083 - DNA, 22 bp, Artificial Sequence
  Artificial sequence related to HLA knockouts in cell therapy
caccacgctgtctctgaccatg

SEQ ID NO: 16084 - DNA, 22 bp, Artificial Sequence
  Artificial sequence related to HLA knockouts in cell therapy
accacgctgtctctgaccatga

SEQ ID NO: 16085 - DNA, 22 bp, Artificial Sequence
  Artificial sequence related to HLA knockouts in cell therapy
ccacgctgtctctgaccatgaa

SEQ ID NO: 16086 - DNA, 22 bp, Artificial Sequence
  Artificial sequence related to HLA knockouts in cell therapy
cacgctgtctctgaccatgaag

SEQ ID NO: 16087 - DNA, 22 bp, Artificial Sequence
  Artificial sequence related to HLA knockouts in cell therapy
acgctgtctctgaccatgaagc

SEQ ID NO: 16088 - DNA, 22 bp, Artificial Sequence
  Artificial sequence related to HLA knockouts in cell therapy
cgctgtctctgaccatgaagcc

SEQ ID NO: 16089 - DNA, 22 bp, Artificial Sequence
  Artificial sequence related to HLA knockouts in cell therapy
gctgtctctgaccatgaagcca

SEQ ID NO: 16090 - DNA, 22 bp, Artificial Sequence
  Artificial sequence related to HLA knockouts in cell therapy
ctgtctctgaccatgaagccac

SEQ ID NO: 16091 - DNA, 22 bp, Artificial Sequence
  Artificial sequence related to HLA knockouts in cell therapy
tgtctctgaccatgaagccacc

SEQ ID NO: 16092 - DNA, 22 bp, Artificial Sequence
  Artificial sequence related to HLA knockouts in cell therapy
gtctctgaccatgaagccaccc

SEQ ID NO: 16093 - DNA, 22 bp, Artificial Sequence
  Artificial sequence related to HLA knockouts in cell therapy
tctctgaccatgaagccaccct

SEQ ID NO: 16094 - DNA, 22 bp, Artificial Sequence
  Artificial sequence related to HLA knockouts in cell therapy
ctctgaccatgaagccaccctg

SEQ ID NO: 16095 - DNA, 22 bp, Artificial Sequence
  Artificial sequence related to HLA knockouts in cell therapy
tctgaccatgaagccaccctga

SEQ ID NO: 16096 - DNA, 22 bp, Artificial Sequence
  Artificial sequence related to HLA knockouts in cell therapy
ctgaccatgaagccaccctgag

SEQ ID NO: 16097 - DNA, 22 bp, Artificial Sequence
  Artificial sequence related to HLA knockouts in cell therapy
tgaccatgaagccaccctgagg

SEQ ID NO: 16098 - DNA, 22 bp, Artificial Sequence
  Artificial sequence related to HLA knockouts in cell therapy
gaccatgaagccaccctgaggt

SEQ ID NO: 16099 - DNA, 22 bp, Artificial Sequence
  Artificial sequence related to HLA knockouts in cell therapy
accatgaagccaccctgaggtg

SEQ ID NO: 16100 - DNA, 22 bp, Artificial Sequence
  Artificial sequence related to HLA knockouts in cell therapy
catgaagccaccctgaggtgct

SEQ ID NO: 16101 - DNA, 22 bp, Artificial Sequence
  Artificial sequence related to HLA knockouts in cell therapy
atgaagccaccctgaggtgctg

SEQ ID NO: 16102 - DNA, 22 bp, Artificial Sequence
  Artificial sequence related to HLA knockouts in cell therapy
ctgagcttctaccctgcggaga

SEQ ID NO: 16103 - DNA, 22 bp, Artificial Sequence
  Artificial sequence related to HLA knockouts in cell therapy
tgagcttctaccctgcggagat

SEQ ID NO: 16104 - DNA, 22 bp, Artificial Sequence
  Artificial sequence related to HLA knockouts in cell therapy
gagcttctaccctgcggagatc

SEQ ID NO: 16105 - DNA, 22 bp, Artificial Sequence
  Artificial sequence related to HLA knockouts in cell therapy
agcttctaccctgcggagatca

SEQ ID NO: 16106 - DNA, 22 bp, Artificial Sequence
  Artificial sequence related to HLA knockouts in cell therapy
gcttctaccctgcggagatcac

SEQ ID NO: 16107 - DNA, 22 bp, Artificial Sequence
  Artificial sequence related to HLA knockouts in cell therapy
cttctaccctgcggagatcaca

SEQ ID NO: 16108 - DNA, 22 bp, Artificial Sequence
  Artificial sequence related to HLA knockouts in cell therapy
ttctaccctgcggagatcacac

SEQ ID NO: 16109 - DNA, 22 bp, Artificial Sequence
  Artificial sequence related to HLA knockouts in cell therapy
tctaccctgcggagatcacact

SEQ ID NO: 16110 - DNA, 22 bp, Artificial Sequence
  Artificial sequence related to HLA knockouts in cell therapy
ctaccctgcggagatcacactg

SEQ ID NO: 16111 - DNA, 22 bp, Artificial Sequence
  Artificial sequence related to HLA knockouts in cell therapy
taccctgcggagatcacactga

SEQ ID NO: 16112 - DNA, 22 bp, Artificial Sequence
  Artificial sequence related to HLA knockouts in cell therapy
accctgcggagatcacactgac

SEQ ID NO: 16113 - DNA, 22 bp, Artificial Sequence
  Artificial sequence related to HLA knockouts in cell therapy
cctgcggagatcacactgacct

SEQ ID NO: 16114 - DNA, 22 bp, Artificial Sequence
  Artificial sequence related to HLA knockouts in cell therapy
ctgcggagatcacactgacctg

SEQ ID NO: 16115 - DNA, 22 bp, Artificial Sequence
  Artificial sequence related to HLA knockouts in cell therapy
tgcggagatcacactgacctgg

SEQ ID NO: 16116 - DNA, 22 bp, Artificial Sequence
  Artificial sequence related to HLA knockouts in cell therapy
cggagatcacactgacctggca

SEQ ID NO: 16117 - DNA, 22 bp, Artificial Sequence
  Artificial sequence related to HLA knockouts in cell therapy
ggagatcacactgacctggcag

SEQ ID NO: 16118 - DNA, 22 bp, Artificial Sequence
  Artificial sequence related to HLA knockouts in cell therapy
gagatcacactgacctggcagc

SEQ ID NO: 16119 - DNA, 22 bp, Artificial Sequence
  Artificial sequence related to HLA knockouts in cell therapy
agatcacactgacctggcagcg

SEQ ID NO: 16120 - DNA, 22 bp, Artificial Sequence
  Artificial sequence related to HLA knockouts in cell therapy
gggatggaaccttccagaagtg

SEQ ID NO: 16121 - DNA, 22 bp, Artificial Sequence
  Artificial sequence related to HLA knockouts in cell therapy
ggatggaaccttccagaagtgg

SEQ ID NO: 16122 - DNA, 22 bp, Artificial Sequence
  Artificial sequence related to HLA knockouts in cell therapy
gatggaaccttccagaagtggg

SEQ ID NO: 16123 - DNA, 22 bp, Artificial Sequence
  Artificial sequence related to HLA knockouts in cell therapy
atggaaccttccagaagtgggc

SEQ ID NO: 16124 - DNA, 22 bp, Artificial Sequence
  Artificial sequence related to HLA knockouts in cell therapy
tggaaccttccagaagtgggcg

SEQ ID NO: 16125 - DNA, 22 bp, Artificial Sequence
  Artificial sequence related to HLA knockouts in cell therapy
ctgtggtggtgccttctggaca

SEQ ID NO: 16126 - DNA, 22 bp, Artificial Sequence
  Artificial sequence related to HLA knockouts in cell therapy
tgtggtggtgccttctggacag

SEQ ID NO: 16127 - DNA, 22 bp, Artificial Sequence
  Artificial sequence related to HLA knockouts in cell therapy
tggtggtgccttctggacagga

SEQ ID NO: 16128 - DNA, 22 bp, Artificial Sequence
  Artificial sequence related to HLA knockouts in cell therapy
tggtgccttctggacaggagca

SEQ ID NO: 16129 - DNA, 22 bp, Artificial Sequence
  Artificial sequence related to HLA knockouts in cell therapy
gtgccttctggacaggagcaga

SEQ ID NO: 16130 - DNA, 22 bp, Artificial Sequence
  Artificial sequence related to HLA knockouts in cell therapy
tgccttctggacaggagcagag

SEQ ID NO: 16131 - DNA, 22 bp, Artificial Sequence
  Artificial sequence related to HLA knockouts in cell therapy
gccttctggacaggagcagaga

SEQ ID NO: 16132 - DNA, 22 bp, Artificial Sequence
  Artificial sequence related to HLA knockouts in cell therapy
ccttctggacaggagcagagat

SEQ ID NO: 16133 - DNA, 22 bp, Artificial Sequence
  Artificial sequence related to HLA knockouts in cell therapy
cttctggacaggagcagagata

SEQ ID NO: 16134 - DNA, 22 bp, Artificial Sequence
  Artificial sequence related to HLA knockouts in cell therapy
ttctggacaggagcagagatac

SEQ ID NO: 16135 - DNA, 22 bp, Artificial Sequence
  Artificial sequence related to HLA knockouts in cell therapy
tctggacaggagcagagataca

SEQ ID NO: 16136 - DNA, 22 bp, Artificial Sequence
  Artificial sequence related to HLA knockouts in cell therapy
ctggacaggagcagagatacac

SEQ ID NO: 16137 - DNA, 22 bp, Artificial Sequence
  Artificial sequence related to HLA knockouts in cell therapy
tggacaggagcagagatacacc

SEQ ID NO: 16138 - DNA, 22 bp, Artificial Sequence
  Artificial sequence related to HLA knockouts in cell therapy
ggacaggagcagagatacacct

SEQ ID NO: 16139 - DNA, 22 bp, Artificial Sequence
  Artificial sequence related to HLA knockouts in cell therapy
gacaggagcagagatacacctg

SEQ ID NO: 16140 - DNA, 22 bp, Artificial Sequence
  Artificial sequence related to HLA knockouts in cell therapy
acaggagcagagatacacctgc

SEQ ID NO: 16141 - DNA, 22 bp, Artificial Sequence
  Artificial sequence related to HLA knockouts in cell therapy
caggagcagagatacacctgcc

SEQ ID NO: 16142 - DNA, 22 bp, Artificial Sequence
  Artificial sequence related to HLA knockouts in cell therapy
aggagcagagatacacctgcca

SEQ ID NO: 16143 - DNA, 22 bp, Artificial Sequence
  Artificial sequence related to HLA knockouts in cell therapy
ggagcagagatacacctgccat

SEQ ID NO: 16144 - DNA, 22 bp, Artificial Sequence
  Artificial sequence related to HLA knockouts in cell therapy
gagcagagatacacctgccatg

SEQ ID NO: 16145 - DNA, 22 bp, Artificial Sequence
  Artificial sequence related to HLA knockouts in cell therapy
agcagagatacacctgccatgt

SEQ ID NO: 16146 - DNA, 22 bp, Artificial Sequence
  Artificial sequence related to HLA knockouts in cell therapy
gcagagatacacctgccatgtg

SEQ ID NO: 16147 - DNA, 22 bp, Artificial Sequence
  Artificial sequence related to HLA knockouts in cell therapy
cagagatacacctgccatgtgc

SEQ ID NO: 16148 - DNA, 22 bp, Artificial Sequence
  Artificial sequence related to HLA knockouts in cell therapy
agagatacacctgccatgtgca

SEQ ID NO: 16149 - DNA, 22 bp, Artificial Sequence
  Artificial sequence related to HLA knockouts in cell therapy
gagatacacctgccatgtgcag

SEQ ID NO: 16150 - DNA, 22 bp, Artificial Sequence
  Artificial sequence related to HLA knockouts in cell therapy
agatacacctgccatgtgcagc

SEQ ID NO: 16151 - DNA, 22 bp, Artificial Sequence
  Artificial sequence related to HLA knockouts in cell therapy
gatacacctgccatgtgcagca

SEQ ID NO: 16152 - DNA, 22 bp, Artificial Sequence
  Artificial sequence related to HLA knockouts in cell therapy
atacacctgccatgtgcagcat

SEQ ID NO: 16153 - DNA, 22 bp, Artificial Sequence
  Artificial sequence related to HLA knockouts in cell therapy
tacacctgccatgtgcagcatg

SEQ ID NO: 16154 - DNA, 22 bp, Artificial Sequence
  Artificial sequence related to HLA knockouts in cell therapy
acacctgccatgtgcagcatga

SEQ ID NO: 16155 - DNA, 22 bp, Artificial Sequence
  Artificial sequence related to HLA knockouts in cell therapy
cacctgccatgtgcagcatgag

SEQ ID NO: 16156 - DNA, 22 bp, Artificial Sequence
  Artificial sequence related to HLA knockouts in cell therapy
acctgccatgtgcagcatgagg

SEQ ID NO: 16157 - DNA, 22 bp, Artificial Sequence
  Artificial sequence related to HLA knockouts in cell therapy
ctgccatgtgcagcatgagggt

SEQ ID NO: 16158 - DNA, 22 bp, Artificial Sequence
  Artificial sequence related to HLA knockouts in cell therapy
tgccatgtgcagcatgagggtt

SEQ ID NO: 16159 - DNA, 22 bp, Artificial Sequence
  Artificial sequence related to HLA knockouts in cell therapy
gccatgtgcagcatgagggttt

SEQ ID NO: 16160 - DNA, 22 bp, Artificial Sequence
  Artificial sequence related to HLA knockouts in cell therapy
ccatgtgcagcatgagggtttg

SEQ ID NO: 16161 - DNA, 22 bp, Artificial Sequence
  Artificial sequence related to HLA knockouts in cell therapy
catgtgcagcatgagggtttgc

SEQ ID NO: 16162 - DNA, 22 bp, Artificial Sequence
  Artificial sequence related to HLA knockouts in cell therapy
atgtgcagcatgagggtttgcc

SEQ ID NO: 16163 - DNA, 22 bp, Artificial Sequence
  Artificial sequence related to HLA knockouts in cell therapy
tgtgcagcatgagggtttgccc

SEQ ID NO: 16164 - DNA, 22 bp, Artificial Sequence
  Artificial sequence related to HLA knockouts in cell therapy
gtgcagcatgagggtttgccca

SEQ ID NO: 16165 - DNA, 22 bp, Artificial Sequence
  Artificial sequence related to HLA knockouts in cell therapy
tgcagcatgagggtttgcccaa

SEQ ID NO: 16166 - DNA, 22 bp, Artificial Sequence
  Artificial sequence related to HLA knockouts in cell therapy
gcagcatgagggtttgcccaag

SEQ ID NO: 16167 - DNA, 22 bp, Artificial Sequence
  Artificial sequence related to HLA knockouts in cell therapy
cagcatgagggtttgcccaagc

SEQ ID NO: 16168 - DNA, 22 bp, Artificial Sequence
  Artificial sequence related to HLA knockouts in cell therapy
agcatgagggtttgcccaagcc

SEQ ID NO: 16169 - DNA, 22 bp, Artificial Sequence
  Artificial sequence related to HLA knockouts in cell therapy
accctgagatgggagccgtctt

SEQ ID NO: 16170 - DNA, 22 bp, Artificial Sequence
  Artificial sequence related to HLA knockouts in cell therapy
tgagatgggagccgtcttccca

SEQ ID NO: 16171 - DNA, 22 bp, Artificial Sequence
  Artificial sequence related to HLA knockouts in cell therapy
cccatcgtgggcatcattgctg

SEQ ID NO: 16172 - DNA, 22 bp, Artificial Sequence
  Artificial sequence related to HLA knockouts in cell therapy
ccatcgtgggcatcattgctgg

SEQ ID NO: 16173 - DNA, 22 bp, Artificial Sequence
  Artificial sequence related to HLA knockouts in cell therapy
catcgtgggcatcattgctggc

SEQ ID NO: 16174 - DNA, 22 bp, Artificial Sequence
  Artificial sequence related to HLA knockouts in cell therapy
atcgtgggcatcattgctggcc

SEQ ID NO: 16175 - DNA, 22 bp, Artificial Sequence
  Artificial sequence related to HLA knockouts in cell therapy
tcgtgggcatcattgctggcct

SEQ ID NO: 16176 - DNA, 22 bp, Artificial Sequence
  Artificial sequence related to HLA knockouts in cell therapy
tgggcatcattgctggcctggt

SEQ ID NO: 16177 - DNA, 22 bp, Artificial Sequence
  Artificial sequence related to HLA knockouts in cell therapy
gggcatcattgctggcctggtt

SEQ ID NO: 16178 - DNA, 22 bp, Artificial Sequence
  Artificial sequence related to HLA knockouts in cell therapy
ggcatcattgctggcctggttc

SEQ ID NO: 16179 - DNA, 22 bp, Artificial Sequence
  Artificial sequence related to HLA knockouts in cell therapy
gcatcattgctggcctggttct

SEQ ID NO: 16180 - DNA, 22 bp, Artificial Sequence
  Artificial sequence related to HLA knockouts in cell therapy
catcattgctggcctggttctc

SEQ ID NO: 16181 - DNA, 22 bp, Artificial Sequence
  Artificial sequence related to HLA knockouts in cell therapy
atcattgctggcctggttctct

SEQ ID NO: 16182 - DNA, 22 bp, Artificial Sequence
  Artificial sequence related to HLA knockouts in cell therapy
tcattgctggcctggttctctt

SEQ ID NO: 16183 - DNA, 22 bp, Artificial Sequence
  Artificial sequence related to HLA knockouts in cell therapy
cattgctggcctggttctcttt

SEQ ID NO: 16184 - DNA, 22 bp, Artificial Sequence
  Artificial sequence related to HLA knockouts in cell therapy
attgctggcctggttctctttg

SEQ ID NO: 16185 - DNA, 22 bp, Artificial Sequence
  Artificial sequence related to HLA knockouts in cell therapy
ttgctggcctggttctctttgg

SEQ ID NO: 16186 - DNA, 22 bp, Artificial Sequence
  Artificial sequence related to HLA knockouts in cell therapy
tgctggcctggttctctttgga

SEQ ID NO: 16187 - DNA, 22 bp, Artificial Sequence
  Artificial sequence related to HLA knockouts in cell therapy
gctggcctggttctctttggag

SEQ ID NO: 16188 - DNA, 22 bp, Artificial Sequence
  Artificial sequence related to HLA knockouts in cell therapy
ctggcctggttctctttggagc

SEQ ID NO: 16189 - DNA, 22 bp, Artificial Sequence
  Artificial sequence related to HLA knockouts in cell therapy
tggcctggttctctttggagct

SEQ ID NO: 16190 - DNA, 22 bp, Artificial Sequence
  Artificial sequence related to HLA knockouts in cell therapy
ggcctggttctctttggagctg

SEQ ID NO: 16191 - DNA, 22 bp, Artificial Sequence
  Artificial sequence related to HLA knockouts in cell therapy
gcctggttctctttggagctgt

SEQ ID NO: 16192 - DNA, 22 bp, Artificial Sequence
  Artificial sequence related to HLA knockouts in cell therapy
cctggttctctttggagctgtg

SEQ ID NO: 16193 - DNA, 22 bp, Artificial Sequence
  Artificial sequence related to HLA knockouts in cell therapy
ctggttctctttggagctgtga

SEQ ID NO: 16194 - DNA, 22 bp, Artificial Sequence
  Artificial sequence related to HLA knockouts in cell therapy
tggttctctttggagctgtgat

SEQ ID NO: 16195 - DNA, 22 bp, Artificial Sequence
  Artificial sequence related to HLA knockouts in cell therapy
ggttctctttggagctgtgatc

SEQ ID NO: 16196 - DNA, 22 bp, Artificial Sequence
  Artificial sequence related to HLA knockouts in cell therapy
gttctctttggagctgtgatca

SEQ ID NO: 16197 - DNA, 22 bp, Artificial Sequence
  Artificial sequence related to HLA knockouts in cell therapy
ttctctttggagctgtgatcac

SEQ ID NO: 16198 - DNA, 22 bp, Artificial Sequence
  Artificial sequence related to HLA knockouts in cell therapy
tctctttggagctgtgatcact

SEQ ID NO: 16199 - DNA, 22 bp, Artificial Sequence
  Artificial sequence related to HLA knockouts in cell therapy
ctctttggagctgtgatcactg

SEQ ID NO: 16200 - DNA, 22 bp, Artificial Sequence
  Artificial sequence related to HLA knockouts in cell therapy
tctttggagctgtgatcactgg

SEQ ID NO: 16201 - DNA, 22 bp, Artificial Sequence
  Artificial sequence related to HLA knockouts in cell therapy
ctttggagctgtgatcactgga

SEQ ID NO: 16202 - DNA, 22 bp, Artificial Sequence
  Artificial sequence related to HLA knockouts in cell therapy
tttggagctgtgatcactggag

SEQ ID NO: 16203 - DNA, 22 bp, Artificial Sequence
  Artificial sequence related to HLA knockouts in cell therapy
ttggagctgtgatcactggagc

SEQ ID NO: 16204 - DNA, 22 bp, Artificial Sequence
  Artificial sequence related to HLA knockouts in cell therapy
tggagctgtgatcactggagct

SEQ ID NO: 16205 - DNA, 22 bp, Artificial Sequence
  Artificial sequence related to HLA knockouts in cell therapy
ggagctgtgatcactggagctg

SEQ ID NO: 16206 - DNA, 22 bp, Artificial Sequence
  Artificial sequence related to HLA knockouts in cell therapy
gagctgtgatcactggagctgt

SEQ ID NO: 16207 - DNA, 22 bp, Artificial Sequence
  Artificial sequence related to HLA knockouts in cell therapy
agctgtgatcactggagctgtg

SEQ ID NO: 16208 - DNA, 22 bp, Artificial Sequence
  Artificial sequence related to HLA knockouts in cell therapy
gctgtgatcactggagctgtgg

SEQ ID NO: 16209 - DNA, 22 bp, Artificial Sequence
  Artificial sequence related to HLA knockouts in cell therapy
ctgtgatcactggagctgtggt

SEQ ID NO: 16210 - DNA, 22 bp, Artificial Sequence
  Artificial sequence related to HLA knockouts in cell therapy
tgtgatcactggagctgtggtc

SEQ ID NO: 16211 - DNA, 22 bp, Artificial Sequence
  Artificial sequence related to HLA knockouts in cell therapy
gtgatcactggagctgtggtcg

SEQ ID NO: 16212 - DNA, 22 bp, Artificial Sequence
  Artificial sequence related to HLA knockouts in cell therapy
tgatcactggagctgtggtcgc

SEQ ID NO: 16213 - DNA, 22 bp, Artificial Sequence
  Artificial sequence related to HLA knockouts in cell therapy
gatcactggagctgtggtcgct

SEQ ID NO: 16214 - DNA, 22 bp, Artificial Sequence
  Artificial sequence related to HLA knockouts in cell therapy
atcactggagctgtggtcgctg

SEQ ID NO: 16215 - DNA, 22 bp, Artificial Sequence
  Artificial sequence related to HLA knockouts in cell therapy
gagctgtggtcgctgctgtgat

SEQ ID NO: 16216 - DNA, 22 bp, Artificial Sequence
  Artificial sequence related to HLA knockouts in cell therapy
agctgtggtcgctgctgtgatg

SEQ ID NO: 16217 - DNA, 22 bp, Artificial Sequence
  Artificial sequence related to HLA knockouts in cell therapy
gctgtggtcgctgctgtgatgt

SEQ ID NO: 16218 - DNA, 22 bp, Artificial Sequence
  Artificial sequence related to HLA knockouts in cell therapy
ctgtggtcgctgctgtgatgtg

SEQ ID NO: 16219 - DNA, 22 bp, Artificial Sequence
  Artificial sequence related to HLA knockouts in cell therapy
tgtggtcgctgctgtgatgtgg

SEQ ID NO: 16220 - DNA, 22 bp, Artificial Sequence
  Artificial sequence related to HLA knockouts in cell therapy
gtggtcgctgctgtgatgtgga

SEQ ID NO: 16221 - DNA, 22 bp, Artificial Sequence
  Artificial sequence related to HLA knockouts in cell therapy
tggtcgctgctgtgatgtggag

SEQ ID NO: 16222 - DNA, 22 bp, Artificial Sequence
  Artificial sequence related to HLA knockouts in cell therapy
gtcgctgctgtgatgtggagga

SEQ ID NO: 16223 - DNA, 22 bp, Artificial Sequence
  Artificial sequence related to HLA knockouts in cell therapy
tcgctgctgtgatgtggaggag

SEQ ID NO: 16224 - DNA, 22 bp, Artificial Sequence
  Artificial sequence related to HLA knockouts in cell therapy
gctgctgtgatgtggaggagga

SEQ ID NO: 16225 - DNA, 22 bp, Artificial Sequence
  Artificial sequence related to HLA knockouts in cell therapy
ctgctgtgatgtggaggaggaa

SEQ ID NO: 16226 - DNA, 22 bp, Artificial Sequence
  Artificial sequence related to HLA knockouts in cell therapy
tgctgtgatgtggaggaggaag

SEQ ID NO: 16227 - DNA, 22 bp, Artificial Sequence
  Artificial sequence related to HLA knockouts in cell therapy
gctgtgatgtggaggaggaaga

SEQ ID NO: 16228 - DNA, 22 bp, Artificial Sequence
  Artificial sequence related to HLA knockouts in cell therapy
ctgtgatgtggaggaggaagag

SEQ ID NO: 16229 - DNA, 22 bp, Artificial Sequence
  Artificial sequence related to HLA knockouts in cell therapy
tgtgatgtggaggaggaagagc

SEQ ID NO: 16230 - DNA, 22 bp, Artificial Sequence
  Artificial sequence related to HLA knockouts in cell therapy
gtgatgtggaggaggaagagct

SEQ ID NO: 16231 - DNA, 22 bp, Artificial Sequence
  Artificial sequence related to HLA knockouts in cell therapy
tgatgtggaggaggaagagctc

SEQ ID NO: 16232 - DNA, 22 bp, Artificial Sequence
  Artificial sequence related to HLA knockouts in cell therapy
gatgtggaggaggaagagctca

SEQ ID NO: 16233 - DNA, 22 bp, Artificial Sequence
  Artificial sequence related to HLA knockouts in cell therapy
atgtggaggaggaagagctcag

SEQ ID NO: 16234 - DNA, 22 bp, Artificial Sequence
  Artificial sequence related to HLA knockouts in cell therapy
tgtggaggaggaagagctcaga

SEQ ID NO: 16235 - DNA, 22 bp, Artificial Sequence
  Artificial sequence related to HLA knockouts in cell therapy
gtggaggaggaagagctcagat

SEQ ID NO: 16236 - DNA, 22 bp, Artificial Sequence
  Artificial sequence related to HLA knockouts in cell therapy
tggaggaggaagagctcagata

SEQ ID NO: 16237 - DNA, 22 bp, Artificial Sequence
  Artificial sequence related to HLA knockouts in cell therapy
ggaggaggaagagctcagatag

SEQ ID NO: 16238 - DNA, 22 bp, Artificial Sequence
  Artificial sequence related to HLA knockouts in cell therapy
gaggaggaagagctcagataga

SEQ ID NO: 16239 - DNA, 22 bp, Artificial Sequence
  Artificial sequence related to HLA knockouts in cell therapy
aggaggaagagctcagatagaa

SEQ ID NO: 16240 - DNA, 22 bp, Artificial Sequence
  Artificial sequence related to HLA knockouts in cell therapy
ggaggaagagctcagatagaaa

SEQ ID NO: 16241 - DNA, 22 bp, Artificial Sequence
  Artificial sequence related to HLA knockouts in cell therapy
aaaggagggagctactctcagg

SEQ ID NO: 16242 - DNA, 22 bp, Artificial Sequence
  Artificial sequence related to HLA knockouts in cell therapy
aaggagggagctactctcaggc

SEQ ID NO: 16243 - DNA, 22 bp, Artificial Sequence
  Artificial sequence related to HLA knockouts in cell therapy
aggagggagctactctcaggct

SEQ ID NO: 16244 - DNA, 22 bp, Artificial Sequence
  Artificial sequence related to HLA knockouts in cell therapy
agggagctactctcaggctgca

SEQ ID NO: 16245 - DNA, 22 bp, Artificial Sequence
  Artificial sequence related to HLA knockouts in cell therapy
gggagctactctcaggctgcaa

SEQ ID NO: 16246 - DNA, 22 bp, Artificial Sequence
  Artificial sequence related to HLA knockouts in cell therapy
ggagctactctcaggctgcaag

SEQ ID NO: 16247 - DNA, 22 bp, Artificial Sequence
  Artificial sequence related to HLA knockouts in cell therapy
gagctactctcaggctgcaagc

SEQ ID NO: 16248 - DNA, 22 bp, Artificial Sequence
  Artificial sequence related to HLA knockouts in cell therapy
agctactctcaggctgcaagca

SEQ ID NO: 16249 - DNA, 22 bp, Artificial Sequence
  Artificial sequence related to HLA knockouts in cell therapy
gctactctcaggctgcaagcag

SEQ ID NO: 16250 - DNA, 22 bp, Artificial Sequence
  Artificial sequence related to HLA knockouts in cell therapy
ctactctcaggctgcaagcagt

SEQ ID NO: 16251 - DNA, 22 bp, Artificial Sequence
  Artificial sequence related to HLA knockouts in cell therapy
tactctcaggctgcaagcagtg

SEQ ID NO: 16252 - DNA, 22 bp, Artificial Sequence
  Artificial sequence related to HLA knockouts in cell therapy
actctcaggctgcaagcagtga

SEQ ID NO: 16253 - DNA, 22 bp, Artificial Sequence
  Artificial sequence related to HLA knockouts in cell therapy
ctctcaggctgcaagcagtgac

SEQ ID NO: 16254 - DNA, 22 bp, Artificial Sequence
  Artificial sequence related to HLA knockouts in cell therapy
tctcaggctgcaagcagtgaca

SEQ ID NO: 16255 - DNA, 22 bp, Artificial Sequence
  Artificial sequence related to HLA knockouts in cell therapy
ctcaggctgcaagcagtgacag

SEQ ID NO: 16256 - DNA, 22 bp, Artificial Sequence
  Artificial sequence related to HLA knockouts in cell therapy
tcaggctgcaagcagtgacagt

SEQ ID NO: 16257 - DNA, 22 bp, Artificial Sequence
  Artificial sequence related to HLA knockouts in cell therapy
caggctgcaagcagtgacagtg

SEQ ID NO: 16258 - DNA, 22 bp, Artificial Sequence
  Artificial sequence related to HLA knockouts in cell therapy
aggctgcaagcagtgacagtgc

SEQ ID NO: 16259 - DNA, 22 bp, Artificial Sequence
  Artificial sequence related to HLA knockouts in cell therapy
ctgcaagcagtgacagtgccca

SEQ ID NO: 16260 - DNA, 22 bp, Artificial Sequence
  Artificial sequence related to HLA knockouts in cell therapy
tgcaagcagtgacagtgcccag

SEQ ID NO: 16261 - DNA, 22 bp, Artificial Sequence
  Artificial sequence related to HLA knockouts in cell therapy
tgacagtgcccagggctctgat

SEQ ID NO: 16262 - DNA, 22 bp, Artificial Sequence
  Artificial sequence related to HLA knockouts in cell therapy
acagtgcccagggctctgatgt

SEQ ID NO: 16263 - DNA, 22 bp, Artificial Sequence
  Artificial sequence related to HLA knockouts in cell therapy
agtgcccagggctctgatgtgt

SEQ ID NO: 16264 - DNA, 22 bp, Artificial Sequence
  Artificial sequence related to HLA knockouts in cell therapy
tgcccagggctctgatgtgtct

SEQ ID NO: 16265 - DNA, 22 bp, Artificial Sequence
  Artificial sequence related to HLA knockouts in cell therapy
cccagggctctgatgtgtctct

SEQ ID NO: 16266 - DNA, 22 bp, Artificial Sequence
  Artificial sequence related to HLA knockouts in cell therapy
ccagggctctgatgtgtctctc

SEQ ID NO: 16267 - DNA, 22 bp, Artificial Sequence
  Artificial sequence related to HLA knockouts in cell therapy
cagggctctgatgtgtctctca

SEQ ID NO: 16268 - DNA, 22 bp, Artificial Sequence
  Artificial sequence related to HLA knockouts in cell therapy
agggctctgatgtgtctctcac

SEQ ID NO: 16269 - DNA, 22 bp, Artificial Sequence
  Artificial sequence related to HLA knockouts in cell therapy
gggctctgatgtgtctctcaca

SEQ ID NO: 16270 - DNA, 22 bp, Artificial Sequence
  Artificial sequence related to HLA knockouts in cell therapy
ggctctgatgtgtctctcacag

SEQ ID NO: 16271 - DNA, 22 bp, Artificial Sequence
  Artificial sequence related to HLA knockouts in cell therapy
gctctgatgtgtctctcacagc

SEQ ID NO: 16272 - DNA, 22 bp, Artificial Sequence
  Artificial sequence related to HLA knockouts in cell therapy
ctctgatgtgtctctcacagct

SEQ ID NO: 16273 - DNA, 22 bp, Artificial Sequence
  Artificial sequence related to HLA knockouts in cell therapy
tctgatgtgtctctcacagctt

SEQ ID NO: 16274 - DNA, 22 bp, Artificial Sequence
  Artificial sequence related to HLA knockouts in cell therapy
ctgatgtgtctctcacagcttg

SEQ ID NO: 16275 - DNA, 22 bp, Artificial Sequence
  Artificial sequence related to HLA knockouts in cell therapy
tgatgtgtctctcacagcttgt

SEQ ID NO: 16276 - DNA, 22 bp, Artificial Sequence
  Artificial sequence related to HLA knockouts in cell therapy
gatgtgtctctcacagcttgta

SEQ ID NO: 16277 - DNA, 22 bp, Artificial Sequence
  Artificial sequence related to HLA knockouts in cell therapy
atgtgtctctcacagcttgtaa

SEQ ID NO: 16278 - DNA, 22 bp, Artificial Sequence
  Artificial sequence related to HLA knockouts in cell therapy
tgtgtctctcacagcttgtaaa

SEQ ID NO: 16279 - DNA, 22 bp, Artificial Sequence
  Artificial sequence related to HLA knockouts in cell therapy
gtgtctctcacagcttgtaaag

SEQ ID NO: 16280 - DNA, 22 bp, Artificial Sequence
  Artificial sequence related to HLA knockouts in cell therapy
tgtctctcacagcttgtaaagt

SEQ ID NO: 16281 - DNA, 22 bp, Artificial Sequence
  Artificial sequence related to HLA knockouts in cell therapy
gtctctcacagcttgtaaagtg

SEQ ID NO: 16282 - DNA, 22 bp, Artificial Sequence
  Artificial sequence related to HLA knockouts in cell therapy
tctctcacagcttgtaaagtgt

SEQ ID NO: 16283 - DNA, 22 bp, Artificial Sequence
  Artificial sequence related to HLA knockouts in cell therapy
ctctcacagcttgtaaagtgtg

SEQ ID NO: 16284 - DNA, 22 bp, Artificial Sequence
  Artificial sequence related to HLA knockouts in cell therapy
tctcacagcttgtaaagtgtga

SEQ ID NO: 16285 - DNA, 22 bp, Artificial Sequence
  Artificial sequence related to HLA knockouts in cell therapy
ctcacagcttgtaaagtgtgag

SEQ ID NO: 16286 - DNA, 22 bp, Artificial Sequence
  Artificial sequence related to HLA knockouts in cell therapy
tcacagcttgtaaagtgtgaga

SEQ ID NO: 16287 - DNA, 22 bp, Artificial Sequence
  Artificial sequence related to HLA knockouts in cell therapy
cacagcttgtaaagtgtgagac

SEQ ID NO: 16288 - DNA, 22 bp, Artificial Sequence
  Artificial sequence related to HLA knockouts in cell therapy
acagcttgtaaagtgtgagaca

SEQ ID NO: 16289 - DNA, 22 bp, Artificial Sequence
  Artificial sequence related to HLA knockouts in cell therapy
cagcttgtaaagtgtgagacag

SEQ ID NO: 16290 - DNA, 22 bp, Artificial Sequence
  Artificial sequence related to HLA knockouts in cell therapy
agcttgtaaagtgtgagacagc

SEQ ID NO: 16291 - DNA, 22 bp, Artificial Sequence
  Artificial sequence related to HLA knockouts in cell therapy
gcttgtaaagtgtgagacagct

SEQ ID NO: 16292 - DNA, 22 bp, Artificial Sequence
  Artificial sequence related to HLA knockouts in cell therapy
cttgtaaagtgtgagacagctg

SEQ ID NO: 16293 - DNA, 22 bp, Artificial Sequence
  Artificial sequence related to HLA knockouts in cell therapy
ttgtaaagtgtgagacagctgc

SEQ ID NO: 16294 - DNA, 22 bp, Artificial Sequence
  Artificial sequence related to HLA knockouts in cell therapy
tgtaaagtgtgagacagctgcc

SEQ ID NO: 16295 - DNA, 22 bp, Artificial Sequence
  Artificial sequence related to HLA knockouts in cell therapy
gtaaagtgtgagacagctgcct

SEQ ID NO: 16296 - DNA, 22 bp, Artificial Sequence
  Artificial sequence related to HLA knockouts in cell therapy
taaagtgtgagacagctgcctt

SEQ ID NO: 16297 - DNA, 22 bp, Artificial Sequence
  Artificial sequence related to HLA knockouts in cell therapy
aaagtgtgagacagctgccttg

SEQ ID NO: 16298 - DNA, 22 bp, Artificial Sequence
  Artificial sequence related to HLA knockouts in cell therapy
aagtgtgagacagctgccttgt

SEQ ID NO: 16299 - DNA, 22 bp, Artificial Sequence
  Artificial sequence related to HLA knockouts in cell therapy
agtgtgagacagctgccttgtg

SEQ ID NO: 16300 - DNA, 22 bp, Artificial Sequence
  Artificial sequence related to HLA knockouts in cell therapy
gtgtgagacagctgccttgtgt

SEQ ID NO: 16301 - DNA, 22 bp, Artificial Sequence
  Artificial sequence related to HLA knockouts in cell therapy
tgtgagacagctgccttgtgtg

SEQ ID NO: 16302 - DNA, 22 bp, Artificial Sequence
  Artificial sequence related to HLA knockouts in cell therapy
gtgagacagctgccttgtgtgg

SEQ ID NO: 16303 - DNA, 22 bp, Artificial Sequence
  Artificial sequence related to HLA knockouts in cell therapy
tgagacagctgccttgtgtggg

SEQ ID NO: 16304 - DNA, 22 bp, Artificial Sequence
  Artificial sequence related to HLA knockouts in cell therapy
gagacagctgccttgtgtggga

SEQ ID NO: 16305 - DNA, 22 bp, Artificial Sequence
  Artificial sequence related to HLA knockouts in cell therapy
agacagctgccttgtgtgggac

SEQ ID NO: 16306 - DNA, 22 bp, Artificial Sequence
  Artificial sequence related to HLA knockouts in cell therapy
gacagctgccttgtgtgggact

SEQ ID NO: 16307 - DNA, 22 bp, Artificial Sequence
  Artificial sequence related to HLA knockouts in cell therapy
acagctgccttgtgtgggactg

SEQ ID NO: 16308 - DNA, 22 bp, Artificial Sequence
  Artificial sequence related to HLA knockouts in cell therapy
cagctgccttgtgtgggactga

SEQ ID NO: 16309 - DNA, 22 bp, Artificial Sequence
  Artificial sequence related to HLA knockouts in cell therapy
agctgccttgtgtgggactgag

SEQ ID NO: 16310 - DNA, 22 bp, Artificial Sequence
  Artificial sequence related to HLA knockouts in cell therapy
gctgccttgtgtgggactgaga

SEQ ID NO: 16311 - DNA, 22 bp, Artificial Sequence
  Artificial sequence related to HLA knockouts in cell therapy
ctgccttgtgtgggactgagag

SEQ ID NO: 16312 - DNA, 22 bp, Artificial Sequence
  Artificial sequence related to HLA knockouts in cell therapy
tgccttgtgtgggactgagagg

SEQ ID NO: 16313 - DNA, 22 bp, Artificial Sequence
  Artificial sequence related to HLA knockouts in cell therapy
ccttgtgtgggactgagaggca

SEQ ID NO: 16314 - DNA, 22 bp, Artificial Sequence
  Artificial sequence related to HLA knockouts in cell therapy
cttgtgtgggactgagaggcaa

SEQ ID NO: 16315 - DNA, 22 bp, Artificial Sequence
  Artificial sequence related to HLA knockouts in cell therapy
ttgtgtgggactgagaggcaag

SEQ ID NO: 16316 - DNA, 22 bp, Artificial Sequence
  Artificial sequence related to HLA knockouts in cell therapy
tgtgtgggactgagaggcaaga

SEQ ID NO: 16317 - DNA, 22 bp, Artificial Sequence
  Artificial sequence related to HLA knockouts in cell therapy
gtgtgggactgagaggcaagag

SEQ ID NO: 16318 - DNA, 22 bp, Artificial Sequence
  Artificial sequence related to HLA knockouts in cell therapy
tgtgggactgagaggcaagagt

SEQ ID NO: 16319 - DNA, 22 bp, Artificial Sequence
  Artificial sequence related to HLA knockouts in cell therapy
gtgggactgagaggcaagagtt

SEQ ID NO: 16320 - DNA, 22 bp, Artificial Sequence
  Artificial sequence related to HLA knockouts in cell therapy
tgggactgagaggcaagagttg

SEQ ID NO: 16321 - DNA, 22 bp, Artificial Sequence
  Artificial sequence related to HLA knockouts in cell therapy
gggactgagaggcaagagttgt

SEQ ID NO: 16322 - DNA, 22 bp, Artificial Sequence
  Artificial sequence related to HLA knockouts in cell therapy
ggactgagaggcaagagttgtt

SEQ ID NO: 16323 - DNA, 22 bp, Artificial Sequence
  Artificial sequence related to HLA knockouts in cell therapy
gactgagaggcaagagttgttc

SEQ ID NO: 16324 - DNA, 22 bp, Artificial Sequence
  Artificial sequence related to HLA knockouts in cell therapy
actgagaggcaagagttgttcc

SEQ ID NO: 16325 - DNA, 22 bp, Artificial Sequence
  Artificial sequence related to HLA knockouts in cell therapy
ctgagaggcaagagttgttcct

SEQ ID NO: 16326 - DNA, 22 bp, Artificial Sequence
  Artificial sequence related to HLA knockouts in cell therapy
tgagaggcaagagttgttcctg

SEQ ID NO: 16327 - DNA, 22 bp, Artificial Sequence
  Artificial sequence related to HLA knockouts in cell therapy
gagaggcaagagttgttcctgc

SEQ ID NO: 16328 - DNA, 22 bp, Artificial Sequence
  Artificial sequence related to HLA knockouts in cell therapy
agaggcaagagttgttcctgcc

SEQ ID NO: 16329 - DNA, 22 bp, Artificial Sequence
  Artificial sequence related to HLA knockouts in cell therapy
gaggcaagagttgttcctgccc

SEQ ID NO: 16330 - DNA, 22 bp, Artificial Sequence
  Artificial sequence related to HLA knockouts in cell therapy
aggcaagagttgttcctgccct

SEQ ID NO: 16331 - DNA, 22 bp, Artificial Sequence
  Artificial sequence related to HLA knockouts in cell therapy
ggcaagagttgttcctgccctt

SEQ ID NO: 16332 - DNA, 22 bp, Artificial Sequence
  Artificial sequence related to HLA knockouts in cell therapy
gcaagagttgttcctgcccttc

SEQ ID NO: 16333 - DNA, 22 bp, Artificial Sequence
  Artificial sequence related to HLA knockouts in cell therapy
caagagttgttcctgcccttcc

SEQ ID NO: 16334 - DNA, 22 bp, Artificial Sequence
  Artificial sequence related to HLA knockouts in cell therapy
aagagttgttcctgcccttccc

SEQ ID NO: 16335 - DNA, 22 bp, Artificial Sequence
  Artificial sequence related to HLA knockouts in cell therapy
agagttgttcctgcccttccct

SEQ ID NO: 16336 - DNA, 22 bp, Artificial Sequence
  Artificial sequence related to HLA knockouts in cell therapy
gagttgttcctgcccttccctt

SEQ ID NO: 16337 - DNA, 22 bp, Artificial Sequence
  Artificial sequence related to HLA knockouts in cell therapy
agttgttcctgcccttcccttt

SEQ ID NO: 16338 - DNA, 22 bp, Artificial Sequence
  Artificial sequence related to HLA knockouts in cell therapy
gttgttcctgcccttccctttg

SEQ ID NO: 16339 - DNA, 22 bp, Artificial Sequence
  Artificial sequence related to HLA knockouts in cell therapy
ttgttcctgcccttccctttgt

SEQ ID NO: 16340 - DNA, 22 bp, Artificial Sequence
  Artificial sequence related to HLA knockouts in cell therapy
tgttcctgcccttccctttgtg

SEQ ID NO: 16341 - DNA, 22 bp, Artificial Sequence
  Artificial sequence related to HLA knockouts in cell therapy
gttcctgcccttccctttgtga

SEQ ID NO: 16342 - DNA, 22 bp, Artificial Sequence
  Artificial sequence related to HLA knockouts in cell therapy
ttcctgcccttccctttgtgac

SEQ ID NO: 16343 - DNA, 22 bp, Artificial Sequence
  Artificial sequence related to HLA knockouts in cell therapy
tcctgcccttccctttgtgact

SEQ ID NO: 16344 - DNA, 22 bp, Artificial Sequence
  Artificial sequence related to HLA knockouts in cell therapy
cctgcccttccctttgtgactt

SEQ ID NO: 16345 - DNA, 22 bp, Artificial Sequence
  Artificial sequence related to HLA knockouts in cell therapy
ctgcccttccctttgtgacttg

SEQ ID NO: 16346 - DNA, 22 bp, Artificial Sequence
  Artificial sequence related to HLA knockouts in cell therapy
tgcccttccctttgtgacttga

SEQ ID NO: 16347 - DNA, 22 bp, Artificial Sequence
  Artificial sequence related to HLA knockouts in cell therapy
gcccttccctttgtgacttgaa

SEQ ID NO: 16348 - DNA, 22 bp, Artificial Sequence
  Artificial sequence related to HLA knockouts in cell therapy
cccttccctttgtgacttgaag

SEQ ID NO: 16349 - DNA, 22 bp, Artificial Sequence
  Artificial sequence related to HLA knockouts in cell therapy
ccttccctttgtgacttgaaga

SEQ ID NO: 16350 - DNA, 22 bp, Artificial Sequence
  Artificial sequence related to HLA knockouts in cell therapy
cttccctttgtgacttgaagaa

SEQ ID NO: 16351 - DNA, 22 bp, Artificial Sequence
  Artificial sequence related to HLA knockouts in cell therapy
ttccctttgtgacttgaagaac

SEQ ID NO: 16352 - DNA, 22 bp, Artificial Sequence
  Artificial sequence related to HLA knockouts in cell therapy
tccctttgtgacttgaagaacc

SEQ ID NO: 16353 - DNA, 22 bp, Artificial Sequence
  Artificial sequence related to HLA knockouts in cell therapy
ccctttgtgacttgaagaaccc

SEQ ID NO: 16354 - DNA, 22 bp, Artificial Sequence
  Artificial sequence related to HLA knockouts in cell therapy
cctttgtgacttgaagaaccct

SEQ ID NO: 16355 - DNA, 22 bp, Artificial Sequence
  Artificial sequence related to HLA knockouts in cell therapy
ctttgtgacttgaagaaccctg

SEQ ID NO: 16356 - DNA, 22 bp, Artificial Sequence
  Artificial sequence related to HLA knockouts in cell therapy
tttgtgacttgaagaaccctga

SEQ ID NO: 16357 - DNA, 22 bp, Artificial Sequence
  Artificial sequence related to HLA knockouts in cell therapy
ttgtgacttgaagaaccctgac

SEQ ID NO: 16358 - DNA, 22 bp, Artificial Sequence
  Artificial sequence related to HLA knockouts in cell therapy
tgtgacttgaagaaccctgact

SEQ ID NO: 16359 - DNA, 22 bp, Artificial Sequence
  Artificial sequence related to HLA knockouts in cell therapy
gtgacttgaagaaccctgactt

SEQ ID NO: 16360 - DNA, 22 bp, Artificial Sequence
  Artificial sequence related to HLA knockouts in cell therapy
tgacttgaagaaccctgacttt

SEQ ID NO: 16361 - DNA, 22 bp, Artificial Sequence
  Artificial sequence related to HLA knockouts in cell therapy
gacttgaagaaccctgactttg

SEQ ID NO: 16362 - DNA, 22 bp, Artificial Sequence
  Artificial sequence related to HLA knockouts in cell therapy
acttgaagaaccctgactttgt

SEQ ID NO: 16363 - DNA, 22 bp, Artificial Sequence
  Artificial sequence related to HLA knockouts in cell therapy
cttgaagaaccctgactttgtt

SEQ ID NO: 16364 - DNA, 22 bp, Artificial Sequence
  Artificial sequence related to HLA knockouts in cell therapy
ttgaagaaccctgactttgttt

SEQ ID NO: 16365 - DNA, 22 bp, Artificial Sequence
  Artificial sequence related to HLA knockouts in cell therapy
tgaagaaccctgactttgtttc

SEQ ID NO: 16366 - DNA, 22 bp, Artificial Sequence
  Artificial sequence related to HLA knockouts in cell therapy
gaagaaccctgactttgtttct

SEQ ID NO: 16367 - DNA, 22 bp, Artificial Sequence
  Artificial sequence related to HLA knockouts in cell therapy
aagaaccctgactttgtttctg

SEQ ID NO: 16368 - DNA, 22 bp, Artificial Sequence
  Artificial sequence related to HLA knockouts in cell therapy
agaaccctgactttgtttctgc

SEQ ID NO: 16369 - DNA, 22 bp, Artificial Sequence
  Artificial sequence related to HLA knockouts in cell therapy
gaaccctgactttgtttctgca

SEQ ID NO: 16370 - DNA, 22 bp, Artificial Sequence
  Artificial sequence related to HLA knockouts in cell therapy
aaccctgactttgtttctgcaa

SEQ ID NO: 16371 - DNA, 22 bp, Artificial Sequence
  Artificial sequence related to HLA knockouts in cell therapy
accctgactttgtttctgcaaa

SEQ ID NO: 16372 - DNA, 22 bp, Artificial Sequence
  Artificial sequence related to HLA knockouts in cell therapy
ccctgactttgtttctgcaaag

SEQ ID NO: 16373 - DNA, 22 bp, Artificial Sequence
  Artificial sequence related to HLA knockouts in cell therapy
cctgactttgtttctgcaaagg

SEQ ID NO: 16374 - DNA, 22 bp, Artificial Sequence
  Artificial sequence related to HLA knockouts in cell therapy
ctgactttgtttctgcaaaggc

SEQ ID NO: 16375 - DNA, 22 bp, Artificial Sequence
  Artificial sequence related to HLA knockouts in cell therapy
tgactttgtttctgcaaaggca

SEQ ID NO: 16376 - DNA, 22 bp, Artificial Sequence
  Artificial sequence related to HLA knockouts in cell therapy
gactttgtttctgcaaaggcac

SEQ ID NO: 16377 - DNA, 22 bp, Artificial Sequence
  Artificial sequence related to HLA knockouts in cell therapy
actttgtttctgcaaaggcacc

SEQ ID NO: 16378 - DNA, 22 bp, Artificial Sequence
  Artificial sequence related to HLA knockouts in cell therapy
ctttgtttctgcaaaggcacct

SEQ ID NO: 16379 - DNA, 22 bp, Artificial Sequence
  Artificial sequence related to HLA knockouts in cell therapy
tttgtttctgcaaaggcacctg

SEQ ID NO: 16380 - DNA, 22 bp, Artificial Sequence
  Artificial sequence related to HLA knockouts in cell therapy
ttgtttctgcaaaggcacctgc

SEQ ID NO: 16381 - DNA, 22 bp, Artificial Sequence
  Artificial sequence related to HLA knockouts in cell therapy
tgtttctgcaaaggcacctgca

SEQ ID NO: 16382 - DNA, 22 bp, Artificial Sequence
  Artificial sequence related to HLA knockouts in cell therapy
gtttctgcaaaggcacctgcat

SEQ ID NO: 16383 - DNA, 22 bp, Artificial Sequence
  Artificial sequence related to HLA knockouts in cell therapy
tttctgcaaaggcacctgcatg

SEQ ID NO: 16384 - DNA, 22 bp, Artificial Sequence
  Artificial sequence related to HLA knockouts in cell therapy
ttctgcaaaggcacctgcatgt

SEQ ID NO: 16385 - DNA, 22 bp, Artificial Sequence
  Artificial sequence related to HLA knockouts in cell therapy
tctgcaaaggcacctgcatgtg

SEQ ID NO: 16386 - DNA, 22 bp, Artificial Sequence
  Artificial sequence related to HLA knockouts in cell therapy
ctgcaaaggcacctgcatgtgt

SEQ ID NO: 16387 - DNA, 22 bp, Artificial Sequence
  Artificial sequence related to HLA knockouts in cell therapy
tgcaaaggcacctgcatgtgtc

SEQ ID NO: 16388 - DNA, 22 bp, Artificial Sequence
  Artificial sequence related to HLA knockouts in cell therapy
gcaaaggcacctgcatgtgtct

SEQ ID NO: 16389 - DNA, 22 bp, Artificial Sequence
  Artificial sequence related to HLA knockouts in cell therapy
caaaggcacctgcatgtgtctg

SEQ ID NO: 16390 - DNA, 22 bp, Artificial Sequence
  Artificial sequence related to HLA knockouts in cell therapy
aaaggcacctgcatgtgtctgt

SEQ ID NO: 16391 - DNA, 22 bp, Artificial Sequence
  Artificial sequence related to HLA knockouts in cell therapy
aaggcacctgcatgtgtctgtg

SEQ ID NO: 16392 - DNA, 22 bp, Artificial Sequence
  Artificial sequence related to HLA knockouts in cell therapy
aggcacctgcatgtgtctgtgt

SEQ ID NO: 16393 - DNA, 22 bp, Artificial Sequence
  Artificial sequence related to HLA knockouts in cell therapy
ggcacctgcatgtgtctgtgtt

SEQ ID NO: 16394 - DNA, 22 bp, Artificial Sequence
  Artificial sequence related to HLA knockouts in cell therapy
gcacctgcatgtgtctgtgttc

SEQ ID NO: 16395 - DNA, 22 bp, Artificial Sequence
  Artificial sequence related to HLA knockouts in cell therapy
cacctgcatgtgtctgtgttcg

SEQ ID NO: 16396 - DNA, 22 bp, Artificial Sequence
  Artificial sequence related to HLA knockouts in cell therapy
acctgcatgtgtctgtgttcgt

SEQ ID NO: 16397 - DNA, 22 bp, Artificial Sequence
  Artificial sequence related to HLA knockouts in cell therapy
cctgcatgtgtctgtgttcgtg

SEQ ID NO: 16398 - DNA, 22 bp, Artificial Sequence
  Artificial sequence related to HLA knockouts in cell therapy
ctgcatgtgtctgtgttcgtgt

SEQ ID NO: 16399 - DNA, 22 bp, Artificial Sequence
  Artificial sequence related to HLA knockouts in cell therapy
tgcatgtgtctgtgttcgtgta

SEQ ID NO: 16400 - DNA, 22 bp, Artificial Sequence
  Artificial sequence related to HLA knockouts in cell therapy
gcatgtgtctgtgttcgtgtag

SEQ ID NO: 16401 - DNA, 22 bp, Artificial Sequence
  Artificial sequence related to HLA knockouts in cell therapy
catgtgtctgtgttcgtgtagg

SEQ ID NO: 16402 - DNA, 22 bp, Artificial Sequence
  Artificial sequence related to HLA knockouts in cell therapy
atgtgtctgtgttcgtgtaggc

SEQ ID NO: 16403 - DNA, 22 bp, Artificial Sequence
  Artificial sequence related to HLA knockouts in cell therapy
tgtgtctgtgttcgtgtaggca

SEQ ID NO: 16404 - DNA, 22 bp, Artificial Sequence
  Artificial sequence related to HLA knockouts in cell therapy
gtgtctgtgttcgtgtaggcat

SEQ ID NO: 16405 - DNA, 22 bp, Artificial Sequence
  Artificial sequence related to HLA knockouts in cell therapy
tgtctgtgttcgtgtaggcata

SEQ ID NO: 16406 - DNA, 22 bp, Artificial Sequence
  Artificial sequence related to HLA knockouts in cell therapy
gtctgtgttcgtgtaggcataa

SEQ ID NO: 16407 - DNA, 22 bp, Artificial Sequence
  Artificial sequence related to HLA knockouts in cell therapy
tctgtgttcgtgtaggcataat

SEQ ID NO: 16408 - DNA, 22 bp, Artificial Sequence
  Artificial sequence related to HLA knockouts in cell therapy
ctgtgttcgtgtaggcataatg

SEQ ID NO: 16409 - DNA, 22 bp, Artificial Sequence
  Artificial sequence related to HLA knockouts in cell therapy
tgtgttcgtgtaggcataatgt

SEQ ID NO: 16410 - DNA, 22 bp, Artificial Sequence
  Artificial sequence related to HLA knockouts in cell therapy
gtgttcgtgtaggcataatgtg

SEQ ID NO: 16411 - DNA, 22 bp, Artificial Sequence
  Artificial sequence related to HLA knockouts in cell therapy
tgttcgtgtaggcataatgtga

SEQ ID NO: 16412 - DNA, 22 bp, Artificial Sequence
  Artificial sequence related to HLA knockouts in cell therapy
gttcgtgtaggcataatgtgag

SEQ ID NO: 16413 - DNA, 22 bp, Artificial Sequence
  Artificial sequence related to HLA knockouts in cell therapy
ttcgtgtaggcataatgtgagg

SEQ ID NO: 16414 - DNA, 22 bp, Artificial Sequence
  Artificial sequence related to HLA knockouts in cell therapy
tcgtgtaggcataatgtgagga

SEQ ID NO: 16415 - DNA, 22 bp, Artificial Sequence
  Artificial sequence related to HLA knockouts in cell therapy
cgtgtaggcataatgtgaggag

SEQ ID NO: 16416 - DNA, 22 bp, Artificial Sequence
  Artificial sequence related to HLA knockouts in cell therapy
gtgtaggcataatgtgaggagg

SEQ ID NO: 16417 - DNA, 22 bp, Artificial Sequence
  Artificial sequence related to HLA knockouts in cell therapy
tgtaggcataatgtgaggaggt

SEQ ID NO: 16418 - DNA, 22 bp, Artificial Sequence
  Artificial sequence related to HLA knockouts in cell therapy
gtaggcataatgtgaggaggtg

SEQ ID NO: 16419 - DNA, 22 bp, Artificial Sequence
  Artificial sequence related to HLA knockouts in cell therapy
taggcataatgtgaggaggtgg

SEQ ID NO: 16420 - DNA, 22 bp, Artificial Sequence
  Artificial sequence related to HLA knockouts in cell therapy
aggcataatgtgaggaggtggg

SEQ ID NO: 16421 - DNA, 22 bp, Artificial Sequence
  Artificial sequence related to HLA knockouts in cell therapy
cccatgtccaccatgaccctct

SEQ ID NO: 16422 - DNA, 22 bp, Artificial Sequence
  Artificial sequence related to HLA knockouts in cell therapy
ccatgtccaccatgaccctctt

SEQ ID NO: 16423 - DNA, 22 bp, Artificial Sequence
  Artificial sequence related to HLA knockouts in cell therapy
catgtccaccatgaccctcttc

SEQ ID NO: 16424 - DNA, 22 bp, Artificial Sequence
  Artificial sequence related to HLA knockouts in cell therapy
atgtccaccatgaccctcttcc

SEQ ID NO: 16425 - DNA, 22 bp, Artificial Sequence
  Artificial sequence related to HLA knockouts in cell therapy
tgtccaccatgaccctcttccc

SEQ ID NO: 16426 - DNA, 22 bp, Artificial Sequence
  Artificial sequence related to HLA knockouts in cell therapy
gtccaccatgaccctcttccca

SEQ ID NO: 16427 - DNA, 22 bp, Artificial Sequence
  Artificial sequence related to HLA knockouts in cell therapy
tccaccatgaccctcttcccac

SEQ ID NO: 16428 - DNA, 22 bp, Artificial Sequence
  Artificial sequence related to HLA knockouts in cell therapy
accatgaccctcttcccacgct

SEQ ID NO: 16429 - DNA, 22 bp, Artificial Sequence
  Artificial sequence related to HLA knockouts in cell therapy
catgaccctcttcccacgctga

SEQ ID NO: 16430 - DNA, 22 bp, Artificial Sequence
  Artificial sequence related to HLA knockouts in cell therapy
atgaccctcttcccacgctgac

SEQ ID NO: 16431 - DNA, 22 bp, Artificial Sequence
  Artificial sequence related to HLA knockouts in cell therapy
tcttcccacgctgacctgtgct

SEQ ID NO: 16432 - DNA, 22 bp, Artificial Sequence
  Artificial sequence related to HLA knockouts in cell therapy
cccaatcatctttcctgttcca

SEQ ID NO: 16433 - DNA, 22 bp, Artificial Sequence
  Artificial sequence related to HLA knockouts in cell therapy
ccaatcatctttcctgttccag

SEQ ID NO: 16434 - DNA, 22 bp, Artificial Sequence
  Artificial sequence related to HLA knockouts in cell therapy
caatcatctttcctgttccaga

SEQ ID NO: 16435 - DNA, 22 bp, Artificial Sequence
  Artificial sequence related to HLA knockouts in cell therapy
aatcatctttcctgttccagag

SEQ ID NO: 16436 - DNA, 22 bp, Artificial Sequence
  Artificial sequence related to HLA knockouts in cell therapy
atcatctttcctgttccagaga

SEQ ID NO: 16437 - DNA, 22 bp, Artificial Sequence
  Artificial sequence related to HLA knockouts in cell therapy
tcatctttcctgttccagagag

SEQ ID NO: 16438 - DNA, 22 bp, Artificial Sequence
  Artificial sequence related to HLA knockouts in cell therapy
catctttcctgttccagagagg

SEQ ID NO: 16439 - DNA, 22 bp, Artificial Sequence
  Artificial sequence related to HLA knockouts in cell therapy
atctttcctgttccagagaggt

SEQ ID NO: 16440 - DNA, 22 bp, Artificial Sequence
  Artificial sequence related to HLA knockouts in cell therapy
tctttcctgttccagagaggtg

SEQ ID NO: 16441 - DNA, 22 bp, Artificial Sequence
  Artificial sequence related to HLA knockouts in cell therapy
ctttcctgttccagagaggtgg

SEQ ID NO: 16442 - DNA, 22 bp, Artificial Sequence
  Artificial sequence related to HLA knockouts in cell therapy
tttcctgttccagagaggtggg

SEQ ID NO: 16443 - DNA, 22 bp, Artificial Sequence
  Artificial sequence related to HLA knockouts in cell therapy
gggctgaggtgtctccatctct

SEQ ID NO: 16444 - DNA, 22 bp, Artificial Sequence
  Artificial sequence related to HLA knockouts in cell therapy
ggctgaggtgtctccatctctg

SEQ ID NO: 16445 - DNA, 22 bp, Artificial Sequence
  Artificial sequence related to HLA knockouts in cell therapy
gctgaggtgtctccatctctgt

SEQ ID NO: 16446 - DNA, 22 bp, Artificial Sequence
  Artificial sequence related to HLA knockouts in cell therapy
ctgaggtgtctccatctctgtc

SEQ ID NO: 16447 - DNA, 22 bp, Artificial Sequence
  Artificial sequence related to HLA knockouts in cell therapy
tgaggtgtctccatctctgtct

SEQ ID NO: 16448 - DNA, 22 bp, Artificial Sequence
  Artificial sequence related to HLA knockouts in cell therapy
gaggtgtctccatctctgtctc

SEQ ID NO: 16449 - DNA, 22 bp, Artificial Sequence
  Artificial sequence related to HLA knockouts in cell therapy
aggtgtctccatctctgtctca

SEQ ID NO: 16450 - DNA, 22 bp, Artificial Sequence
  Artificial sequence related to HLA knockouts in cell therapy
ggtgtctccatctctgtctcaa

SEQ ID NO: 16451 - DNA, 22 bp, Artificial Sequence
  Artificial sequence related to HLA knockouts in cell therapy
gtgtctccatctctgtctcaac

SEQ ID NO: 16452 - DNA, 22 bp, Artificial Sequence
  Artificial sequence related to HLA knockouts in cell therapy
tgtctccatctctgtctcaact

SEQ ID NO: 16453 - DNA, 22 bp, Artificial Sequence
  Artificial sequence related to HLA knockouts in cell therapy
gtctccatctctgtctcaactt

SEQ ID NO: 16454 - DNA, 22 bp, Artificial Sequence
  Artificial sequence related to HLA knockouts in cell therapy
tctccatctctgtctcaacttc

SEQ ID NO: 16455 - DNA, 22 bp, Artificial Sequence
  Artificial sequence related to HLA knockouts in cell therapy
ctccatctctgtctcaacttca

SEQ ID NO: 16456 - DNA, 22 bp, Artificial Sequence
  Artificial sequence related to HLA knockouts in cell therapy
tccatctctgtctcaacttcat

SEQ ID NO: 16457 - DNA, 22 bp, Artificial Sequence
  Artificial sequence related to HLA knockouts in cell therapy
ccatctctgtctcaacttcatg

SEQ ID NO: 16458 - DNA, 22 bp, Artificial Sequence
  Artificial sequence related to HLA knockouts in cell therapy
catctctgtctcaacttcatgg

SEQ ID NO: 16459 - DNA, 22 bp, Artificial Sequence
  Artificial sequence related to HLA knockouts in cell therapy
atctctgtctcaacttcatggt

SEQ ID NO: 16460 - DNA, 22 bp, Artificial Sequence
  Artificial sequence related to HLA knockouts in cell therapy
tctctgtctcaacttcatggtg

SEQ ID NO: 16461 - DNA, 22 bp, Artificial Sequence
  Artificial sequence related to HLA knockouts in cell therapy
ctctgtctcaacttcatggtgc

SEQ ID NO: 16462 - DNA, 22 bp, Artificial Sequence
  Artificial sequence related to HLA knockouts in cell therapy
tctgtctcaacttcatggtgca

SEQ ID NO: 16463 - DNA, 22 bp, Artificial Sequence
  Artificial sequence related to HLA knockouts in cell therapy
ctgtctcaacttcatggtgcac

SEQ ID NO: 16464 - DNA, 22 bp, Artificial Sequence
  Artificial sequence related to HLA knockouts in cell therapy
tgtctcaacttcatggtgcact

SEQ ID NO: 16465 - DNA, 22 bp, Artificial Sequence
  Artificial sequence related to HLA knockouts in cell therapy
gtctcaacttcatggtgcactg

SEQ ID NO: 16466 - DNA, 22 bp, Artificial Sequence
  Artificial sequence related to HLA knockouts in cell therapy
tctcaacttcatggtgcactga

SEQ ID NO: 16467 - DNA, 22 bp, Artificial Sequence
  Artificial sequence related to HLA knockouts in cell therapy
ctcaacttcatggtgcactgag

SEQ ID NO: 16468 - DNA, 22 bp, Artificial Sequence
  Artificial sequence related to HLA knockouts in cell therapy
tcaacttcatggtgcactgagc

SEQ ID NO: 16469 - DNA, 22 bp, Artificial Sequence
  Artificial sequence related to HLA knockouts in cell therapy
caacttcatggtgcactgagct

SEQ ID NO: 16470 - DNA, 22 bp, Artificial Sequence
  Artificial sequence related to HLA knockouts in cell therapy
aacttcatggtgcactgagctg

SEQ ID NO: 16471 - DNA, 22 bp, Artificial Sequence
  Artificial sequence related to HLA knockouts in cell therapy
acttcatggtgcactgagctgt

SEQ ID NO: 16472 - DNA, 22 bp, Artificial Sequence
  Artificial sequence related to HLA knockouts in cell therapy
cttcatggtgcactgagctgta

SEQ ID NO: 16473 - DNA, 22 bp, Artificial Sequence
  Artificial sequence related to HLA knockouts in cell therapy
ttcatggtgcactgagctgtaa

SEQ ID NO: 16474 - DNA, 22 bp, Artificial Sequence
  Artificial sequence related to HLA knockouts in cell therapy
tcatggtgcactgagctgtaac

SEQ ID NO: 16475 - DNA, 22 bp, Artificial Sequence
  Artificial sequence related to HLA knockouts in cell therapy
catggtgcactgagctgtaact

SEQ ID NO: 16476 - DNA, 22 bp, Artificial Sequence
  Artificial sequence related to HLA knockouts in cell therapy
atggtgcactgagctgtaactt

SEQ ID NO: 16477 - DNA, 22 bp, Artificial Sequence
  Artificial sequence related to HLA knockouts in cell therapy
tggtgcactgagctgtaacttc

SEQ ID NO: 16478 - DNA, 22 bp, Artificial Sequence
  Artificial sequence related to HLA knockouts in cell therapy
ggtgcactgagctgtaacttct

SEQ ID NO: 16479 - DNA, 22 bp, Artificial Sequence
  Artificial sequence related to HLA knockouts in cell therapy
gtgcactgagctgtaacttctt

SEQ ID NO: 16480 - DNA, 22 bp, Artificial Sequence
  Artificial sequence related to HLA knockouts in cell therapy
tgcactgagctgtaacttcttc

SEQ ID NO: 16481 - DNA, 22 bp, Artificial Sequence
  Artificial sequence related to HLA knockouts in cell therapy
gcactgagctgtaacttcttcc

SEQ ID NO: 16482 - DNA, 22 bp, Artificial Sequence
  Artificial sequence related to HLA knockouts in cell therapy
cactgagctgtaacttcttcct

SEQ ID NO: 16483 - DNA, 22 bp, Artificial Sequence
  Artificial sequence related to HLA knockouts in cell therapy
actgagctgtaacttcttcctt

SEQ ID NO: 16484 - DNA, 22 bp, Artificial Sequence
  Artificial sequence related to HLA knockouts in cell therapy
ctgagctgtaacttcttccttc

SEQ ID NO: 16485 - DNA, 22 bp, Artificial Sequence
  Artificial sequence related to HLA knockouts in cell therapy
tgagctgtaacttcttccttcc

SEQ ID NO: 16486 - DNA, 22 bp, Artificial Sequence
  Artificial sequence related to HLA knockouts in cell therapy
gagctgtaacttcttccttccc

SEQ ID NO: 16487 - DNA, 22 bp, Artificial Sequence
  Artificial sequence related to HLA knockouts in cell therapy
agctgtaacttcttccttccct

SEQ ID NO: 16488 - DNA, 22 bp, Artificial Sequence
  Artificial sequence related to HLA knockouts in cell therapy
gctgtaacttcttccttcccta

SEQ ID NO: 16489 - DNA, 22 bp, Artificial Sequence
  Artificial sequence related to HLA knockouts in cell therapy
ctgtaacttcttccttccctat

SEQ ID NO: 16490 - DNA, 22 bp, Artificial Sequence
  Artificial sequence related to HLA knockouts in cell therapy
tgtaacttcttccttccctatt

SEQ ID NO: 16491 - DNA, 22 bp, Artificial Sequence
  Artificial sequence related to HLA knockouts in cell therapy
gtaacttcttccttccctatta

SEQ ID NO: 16492 - DNA, 22 bp, Artificial Sequence
  Artificial sequence related to HLA knockouts in cell therapy
taacttcttccttccctattaa

SEQ ID NO: 16493 - DNA, 22 bp, Artificial Sequence
  Artificial sequence related to HLA knockouts in cell therapy
aacttcttccttccctattaaa

SEQ ID NO: 16494 - DNA, 18 bp, Artificial Sequence
  Artificial sequence related to HLA knockouts in cell therapy
cggtgtatggattgggga

SEQ ID NO: 16495 - DNA, 18 bp, Artificial Sequence
  Artificial sequence related to HLA knockouts in cell therapy
ggtgtatggattggggag

SEQ ID NO: 16496 - DNA, 18 bp, Artificial Sequence
  Artificial sequence related to HLA knockouts in cell therapy
gtgtatggattggggagt

SEQ ID NO: 16497 - DNA, 18 bp, Artificial Sequence
  Artificial sequence related to HLA knockouts in cell therapy
tgtatggattggggagtc

SEQ ID NO: 16498 - DNA, 18 bp, Artificial Sequence
  Artificial sequence related to HLA knockouts in cell therapy
gtatggattggggagtcc

SEQ ID NO: 16499 - DNA, 18 bp, Artificial Sequence
  Artificial sequence related to HLA knockouts in cell therapy
tatggattggggagtccc

SEQ ID NO: 16500 - DNA, 18 bp, Artificial Sequence
  Artificial sequence related to HLA knockouts in cell therapy
atggattggggagtccca

SEQ ID NO: 16501 - DNA, 18 bp, Artificial Sequence
  Artificial sequence related to HLA knockouts in cell therapy
cttggggattccccaact

SEQ ID NO: 16502 - DNA, 18 bp, Artificial Sequence
  Artificial sequence related to HLA knockouts in cell therapy
ttggggattccccaactc

SEQ ID NO: 16503 - DNA, 18 bp, Artificial Sequence
  Artificial sequence related to HLA knockouts in cell therapy
attccccaactccgcagt

SEQ ID NO: 16504 - DNA, 18 bp, Artificial Sequence
  Artificial sequence related to HLA knockouts in cell therapy
ttccccaactccgcagtt

SEQ ID NO: 16505 - DNA, 18 bp, Artificial Sequence
  Artificial sequence related to HLA knockouts in cell therapy
tccccaactccgcagttt

SEQ ID NO: 16506 - DNA, 18 bp, Artificial Sequence
  Artificial sequence related to HLA knockouts in cell therapy
aactccgcagtttctttt

SEQ ID NO: 16507 - DNA, 18 bp, Artificial Sequence
  Artificial sequence related to HLA knockouts in cell therapy
actccgcagtttcttttc

SEQ ID NO: 16508 - DNA, 18 bp, Artificial Sequence
  Artificial sequence related to HLA knockouts in cell therapy
ctccgcagtttcttttct

SEQ ID NO: 16509 - DNA, 18 bp, Artificial Sequence
  Artificial sequence related to HLA knockouts in cell therapy
tccgcagtttcttttctc

SEQ ID NO: 16510 - DNA, 18 bp, Artificial Sequence
  Artificial sequence related to HLA knockouts in cell therapy
ccgcagtttcttttctcc

SEQ ID NO: 16511 - DNA, 18 bp, Artificial Sequence
  Artificial sequence related to HLA knockouts in cell therapy
cgcagtttcttttctccc

SEQ ID NO: 16512 - DNA, 18 bp, Artificial Sequence
  Artificial sequence related to HLA knockouts in cell therapy
gcagtttcttttctccct

SEQ ID NO: 16513 - DNA, 18 bp, Artificial Sequence
  Artificial sequence related to HLA knockouts in cell therapy
cagtttcttttctccctc

SEQ ID NO: 16514 - DNA, 18 bp, Artificial Sequence
  Artificial sequence related to HLA knockouts in cell therapy
agtttcttttctccctct

SEQ ID NO: 16515 - DNA, 18 bp, Artificial Sequence
  Artificial sequence related to HLA knockouts in cell therapy
gtttcttttctccctctc

SEQ ID NO: 16516 - DNA, 18 bp, Artificial Sequence
  Artificial sequence related to HLA knockouts in cell therapy
tttcttttctccctctcc

SEQ ID NO: 16517 - DNA, 18 bp, Artificial Sequence
  Artificial sequence related to HLA knockouts in cell therapy
ttcttttctccctctccc

SEQ ID NO: 16518 - DNA, 18 bp, Artificial Sequence
  Artificial sequence related to HLA knockouts in cell therapy
tcttttctccctctccca

SEQ ID NO: 16519 - DNA, 18 bp, Artificial Sequence
  Artificial sequence related to HLA knockouts in cell therapy
cttttctccctctcccaa

SEQ ID NO: 16520 - DNA, 18 bp, Artificial Sequence
  Artificial sequence related to HLA knockouts in cell therapy
ttttctccctctcccaac

SEQ ID NO: 16521 - DNA, 18 bp, Artificial Sequence
  Artificial sequence related to HLA knockouts in cell therapy
ggactcagattctcccca

SEQ ID NO: 16522 - DNA, 18 bp, Artificial Sequence
  Artificial sequence related to HLA knockouts in cell therapy
gactcagattctccccag

SEQ ID NO: 16523 - DNA, 18 bp, Artificial Sequence
  Artificial sequence related to HLA knockouts in cell therapy
actcagattctccccaga

SEQ ID NO: 16524 - DNA, 18 bp, Artificial Sequence
  Artificial sequence related to HLA knockouts in cell therapy
ctcagattctccccagac

SEQ ID NO: 16525 - DNA, 18 bp, Artificial Sequence
  Artificial sequence related to HLA knockouts in cell therapy
tcagattctccccagacg

SEQ ID NO: 16526 - DNA, 18 bp, Artificial Sequence
  Artificial sequence related to HLA knockouts in cell therapy
agtattgggacggggaga

SEQ ID NO: 16527 - DNA, 18 bp, Artificial Sequence
  Artificial sequence related to HLA knockouts in cell therapy
tattgggacggggagaca

SEQ ID NO: 16528 - DNA, 18 bp, Artificial Sequence
  Artificial sequence related to HLA knockouts in cell therapy
acgcccccaaaacgcata

SEQ ID NO: 16529 - DNA, 18 bp, Artificial Sequence
  Artificial sequence related to HLA knockouts in cell therapy
cgcccccaaaacgcatat

SEQ ID NO: 16530 - DNA, 18 bp, Artificial Sequence
  Artificial sequence related to HLA knockouts in cell therapy
gcccccaaaacgcatatg

SEQ ID NO: 16531 - DNA, 18 bp, Artificial Sequence
  Artificial sequence related to HLA knockouts in cell therapy
cccccaaaacgcatatga

SEQ ID NO: 16532 - DNA, 18 bp, Artificial Sequence
  Artificial sequence related to HLA knockouts in cell therapy
ccccaaaacgcatatgac

SEQ ID NO: 16533 - DNA, 18 bp, Artificial Sequence
  Artificial sequence related to HLA knockouts in cell therapy
cccaaaacgcatatgact

SEQ ID NO: 16534 - DNA, 18 bp, Artificial Sequence
  Artificial sequence related to HLA knockouts in cell therapy
ccaaaacgcatatgactc

SEQ ID NO: 16535 - DNA, 18 bp, Artificial Sequence
  Artificial sequence related to HLA knockouts in cell therapy
caaaacgcatatgactca

SEQ ID NO: 16536 - DNA, 18 bp, Artificial Sequence
  Artificial sequence related to HLA knockouts in cell therapy
aaaacgcatatgactcac

SEQ ID NO: 16537 - DNA, 18 bp, Artificial Sequence
  Artificial sequence related to HLA knockouts in cell therapy
tgcaggggatggaacctt

SEQ ID NO: 16538 - DNA, 18 bp, Artificial Sequence
  Artificial sequence related to HLA knockouts in cell therapy
aggggatggaaccttcca

SEQ ID NO: 16539 - DNA, 18 bp, Artificial Sequence
  Artificial sequence related to HLA knockouts in cell therapy
aagagctcagatagaaaa

SEQ ID NO: 16540 - DNA, 18 bp, Artificial Sequence
  Artificial sequence related to HLA knockouts in cell therapy
agagctcagatagaaaag

SEQ ID NO: 16541 - DNA, 18 bp, Artificial Sequence
  Artificial sequence related to HLA knockouts in cell therapy
gagctcagatagaaaagg

SEQ ID NO: 16542 - DNA, 18 bp, Artificial Sequence
  Artificial sequence related to HLA knockouts in cell therapy
agctcagatagaaaagga

SEQ ID NO: 16543 - DNA, 18 bp, Artificial Sequence
  Artificial sequence related to HLA knockouts in cell therapy
gctcagatagaaaaggag

SEQ ID NO: 16544 - DNA, 18 bp, Artificial Sequence
  Artificial sequence related to HLA knockouts in cell therapy
ctcagatagaaaaggagg

SEQ ID NO: 16545 - DNA, 18 bp, Artificial Sequence
  Artificial sequence related to HLA knockouts in cell therapy
tcagatagaaaaggaggg

SEQ ID NO: 16546 - DNA, 18 bp, Artificial Sequence
  Artificial sequence related to HLA knockouts in cell therapy
cagatagaaaaggaggga

SEQ ID NO: 16547 - DNA, 18 bp, Artificial Sequence
  Artificial sequence related to HLA knockouts in cell therapy
agatagaaaaggagggag

SEQ ID NO: 16548 - DNA, 18 bp, Artificial Sequence
  Artificial sequence related to HLA knockouts in cell therapy
gatagaaaaggagggagc

SEQ ID NO: 16549 - DNA, 18 bp, Artificial Sequence
  Artificial sequence related to HLA knockouts in cell therapy
atagaaaaggagggagct

SEQ ID NO: 16550 - DNA, 18 bp, Artificial Sequence
  Artificial sequence related to HLA knockouts in cell therapy
tagaaaaggagggagcta

SEQ ID NO: 16551 - DNA, 18 bp, Artificial Sequence
  Artificial sequence related to HLA knockouts in cell therapy
agaaaaggagggagctac

SEQ ID NO: 16552 - DNA, 18 bp, Artificial Sequence
  Artificial sequence related to HLA knockouts in cell therapy
gaaaaggagggagctact

SEQ ID NO: 16553 - DNA, 18 bp, Artificial Sequence
  Artificial sequence related to HLA knockouts in cell therapy
aaaaggagggagctactc

SEQ ID NO: 16554 - DNA, 18 bp, Artificial Sequence
  Artificial sequence related to HLA knockouts in cell therapy
taatgtgaggaggtgggg

SEQ ID NO: 16555 - DNA, 18 bp, Artificial Sequence
  Artificial sequence related to HLA knockouts in cell therapy
aatgtgaggaggtgggga

SEQ ID NO: 16556 - DNA, 18 bp, Artificial Sequence
  Artificial sequence related to HLA knockouts in cell therapy
tgctccctccccaatcat

SEQ ID NO: 16557 - DNA, 18 bp, Artificial Sequence
  Artificial sequence related to HLA knockouts in cell therapy
ctccctccccaatcatct

SEQ ID NO: 16558 - DNA, 18 bp, Artificial Sequence
  Artificial sequence related to HLA knockouts in cell therapy
tccctccccaatcatctt

SEQ ID NO: 16559 - DNA, 18 bp, Artificial Sequence
  Artificial sequence related to HLA knockouts in cell therapy
ccctccccaatcatcttt

SEQ ID NO: 16560 - DNA, 18 bp, Artificial Sequence
  Artificial sequence related to HLA knockouts in cell therapy
cctccccaatcatctttc

SEQ ID NO: 16561 - DNA, 18 bp, Artificial Sequence
  Artificial sequence related to HLA knockouts in cell therapy
ctccccaatcatctttcc

SEQ ID NO: 16562 - DNA, 18 bp, Artificial Sequence
  Artificial sequence related to HLA knockouts in cell therapy
tccccaatcatctttcct

SEQ ID NO: 16563 - DNA, 18 bp, Artificial Sequence
  Artificial sequence related to HLA knockouts in cell therapy
ccccaatcatctttcctg

SEQ ID NO: 16564 - DNA, 18 bp, Artificial Sequence
  Artificial sequence related to HLA knockouts in cell therapy
cttccttccctattaaaa

SEQ ID NO: 16565 - DNA, 19 bp, Artificial Sequence
  Artificial sequence related to HLA knockouts in cell therapy
gcggtgtatggattgggga

SEQ ID NO: 16566 - DNA, 19 bp, Artificial Sequence
  Artificial sequence related to HLA knockouts in cell therapy
cggtgtatggattggggag

SEQ ID NO: 16567 - DNA, 19 bp, Artificial Sequence
  Artificial sequence related to HLA knockouts in cell therapy
ggtgtatggattggggagt

SEQ ID NO: 16568 - DNA, 19 bp, Artificial Sequence
  Artificial sequence related to HLA knockouts in cell therapy
gtgtatggattggggagtc

SEQ ID NO: 16569 - DNA, 19 bp, Artificial Sequence
  Artificial sequence related to HLA knockouts in cell therapy
tgtatggattggggagtcc

SEQ ID NO: 16570 - DNA, 19 bp, Artificial Sequence
  Artificial sequence related to HLA knockouts in cell therapy
gtatggattggggagtccc

SEQ ID NO: 16571 - DNA, 19 bp, Artificial Sequence
  Artificial sequence related to HLA knockouts in cell therapy
tatggattggggagtccca

SEQ ID NO: 16572 - DNA, 19 bp, Artificial Sequence
  Artificial sequence related to HLA knockouts in cell therapy
atggattggggagtcccag

SEQ ID NO: 16573 - DNA, 19 bp, Artificial Sequence
  Artificial sequence related to HLA knockouts in cell therapy
attggggagtcccagcctt

SEQ ID NO: 16574 - DNA, 19 bp, Artificial Sequence
  Artificial sequence related to HLA knockouts in cell therapy
agtcccagccttggggatt

SEQ ID NO: 16575 - DNA, 19 bp, Artificial Sequence
  Artificial sequence related to HLA knockouts in cell therapy
agccttggggattccccaa

SEQ ID NO: 16576 - DNA, 19 bp, Artificial Sequence
  Artificial sequence related to HLA knockouts in cell therapy
ccttggggattccccaact

SEQ ID NO: 16577 - DNA, 19 bp, Artificial Sequence
  Artificial sequence related to HLA knockouts in cell therapy
cttggggattccccaactc

SEQ ID NO: 16578 - DNA, 19 bp, Artificial Sequence
  Artificial sequence related to HLA knockouts in cell therapy
ttggggattccccaactcc

SEQ ID NO: 16579 - DNA, 19 bp, Artificial Sequence
  Artificial sequence related to HLA knockouts in cell therapy
gattccccaactccgcagt

SEQ ID NO: 16580 - DNA, 19 bp, Artificial Sequence
  Artificial sequence related to HLA knockouts in cell therapy
attccccaactccgcagtt

SEQ ID NO: 16581 - DNA, 19 bp, Artificial Sequence
  Artificial sequence related to HLA knockouts in cell therapy
ttccccaactccgcagttt

SEQ ID NO: 16582 - DNA, 19 bp, Artificial Sequence
  Artificial sequence related to HLA knockouts in cell therapy
tccccaactccgcagtttc

SEQ ID NO: 16583 - DNA, 19 bp, Artificial Sequence
  Artificial sequence related to HLA knockouts in cell therapy
ccccaactccgcagtttct

SEQ ID NO: 16584 - DNA, 19 bp, Artificial Sequence
  Artificial sequence related to HLA knockouts in cell therapy
caactccgcagtttctttt

SEQ ID NO: 16585 - DNA, 19 bp, Artificial Sequence
  Artificial sequence related to HLA knockouts in cell therapy
aactccgcagtttcttttc

SEQ ID NO: 16586 - DNA, 19 bp, Artificial Sequence
  Artificial sequence related to HLA knockouts in cell therapy
actccgcagtttcttttct

SEQ ID NO: 16587 - DNA, 19 bp, Artificial Sequence
  Artificial sequence related to HLA knockouts in cell therapy
ctccgcagtttcttttctc

SEQ ID NO: 16588 - DNA, 19 bp, Artificial Sequence
  Artificial sequence related to HLA knockouts in cell therapy
tccgcagtttcttttctcc

SEQ ID NO: 16589 - DNA, 19 bp, Artificial Sequence
  Artificial sequence related to HLA knockouts in cell therapy
ccgcagtttcttttctccc

SEQ ID NO: 16590 - DNA, 19 bp, Artificial Sequence
  Artificial sequence related to HLA knockouts in cell therapy
cgcagtttcttttctccct

SEQ ID NO: 16591 - DNA, 19 bp, Artificial Sequence
  Artificial sequence related to HLA knockouts in cell therapy
gcagtttcttttctccctc

SEQ ID NO: 16592 - DNA, 19 bp, Artificial Sequence
  Artificial sequence related to HLA knockouts in cell therapy
cagtttcttttctccctct

SEQ ID NO: 16593 - DNA, 19 bp, Artificial Sequence
  Artificial sequence related to HLA knockouts in cell therapy
agtttcttttctccctctc

SEQ ID NO: 16594 - DNA, 19 bp, Artificial Sequence
  Artificial sequence related to HLA knockouts in cell therapy
gtttcttttctccctctcc

SEQ ID NO: 16595 - DNA, 19 bp, Artificial Sequence
  Artificial sequence related to HLA knockouts in cell therapy
tttcttttctccctctccc

SEQ ID NO: 16596 - DNA, 19 bp, Artificial Sequence
  Artificial sequence related to HLA knockouts in cell therapy
ttcttttctccctctccca

SEQ ID NO: 16597 - DNA, 19 bp, Artificial Sequence
  Artificial sequence related to HLA knockouts in cell therapy
tcttttctccctctcccaa

SEQ ID NO: 16598 - DNA, 19 bp, Artificial Sequence
  Artificial sequence related to HLA knockouts in cell therapy
cttttctccctctcccaac

SEQ ID NO: 16599 - DNA, 19 bp, Artificial Sequence
  Artificial sequence related to HLA knockouts in cell therapy
ttttctccctctcccaacc

SEQ ID NO: 16600 - DNA, 19 bp, Artificial Sequence
  Artificial sequence related to HLA knockouts in cell therapy
gggactcagattctcccca

SEQ ID NO: 16601 - DNA, 19 bp, Artificial Sequence
  Artificial sequence related to HLA knockouts in cell therapy
ggactcagattctccccag

SEQ ID NO: 16602 - DNA, 19 bp, Artificial Sequence
  Artificial sequence related to HLA knockouts in cell therapy
gactcagattctccccaga

SEQ ID NO: 16603 - DNA, 19 bp, Artificial Sequence
  Artificial sequence related to HLA knockouts in cell therapy
actcagattctccccagac

SEQ ID NO: 16604 - DNA, 19 bp, Artificial Sequence
  Artificial sequence related to HLA knockouts in cell therapy
ctcagattctccccagacg

SEQ ID NO: 16605 - DNA, 19 bp, Artificial Sequence
  Artificial sequence related to HLA knockouts in cell therapy
tcagattctccccagacgc

SEQ ID NO: 16606 - DNA, 19 bp, Artificial Sequence
  Artificial sequence related to HLA knockouts in cell therapy
gagtattgggacggggaga

SEQ ID NO: 16607 - DNA, 19 bp, Artificial Sequence
  Artificial sequence related to HLA knockouts in cell therapy
agtattgggacggggagac

SEQ ID NO: 16608 - DNA, 19 bp, Artificial Sequence
  Artificial sequence related to HLA knockouts in cell therapy
gtattgggacggggagaca

SEQ ID NO: 16609 - DNA, 19 bp, Artificial Sequence
  Artificial sequence related to HLA knockouts in cell therapy
tattgggacggggagacac

SEQ ID NO: 16610 - DNA, 19 bp, Artificial Sequence
  Artificial sequence related to HLA knockouts in cell therapy
acggggagacacggaaagt

SEQ ID NO: 16611 - DNA, 19 bp, Artificial Sequence
  Artificial sequence related to HLA knockouts in cell therapy
ggggagacacggaaagtga

SEQ ID NO: 16612 - DNA, 19 bp, Artificial Sequence
  Artificial sequence related to HLA knockouts in cell therapy
tgcgcggctactacaacca

SEQ ID NO: 16613 - DNA, 19 bp, Artificial Sequence
  Artificial sequence related to HLA knockouts in cell therapy
gacgcccccaaaacgcata

SEQ ID NO: 16614 - DNA, 19 bp, Artificial Sequence
  Artificial sequence related to HLA knockouts in cell therapy
acgcccccaaaacgcatat

SEQ ID NO: 16615 - DNA, 19 bp, Artificial Sequence
  Artificial sequence related to HLA knockouts in cell therapy
cgcccccaaaacgcatatg

SEQ ID NO: 16616 - DNA, 19 bp, Artificial Sequence
  Artificial sequence related to HLA knockouts in cell therapy
gcccccaaaacgcatatga

SEQ ID NO: 16617 - DNA, 19 bp, Artificial Sequence
  Artificial sequence related to HLA knockouts in cell therapy
cccccaaaacgcatatgac

SEQ ID NO: 16618 - DNA, 19 bp, Artificial Sequence
  Artificial sequence related to HLA knockouts in cell therapy
ccccaaaacgcatatgact

SEQ ID NO: 16619 - DNA, 19 bp, Artificial Sequence
  Artificial sequence related to HLA knockouts in cell therapy
cccaaaacgcatatgactc

SEQ ID NO: 16620 - DNA, 19 bp, Artificial Sequence
  Artificial sequence related to HLA knockouts in cell therapy
ccaaaacgcatatgactca

SEQ ID NO: 16621 - DNA, 19 bp, Artificial Sequence
  Artificial sequence related to HLA knockouts in cell therapy
caaaacgcatatgactcac

SEQ ID NO: 16622 - DNA, 19 bp, Artificial Sequence
  Artificial sequence related to HLA knockouts in cell therapy
aaaacgcatatgactcacc

SEQ ID NO: 16623 - DNA, 19 bp, Artificial Sequence
  Artificial sequence related to HLA knockouts in cell therapy
ctgcaggggatggaacctt

SEQ ID NO: 16624 - DNA, 19 bp, Artificial Sequence
  Artificial sequence related to HLA knockouts in cell therapy
tgcaggggatggaaccttc

SEQ ID NO: 16625 - DNA, 19 bp, Artificial Sequence
  Artificial sequence related to HLA knockouts in cell therapy
caggggatggaaccttcca

SEQ ID NO: 16626 - DNA, 19 bp, Artificial Sequence
  Artificial sequence related to HLA knockouts in cell therapy
aggggatggaaccttccag

SEQ ID NO: 16627 - DNA, 19 bp, Artificial Sequence
  Artificial sequence related to HLA knockouts in cell therapy
ggggatggaaccttccaga

SEQ ID NO: 16628 - DNA, 19 bp, Artificial Sequence
  Artificial sequence related to HLA knockouts in cell therapy
aagcccctcaccctgagat

SEQ ID NO: 16629 - DNA, 19 bp, Artificial Sequence
  Artificial sequence related to HLA knockouts in cell therapy
atccccatcgtgggcatca

SEQ ID NO: 16630 - DNA, 19 bp, Artificial Sequence
  Artificial sequence related to HLA knockouts in cell therapy
tccccatcgtgggcatcat

SEQ ID NO: 16631 - DNA, 19 bp, Artificial Sequence
  Artificial sequence related to HLA knockouts in cell therapy
ccccatcgtgggcatcatt

SEQ ID NO: 16632 - DNA, 19 bp, Artificial Sequence
  Artificial sequence related to HLA knockouts in cell therapy
gaagagctcagatagaaaa

SEQ ID NO: 16633 - DNA, 19 bp, Artificial Sequence
  Artificial sequence related to HLA knockouts in cell therapy
aagagctcagatagaaaag

SEQ ID NO: 16634 - DNA, 19 bp, Artificial Sequence
  Artificial sequence related to HLA knockouts in cell therapy
agagctcagatagaaaagg

SEQ ID NO: 16635 - DNA, 19 bp, Artificial Sequence
  Artificial sequence related to HLA knockouts in cell therapy
gagctcagatagaaaagga

SEQ ID NO: 16636 - DNA, 19 bp, Artificial Sequence
  Artificial sequence related to HLA knockouts in cell therapy
agctcagatagaaaaggag

SEQ ID NO: 16637 - DNA, 19 bp, Artificial Sequence
  Artificial sequence related to HLA knockouts in cell therapy
gctcagatagaaaaggagg

SEQ ID NO: 16638 - DNA, 19 bp, Artificial Sequence
  Artificial sequence related to HLA knockouts in cell therapy
ctcagatagaaaaggaggg

SEQ ID NO: 16639 - DNA, 19 bp, Artificial Sequence
  Artificial sequence related to HLA knockouts in cell therapy
tcagatagaaaaggaggga

SEQ ID NO: 16640 - DNA, 19 bp, Artificial Sequence
  Artificial sequence related to HLA knockouts in cell therapy
cagatagaaaaggagggag

SEQ ID NO: 16641 - DNA, 19 bp, Artificial Sequence
  Artificial sequence related to HLA knockouts in cell therapy
agatagaaaaggagggagc

SEQ ID NO: 16642 - DNA, 19 bp, Artificial Sequence
  Artificial sequence related to HLA knockouts in cell therapy
gatagaaaaggagggagct

SEQ ID NO: 16643 - DNA, 19 bp, Artificial Sequence
  Artificial sequence related to HLA knockouts in cell therapy
atagaaaaggagggagcta

SEQ ID NO: 16644 - DNA, 19 bp, Artificial Sequence
  Artificial sequence related to HLA knockouts in cell therapy
tagaaaaggagggagctac

SEQ ID NO: 16645 - DNA, 19 bp, Artificial Sequence
  Artificial sequence related to HLA knockouts in cell therapy
agaaaaggagggagctact

SEQ ID NO: 16646 - DNA, 19 bp, Artificial Sequence
  Artificial sequence related to HLA knockouts in cell therapy
gaaaaggagggagctactc

SEQ ID NO: 16647 - DNA, 19 bp, Artificial Sequence
  Artificial sequence related to HLA knockouts in cell therapy
aaaaggagggagctactct

SEQ ID NO: 16648 - DNA, 19 bp, Artificial Sequence
  Artificial sequence related to HLA knockouts in cell therapy
ataatgtgaggaggtgggg

SEQ ID NO: 16649 - DNA, 19 bp, Artificial Sequence
  Artificial sequence related to HLA knockouts in cell therapy
taatgtgaggaggtgggga

SEQ ID NO: 16650 - DNA, 19 bp, Artificial Sequence
  Artificial sequence related to HLA knockouts in cell therapy
aatgtgaggaggtggggag

SEQ ID NO: 16651 - DNA, 19 bp, Artificial Sequence
  Artificial sequence related to HLA knockouts in cell therapy
atgtgaggaggtggggaga

SEQ ID NO: 16652 - DNA, 19 bp, Artificial Sequence
  Artificial sequence related to HLA knockouts in cell therapy
acccccatgtccaccatga

SEQ ID NO: 16653 - DNA, 19 bp, Artificial Sequence
  Artificial sequence related to HLA knockouts in cell therapy
tgtgctccctccccaatca

SEQ ID NO: 16654 - DNA, 19 bp, Artificial Sequence
  Artificial sequence related to HLA knockouts in cell therapy
gtgctccctccccaatcat

SEQ ID NO: 16655 - DNA, 19 bp, Artificial Sequence
  Artificial sequence related to HLA knockouts in cell therapy
tgctccctccccaatcatc

SEQ ID NO: 16656 - DNA, 19 bp, Artificial Sequence
  Artificial sequence related to HLA knockouts in cell therapy
gctccctccccaatcatct

SEQ ID NO: 16657 - DNA, 19 bp, Artificial Sequence
  Artificial sequence related to HLA knockouts in cell therapy
ctccctccccaatcatctt

SEQ ID NO: 16658 - DNA, 19 bp, Artificial Sequence
  Artificial sequence related to HLA knockouts in cell therapy
tccctccccaatcatcttt

SEQ ID NO: 16659 - DNA, 19 bp, Artificial Sequence
  Artificial sequence related to HLA knockouts in cell therapy
ccctccccaatcatctttc

SEQ ID NO: 16660 - DNA, 19 bp, Artificial Sequence
  Artificial sequence related to HLA knockouts in cell therapy
cctccccaatcatctttcc

SEQ ID NO: 16661 - DNA, 19 bp, Artificial Sequence
  Artificial sequence related to HLA knockouts in cell therapy
ctccccaatcatctttcct

SEQ ID NO: 16662 - DNA, 19 bp, Artificial Sequence
  Artificial sequence related to HLA knockouts in cell therapy
tccccaatcatctttcctg

SEQ ID NO: 16663 - DNA, 19 bp, Artificial Sequence
  Artificial sequence related to HLA knockouts in cell therapy
ccccaatcatctttcctgt

SEQ ID NO: 16664 - DNA, 19 bp, Artificial Sequence
  Artificial sequence related to HLA knockouts in cell therapy
tcttccttccctattaaaa

SEQ ID NO: 16665 - DNA, 20 bp, Artificial Sequence
  Artificial sequence related to HLA knockouts in cell therapy
cggtgtatggattggggagt

SEQ ID NO: 16666 - DNA, 20 bp, Artificial Sequence
  Artificial sequence related to HLA knockouts in cell therapy
ggtgtatggattggggagtc

SEQ ID NO: 16667 - DNA, 20 bp, Artificial Sequence
  Artificial sequence related to HLA knockouts in cell therapy
gtgtatggattggggagtcc

SEQ ID NO: 16668 - DNA, 20 bp, Artificial Sequence
  Artificial sequence related to HLA knockouts in cell therapy
tgtatggattggggagtccc

SEQ ID NO: 16669 - DNA, 20 bp, Artificial Sequence
  Artificial sequence related to HLA knockouts in cell therapy
gtatggattggggagtccca

SEQ ID NO: 16670 - DNA, 20 bp, Artificial Sequence
  Artificial sequence related to HLA knockouts in cell therapy
tatggattggggagtcccag

SEQ ID NO: 16671 - DNA, 20 bp, Artificial Sequence
  Artificial sequence related to HLA knockouts in cell therapy
gattccccaactccgcagtt

SEQ ID NO: 16672 - DNA, 20 bp, Artificial Sequence
  Artificial sequence related to HLA knockouts in cell therapy
attccccaactccgcagttt

SEQ ID NO: 16673 - DNA, 20 bp, Artificial Sequence
  Artificial sequence related to HLA knockouts in cell therapy
ttccccaactccgcagtttc

SEQ ID NO: 16674 - DNA, 20 bp, Artificial Sequence
  Artificial sequence related to HLA knockouts in cell therapy
tccccaactccgcagtttct

SEQ ID NO: 16675 - DNA, 20 bp, Artificial Sequence
  Artificial sequence related to HLA knockouts in cell therapy
ccccaactccgcagtttctt

SEQ ID NO: 16676 - DNA, 20 bp, Artificial Sequence
  Artificial sequence related to HLA knockouts in cell therapy
ccaactccgcagtttctttt

SEQ ID NO: 16677 - DNA, 20 bp, Artificial Sequence
  Artificial sequence related to HLA knockouts in cell therapy
caactccgcagtttcttttc

SEQ ID NO: 16678 - DNA, 20 bp, Artificial Sequence
  Artificial sequence related to HLA knockouts in cell therapy
aactccgcagtttcttttct

SEQ ID NO: 16679 - DNA, 20 bp, Artificial Sequence
  Artificial sequence related to HLA knockouts in cell therapy
actccgcagtttcttttctc

SEQ ID NO: 16680 - DNA, 20 bp, Artificial Sequence
  Artificial sequence related to HLA knockouts in cell therapy
ctccgcagtttcttttctcc

SEQ ID NO: 16681 - DNA, 20 bp, Artificial Sequence
  Artificial sequence related to HLA knockouts in cell therapy
tccgcagtttcttttctccc

SEQ ID NO: 16682 - DNA, 20 bp, Artificial Sequence
  Artificial sequence related to HLA knockouts in cell therapy
ccgcagtttcttttctccct

SEQ ID NO: 16683 - DNA, 20 bp, Artificial Sequence
  Artificial sequence related to HLA knockouts in cell therapy
cgcagtttcttttctccctc

SEQ ID NO: 16684 - DNA, 20 bp, Artificial Sequence
  Artificial sequence related to HLA knockouts in cell therapy
gcagtttcttttctccctct

SEQ ID NO: 16685 - DNA, 20 bp, Artificial Sequence
  Artificial sequence related to HLA knockouts in cell therapy
cagtttcttttctccctctc

SEQ ID NO: 16686 - DNA, 20 bp, Artificial Sequence
  Artificial sequence related to HLA knockouts in cell therapy
agtttcttttctccctctcc

SEQ ID NO: 16687 - DNA, 20 bp, Artificial Sequence
  Artificial sequence related to HLA knockouts in cell therapy
gtttcttttctccctctccc

SEQ ID NO: 16688 - DNA, 20 bp, Artificial Sequence
  Artificial sequence related to HLA knockouts in cell therapy
tttcttttctccctctccca

SEQ ID NO: 16689 - DNA, 20 bp, Artificial Sequence
  Artificial sequence related to HLA knockouts in cell therapy
ttcttttctccctctcccaa

SEQ ID NO: 16690 - DNA, 20 bp, Artificial Sequence
  Artificial sequence related to HLA knockouts in cell therapy
tcttttctccctctcccaac

SEQ ID NO: 16691 - DNA, 20 bp, Artificial Sequence
  Artificial sequence related to HLA knockouts in cell therapy
cttttctccctctcccaacc

SEQ ID NO: 16692 - DNA, 20 bp, Artificial Sequence
  Artificial sequence related to HLA knockouts in cell therapy
ttttctccctctcccaacct

SEQ ID NO: 16693 - DNA, 20 bp, Artificial Sequence
  Artificial sequence related to HLA knockouts in cell therapy
ggactcagattctccccaga

SEQ ID NO: 16694 - DNA, 20 bp, Artificial Sequence
  Artificial sequence related to HLA knockouts in cell therapy
gactcagattctccccagac

SEQ ID NO: 16695 - DNA, 20 bp, Artificial Sequence
  Artificial sequence related to HLA knockouts in cell therapy
actcagattctccccagacg

SEQ ID NO: 16696 - DNA, 20 bp, Artificial Sequence
  Artificial sequence related to HLA knockouts in cell therapy
agtattgggacggggagaca

SEQ ID NO: 16697 - DNA, 20 bp, Artificial Sequence
  Artificial sequence related to HLA knockouts in cell therapy
ggggagacacggaaagtgaa

SEQ ID NO: 16698 - DNA, 20 bp, Artificial Sequence
  Artificial sequence related to HLA knockouts in cell therapy
gacgcccccaaaacgcatat

SEQ ID NO: 16699 - DNA, 20 bp, Artificial Sequence
  Artificial sequence related to HLA knockouts in cell therapy
acgcccccaaaacgcatatg

SEQ ID NO: 16700 - DNA, 20 bp, Artificial Sequence
  Artificial sequence related to HLA knockouts in cell therapy
cgcccccaaaacgcatatga

SEQ ID NO: 16701 - DNA, 20 bp, Artificial Sequence
  Artificial sequence related to HLA knockouts in cell therapy
gcccccaaaacgcatatgac

SEQ ID NO: 16702 - DNA, 20 bp, Artificial Sequence
  Artificial sequence related to HLA knockouts in cell therapy
cccccaaaacgcatatgact

SEQ ID NO: 16703 - DNA, 20 bp, Artificial Sequence
  Artificial sequence related to HLA knockouts in cell therapy
ccccaaaacgcatatgactc

SEQ ID NO: 16704 - DNA, 20 bp, Artificial Sequence
  Artificial sequence related to HLA knockouts in cell therapy
cccaaaacgcatatgactca

SEQ ID NO: 16705 - DNA, 20 bp, Artificial Sequence
  Artificial sequence related to HLA knockouts in cell therapy
ccaaaacgcatatgactcac

SEQ ID NO: 16706 - DNA, 20 bp, Artificial Sequence
  Artificial sequence related to HLA knockouts in cell therapy
caaaacgcatatgactcacc

SEQ ID NO: 16707 - DNA, 20 bp, Artificial Sequence
  Artificial sequence related to HLA knockouts in cell therapy
aaaacgcatatgactcacca

SEQ ID NO: 16708 - DNA, 20 bp, Artificial Sequence
  Artificial sequence related to HLA knockouts in cell therapy
aggggatggaaccttccaga

SEQ ID NO: 16709 - DNA, 20 bp, Artificial Sequence
  Artificial sequence related to HLA knockouts in cell therapy
ggggatggaaccttccagaa

SEQ ID NO: 16710 - DNA, 20 bp, Artificial Sequence
  Artificial sequence related to HLA knockouts in cell therapy
atccccatcgtgggcatcat

SEQ ID NO: 16711 - DNA, 20 bp, Artificial Sequence
  Artificial sequence related to HLA knockouts in cell therapy
tccccatcgtgggcatcatt

SEQ ID NO: 16712 - DNA, 20 bp, Artificial Sequence
  Artificial sequence related to HLA knockouts in cell therapy
ggaagagctcagatagaaaa

SEQ ID NO: 16713 - DNA, 20 bp, Artificial Sequence
  Artificial sequence related to HLA knockouts in cell therapy
gaagagctcagatagaaaag

SEQ ID NO: 16714 - DNA, 20 bp, Artificial Sequence
  Artificial sequence related to HLA knockouts in cell therapy
aagagctcagatagaaaagg

SEQ ID NO: 16715 - DNA, 20 bp, Artificial Sequence
  Artificial sequence related to HLA knockouts in cell therapy
agagctcagatagaaaagga

SEQ ID NO: 16716 - DNA, 20 bp, Artificial Sequence
  Artificial sequence related to HLA knockouts in cell therapy
gagctcagatagaaaaggag

SEQ ID NO: 16717 - DNA, 20 bp, Artificial Sequence
  Artificial sequence related to HLA knockouts in cell therapy
agctcagatagaaaaggagg

SEQ ID NO: 16718 - DNA, 20 bp, Artificial Sequence
  Artificial sequence related to HLA knockouts in cell therapy
gctcagatagaaaaggaggg

SEQ ID NO: 16719 - DNA, 20 bp, Artificial Sequence
  Artificial sequence related to HLA knockouts in cell therapy
ctcagatagaaaaggaggga

SEQ ID NO: 16720 - DNA, 20 bp, Artificial Sequence
  Artificial sequence related to HLA knockouts in cell therapy
tcagatagaaaaggagggag

SEQ ID NO: 16721 - DNA, 20 bp, Artificial Sequence
  Artificial sequence related to HLA knockouts in cell therapy
cagatagaaaaggagggagc

SEQ ID NO: 16722 - DNA, 20 bp, Artificial Sequence
  Artificial sequence related to HLA knockouts in cell therapy
agatagaaaaggagggagct

SEQ ID NO: 16723 - DNA, 20 bp, Artificial Sequence
  Artificial sequence related to HLA knockouts in cell therapy
gatagaaaaggagggagcta

SEQ ID NO: 16724 - DNA, 20 bp, Artificial Sequence
  Artificial sequence related to HLA knockouts in cell therapy
atagaaaaggagggagctac

SEQ ID NO: 16725 - DNA, 20 bp, Artificial Sequence
  Artificial sequence related to HLA knockouts in cell therapy
tagaaaaggagggagctact

SEQ ID NO: 16726 - DNA, 20 bp, Artificial Sequence
  Artificial sequence related to HLA knockouts in cell therapy
agaaaaggagggagctactc

SEQ ID NO: 16727 - DNA, 20 bp, Artificial Sequence
  Artificial sequence related to HLA knockouts in cell therapy
gaaaaggagggagctactct

SEQ ID NO: 16728 - DNA, 20 bp, Artificial Sequence
  Artificial sequence related to HLA knockouts in cell therapy
aaaaggagggagctactctc

SEQ ID NO: 16729 - DNA, 20 bp, Artificial Sequence
  Artificial sequence related to HLA knockouts in cell therapy
cataatgtgaggaggtgggg

SEQ ID NO: 16730 - DNA, 20 bp, Artificial Sequence
  Artificial sequence related to HLA knockouts in cell therapy
ataatgtgaggaggtgggga

SEQ ID NO: 16731 - DNA, 20 bp, Artificial Sequence
  Artificial sequence related to HLA knockouts in cell therapy
taatgtgaggaggtggggag

SEQ ID NO: 16732 - DNA, 20 bp, Artificial Sequence
  Artificial sequence related to HLA knockouts in cell therapy
aatgtgaggaggtggggaga

SEQ ID NO: 16733 - DNA, 20 bp, Artificial Sequence
  Artificial sequence related to HLA knockouts in cell therapy
tgtgctccctccccaatcat

SEQ ID NO: 16734 - DNA, 20 bp, Artificial Sequence
  Artificial sequence related to HLA knockouts in cell therapy
tgctccctccccaatcatct

SEQ ID NO: 16735 - DNA, 20 bp, Artificial Sequence
  Artificial sequence related to HLA knockouts in cell therapy
gctccctccccaatcatctt

SEQ ID NO: 16736 - DNA, 20 bp, Artificial Sequence
  Artificial sequence related to HLA knockouts in cell therapy
ctccctccccaatcatcttt

SEQ ID NO: 16737 - DNA, 20 bp, Artificial Sequence
  Artificial sequence related to HLA knockouts in cell therapy
tccctccccaatcatctttc

SEQ ID NO: 16738 - DNA, 20 bp, Artificial Sequence
  Artificial sequence related to HLA knockouts in cell therapy
ccctccccaatcatctttcc

SEQ ID NO: 16739 - DNA, 20 bp, Artificial Sequence
  Artificial sequence related to HLA knockouts in cell therapy
cctccccaatcatctttcct

SEQ ID NO: 16740 - DNA, 20 bp, Artificial Sequence
  Artificial sequence related to HLA knockouts in cell therapy
ctccccaatcatctttcctg

SEQ ID NO: 16741 - DNA, 20 bp, Artificial Sequence
  Artificial sequence related to HLA knockouts in cell therapy
tccccaatcatctttcctgt

SEQ ID NO: 16742 - DNA, 20 bp, Artificial Sequence
  Artificial sequence related to HLA knockouts in cell therapy
ccccaatcatctttcctgtt

SEQ ID NO: 16743 - DNA, 21 bp, Artificial Sequence
  Artificial sequence related to HLA knockouts in cell therapy
aaggcggtgtatggattgggg

SEQ ID NO: 16744 - DNA, 21 bp, Artificial Sequence
  Artificial sequence related to HLA knockouts in cell therapy
aggcggtgtatggattgggga

SEQ ID NO: 16745 - DNA, 21 bp, Artificial Sequence
  Artificial sequence related to HLA knockouts in cell therapy
gcggtgtatggattggggagt

SEQ ID NO: 16746 - DNA, 21 bp, Artificial Sequence
  Artificial sequence related to HLA knockouts in cell therapy
cggtgtatggattggggagtc

SEQ ID NO: 16747 - DNA, 21 bp, Artificial Sequence
  Artificial sequence related to HLA knockouts in cell therapy
ggtgtatggattggggagtcc

SEQ ID NO: 16748 - DNA, 21 bp, Artificial Sequence
  Artificial sequence related to HLA knockouts in cell therapy
gtgtatggattggggagtccc

SEQ ID NO: 16749 - DNA, 21 bp, Artificial Sequence
  Artificial sequence related to HLA knockouts in cell therapy
tgtatggattggggagtccca

SEQ ID NO: 16750 - DNA, 21 bp, Artificial Sequence
  Artificial sequence related to HLA knockouts in cell therapy
gtatggattggggagtcccag

SEQ ID NO: 16751 - DNA, 21 bp, Artificial Sequence
  Artificial sequence related to HLA knockouts in cell therapy
tatggattggggagtcccagc

SEQ ID NO: 16752 - DNA, 21 bp, Artificial Sequence
  Artificial sequence related to HLA knockouts in cell therapy
agccttggggattccccaact

SEQ ID NO: 16753 - DNA, 21 bp, Artificial Sequence
  Artificial sequence related to HLA knockouts in cell therapy
ggattccccaactccgcagtt

SEQ ID NO: 16754 - DNA, 21 bp, Artificial Sequence
  Artificial sequence related to HLA knockouts in cell therapy
gattccccaactccgcagttt

SEQ ID NO: 16755 - DNA, 21 bp, Artificial Sequence
  Artificial sequence related to HLA knockouts in cell therapy
attccccaactccgcagtttc

SEQ ID NO: 16756 - DNA, 21 bp, Artificial Sequence
  Artificial sequence related to HLA knockouts in cell therapy
ttccccaactccgcagtttct

SEQ ID NO: 16757 - DNA, 21 bp, Artificial Sequence
  Artificial sequence related to HLA knockouts in cell therapy
tccccaactccgcagtttctt

SEQ ID NO: 16758 - DNA, 21 bp, Artificial Sequence
  Artificial sequence related to HLA knockouts in cell therapy
ccccaactccgcagtttcttt

SEQ ID NO: 16759 - DNA, 21 bp, Artificial Sequence
  Artificial sequence related to HLA knockouts in cell therapy
cccaactccgcagtttctttt

SEQ ID NO: 16760 - DNA, 21 bp, Artificial Sequence
  Artificial sequence related to HLA knockouts in cell therapy
ccaactccgcagtttcttttc

SEQ ID NO: 16761 - DNA, 21 bp, Artificial Sequence
  Artificial sequence related to HLA knockouts in cell therapy
caactccgcagtttcttttct

SEQ ID NO: 16762 - DNA, 21 bp, Artificial Sequence
  Artificial sequence related to HLA knockouts in cell therapy
aactccgcagtttcttttctc

SEQ ID NO: 16763 - DNA, 21 bp, Artificial Sequence
  Artificial sequence related to HLA knockouts in cell therapy
actccgcagtttcttttctcc

SEQ ID NO: 16764 - DNA, 21 bp, Artificial Sequence
  Artificial sequence related to HLA knockouts in cell therapy
ctccgcagtttcttttctccc

SEQ ID NO: 16765 - DNA, 21 bp, Artificial Sequence
  Artificial sequence related to HLA knockouts in cell therapy
tccgcagtttcttttctccct

SEQ ID NO: 16766 - DNA, 21 bp, Artificial Sequence
  Artificial sequence related to HLA knockouts in cell therapy
ccgcagtttcttttctccctc

SEQ ID NO: 16767 - DNA, 21 bp, Artificial Sequence
  Artificial sequence related to HLA knockouts in cell therapy
cgcagtttcttttctccctct

SEQ ID NO: 16768 - DNA, 21 bp, Artificial Sequence
  Artificial sequence related to HLA knockouts in cell therapy
gcagtttcttttctccctctc

SEQ ID NO: 16769 - DNA, 21 bp, Artificial Sequence
  Artificial sequence related to HLA knockouts in cell therapy
cagtttcttttctccctctcc

SEQ ID NO: 16770 - DNA, 21 bp, Artificial Sequence
  Artificial sequence related to HLA knockouts in cell therapy
agtttcttttctccctctccc

SEQ ID NO: 16771 - DNA, 21 bp, Artificial Sequence
  Artificial sequence related to HLA knockouts in cell therapy
gtttcttttctccctctccca

SEQ ID NO: 16772 - DNA, 21 bp, Artificial Sequence
  Artificial sequence related to HLA knockouts in cell therapy
tttcttttctccctctcccaa

SEQ ID NO: 16773 - DNA, 21 bp, Artificial Sequence
  Artificial sequence related to HLA knockouts in cell therapy
ttcttttctccctctcccaac

SEQ ID NO: 16774 - DNA, 21 bp, Artificial Sequence
  Artificial sequence related to HLA knockouts in cell therapy
tcttttctccctctcccaacc

SEQ ID NO: 16775 - DNA, 21 bp, Artificial Sequence
  Artificial sequence related to HLA knockouts in cell therapy
cttttctccctctcccaacct

SEQ ID NO: 16776 - DNA, 21 bp, Artificial Sequence
  Artificial sequence related to HLA knockouts in cell therapy
ttttctccctctcccaaccta

SEQ ID NO: 16777 - DNA, 21 bp, Artificial Sequence
  Artificial sequence related to HLA knockouts in cell therapy
gggactcagattctccccaga

SEQ ID NO: 16778 - DNA, 21 bp, Artificial Sequence
  Artificial sequence related to HLA knockouts in cell therapy
ggactcagattctccccagac

SEQ ID NO: 16779 - DNA, 21 bp, Artificial Sequence
  Artificial sequence related to HLA knockouts in cell therapy
gactcagattctccccagacg

SEQ ID NO: 16780 - DNA, 21 bp, Artificial Sequence
  Artificial sequence related to HLA knockouts in cell therapy
actcagattctccccagacgc

SEQ ID NO: 16781 - DNA, 21 bp, Artificial Sequence
  Artificial sequence related to HLA knockouts in cell therapy
gagtattgggacggggagaca

SEQ ID NO: 16782 - DNA, 21 bp, Artificial Sequence
  Artificial sequence related to HLA knockouts in cell therapy
agtattgggacggggagacac

SEQ ID NO: 16783 - DNA, 21 bp, Artificial Sequence
  Artificial sequence related to HLA knockouts in cell therapy
acggggagacacggaaagtga

SEQ ID NO: 16784 - DNA, 21 bp, Artificial Sequence
  Artificial sequence related to HLA knockouts in cell therapy
cggggagacacggaaagtgaa

SEQ ID NO: 16785 - DNA, 21 bp, Artificial Sequence
  Artificial sequence related to HLA knockouts in cell therapy
ggggagacacggaaagtgaag

SEQ ID NO: 16786 - DNA, 21 bp, Artificial Sequence
  Artificial sequence related to HLA knockouts in cell therapy
tgcgcggctactacaaccaga

SEQ ID NO: 16787 - DNA, 21 bp, Artificial Sequence
  Artificial sequence related to HLA knockouts in cell therapy
ggacgcccccaaaacgcatat

SEQ ID NO: 16788 - DNA, 21 bp, Artificial Sequence
  Artificial sequence related to HLA knockouts in cell therapy
gacgcccccaaaacgcatatg

SEQ ID NO: 16789 - DNA, 21 bp, Artificial Sequence
  Artificial sequence related to HLA knockouts in cell therapy
acgcccccaaaacgcatatga

SEQ ID NO: 16790 - DNA, 21 bp, Artificial Sequence
  Artificial sequence related to HLA knockouts in cell therapy
cgcccccaaaacgcatatgac

SEQ ID NO: 16791 - DNA, 21 bp, Artificial Sequence
  Artificial sequence related to HLA knockouts in cell therapy
gcccccaaaacgcatatgact

SEQ ID NO: 16792 - DNA, 21 bp, Artificial Sequence
  Artificial sequence related to HLA knockouts in cell therapy
cccccaaaacgcatatgactc

SEQ ID NO: 16793 - DNA, 21 bp, Artificial Sequence
  Artificial sequence related to HLA knockouts in cell therapy
ccccaaaacgcatatgactca

SEQ ID NO: 16794 - DNA, 21 bp, Artificial Sequence
  Artificial sequence related to HLA knockouts in cell therapy
cccaaaacgcatatgactcac

SEQ ID NO: 16795 - DNA, 21 bp, Artificial Sequence
  Artificial sequence related to HLA knockouts in cell therapy
ccaaaacgcatatgactcacc

SEQ ID NO: 16796 - DNA, 21 bp, Artificial Sequence
  Artificial sequence related to HLA knockouts in cell therapy
caaaacgcatatgactcacca

SEQ ID NO: 16797 - DNA, 21 bp, Artificial Sequence
  Artificial sequence related to HLA knockouts in cell therapy
aaaacgcatatgactcaccac

SEQ ID NO: 16798 - DNA, 21 bp, Artificial Sequence
  Artificial sequence related to HLA knockouts in cell therapy
tgcaggggatggaaccttcca

SEQ ID NO: 16799 - DNA, 21 bp, Artificial Sequence
  Artificial sequence related to HLA knockouts in cell therapy
caggggatggaaccttccaga

SEQ ID NO: 16800 - DNA, 21 bp, Artificial Sequence
  Artificial sequence related to HLA knockouts in cell therapy
aggggatggaaccttccagaa

SEQ ID NO: 16801 - DNA, 21 bp, Artificial Sequence
  Artificial sequence related to HLA knockouts in cell therapy
ggggatggaaccttccagaag

SEQ ID NO: 16802 - DNA, 21 bp, Artificial Sequence
  Artificial sequence related to HLA knockouts in cell therapy
catccccatcgtgggcatcat

SEQ ID NO: 16803 - DNA, 21 bp, Artificial Sequence
  Artificial sequence related to HLA knockouts in cell therapy
atccccatcgtgggcatcatt

SEQ ID NO: 16804 - DNA, 21 bp, Artificial Sequence
  Artificial sequence related to HLA knockouts in cell therapy
tccccatcgtgggcatcattg

SEQ ID NO: 16805 - DNA, 21 bp, Artificial Sequence
  Artificial sequence related to HLA knockouts in cell therapy
aggaagagctcagatagaaaa

SEQ ID NO: 16806 - DNA, 21 bp, Artificial Sequence
  Artificial sequence related to HLA knockouts in cell therapy
ggaagagctcagatagaaaag

SEQ ID NO: 16807 - DNA, 21 bp, Artificial Sequence
  Artificial sequence related to HLA knockouts in cell therapy
gaagagctcagatagaaaagg

SEQ ID NO: 16808 - DNA, 21 bp, Artificial Sequence
  Artificial sequence related to HLA knockouts in cell therapy
aagagctcagatagaaaagga

SEQ ID NO: 16809 - DNA, 21 bp, Artificial Sequence
  Artificial sequence related to HLA knockouts in cell therapy
agagctcagatagaaaaggag

SEQ ID NO: 16810 - DNA, 21 bp, Artificial Sequence
  Artificial sequence related to HLA knockouts in cell therapy
gagctcagatagaaaaggagg

SEQ ID NO: 16811 - DNA, 21 bp, Artificial Sequence
  Artificial sequence related to HLA knockouts in cell therapy
agctcagatagaaaaggaggg

SEQ ID NO: 16812 - DNA, 21 bp, Artificial Sequence
  Artificial sequence related to HLA knockouts in cell therapy
gctcagatagaaaaggaggga

SEQ ID NO: 16813 - DNA, 21 bp, Artificial Sequence
  Artificial sequence related to HLA knockouts in cell therapy
ctcagatagaaaaggagggag

SEQ ID NO: 16814 - DNA, 21 bp, Artificial Sequence
  Artificial sequence related to HLA knockouts in cell therapy
tcagatagaaaaggagggagc

SEQ ID NO: 16815 - DNA, 21 bp, Artificial Sequence
  Artificial sequence related to HLA knockouts in cell therapy
cagatagaaaaggagggagct

SEQ ID NO: 16816 - DNA, 21 bp, Artificial Sequence
  Artificial sequence related to HLA knockouts in cell therapy
agatagaaaaggagggagcta

SEQ ID NO: 16817 - DNA, 21 bp, Artificial Sequence
  Artificial sequence related to HLA knockouts in cell therapy
gatagaaaaggagggagctac

SEQ ID NO: 16818 - DNA, 21 bp, Artificial Sequence
  Artificial sequence related to HLA knockouts in cell therapy
atagaaaaggagggagctact

SEQ ID NO: 16819 - DNA, 21 bp, Artificial Sequence
  Artificial sequence related to HLA knockouts in cell therapy
tagaaaaggagggagctactc

SEQ ID NO: 16820 - DNA, 21 bp, Artificial Sequence
  Artificial sequence related to HLA knockouts in cell therapy
agaaaaggagggagctactct

SEQ ID NO: 16821 - DNA, 21 bp, Artificial Sequence
  Artificial sequence related to HLA knockouts in cell therapy
gaaaaggagggagctactctc

SEQ ID NO: 16822 - DNA, 21 bp, Artificial Sequence
  Artificial sequence related to HLA knockouts in cell therapy
aaaaggagggagctactctca

SEQ ID NO: 16823 - DNA, 21 bp, Artificial Sequence
  Artificial sequence related to HLA knockouts in cell therapy
gcataatgtgaggaggtgggg

SEQ ID NO: 16824 - DNA, 21 bp, Artificial Sequence
  Artificial sequence related to HLA knockouts in cell therapy
cataatgtgaggaggtgggga

SEQ ID NO: 16825 - DNA, 21 bp, Artificial Sequence
  Artificial sequence related to HLA knockouts in cell therapy
ataatgtgaggaggtggggag

SEQ ID NO: 16826 - DNA, 21 bp, Artificial Sequence
  Artificial sequence related to HLA knockouts in cell therapy
taatgtgaggaggtggggaga

SEQ ID NO: 16827 - DNA, 21 bp, Artificial Sequence
  Artificial sequence related to HLA knockouts in cell therapy
aatgtgaggaggtggggagac

SEQ ID NO: 16828 - DNA, 21 bp, Artificial Sequence
  Artificial sequence related to HLA knockouts in cell therapy
ctgtgctccctccccaatcat

SEQ ID NO: 16829 - DNA, 21 bp, Artificial Sequence
  Artificial sequence related to HLA knockouts in cell therapy
tgtgctccctccccaatcatc

SEQ ID NO: 16830 - DNA, 21 bp, Artificial Sequence
  Artificial sequence related to HLA knockouts in cell therapy
gtgctccctccccaatcatct

SEQ ID NO: 16831 - DNA, 21 bp, Artificial Sequence
  Artificial sequence related to HLA knockouts in cell therapy
tgctccctccccaatcatctt

SEQ ID NO: 16832 - DNA, 21 bp, Artificial Sequence
  Artificial sequence related to HLA knockouts in cell therapy
gctccctccccaatcatcttt

SEQ ID NO: 16833 - DNA, 21 bp, Artificial Sequence
  Artificial sequence related to HLA knockouts in cell therapy
ctccctccccaatcatctttc

SEQ ID NO: 16834 - DNA, 21 bp, Artificial Sequence
  Artificial sequence related to HLA knockouts in cell therapy
tccctccccaatcatctttcc

SEQ ID NO: 16835 - DNA, 21 bp, Artificial Sequence
  Artificial sequence related to HLA knockouts in cell therapy
ccctccccaatcatctttcct

SEQ ID NO: 16836 - DNA, 21 bp, Artificial Sequence
  Artificial sequence related to HLA knockouts in cell therapy
cctccccaatcatctttcctg

SEQ ID NO: 16837 - DNA, 21 bp, Artificial Sequence
  Artificial sequence related to HLA knockouts in cell therapy
ctccccaatcatctttcctgt

SEQ ID NO: 16838 - DNA, 21 bp, Artificial Sequence
  Artificial sequence related to HLA knockouts in cell therapy
tccccaatcatctttcctgtt

SEQ ID NO: 16839 - DNA, 21 bp, Artificial Sequence
  Artificial sequence related to HLA knockouts in cell therapy
ccccaatcatctttcctgttc

SEQ ID NO: 16840 - DNA, 22 bp, Artificial Sequence
  Artificial sequence related to HLA knockouts in cell therapy
ccccgaaggcggtgtatggatt

SEQ ID NO: 16841 - DNA, 22 bp, Artificial Sequence
  Artificial sequence related to HLA knockouts in cell therapy
gaaggcggtgtatggattgggg

SEQ ID NO: 16842 - DNA, 22 bp, Artificial Sequence
  Artificial sequence related to HLA knockouts in cell therapy
aaggcggtgtatggattgggga

SEQ ID NO: 16843 - DNA, 22 bp, Artificial Sequence
  Artificial sequence related to HLA knockouts in cell therapy
aggcggtgtatggattggggag

SEQ ID NO: 16844 - DNA, 22 bp, Artificial Sequence
  Artificial sequence related to HLA knockouts in cell therapy
ggcggtgtatggattggggagt

SEQ ID NO: 16845 - DNA, 22 bp, Artificial Sequence
  Artificial sequence related to HLA knockouts in cell therapy
gcggtgtatggattggggagtc

SEQ ID NO: 16846 - DNA, 22 bp, Artificial Sequence
  Artificial sequence related to HLA knockouts in cell therapy
cggtgtatggattggggagtcc

SEQ ID NO: 16847 - DNA, 22 bp, Artificial Sequence
  Artificial sequence related to HLA knockouts in cell therapy
ggtgtatggattggggagtccc

SEQ ID NO: 16848 - DNA, 22 bp, Artificial Sequence
  Artificial sequence related to HLA knockouts in cell therapy
gtgtatggattggggagtccca

SEQ ID NO: 16849 - DNA, 22 bp, Artificial Sequence
  Artificial sequence related to HLA knockouts in cell therapy
tgtatggattggggagtcccag

SEQ ID NO: 16850 - DNA, 22 bp, Artificial Sequence
  Artificial sequence related to HLA knockouts in cell therapy
gtatggattggggagtcccagc

SEQ ID NO: 16851 - DNA, 22 bp, Artificial Sequence
  Artificial sequence related to HLA knockouts in cell therapy
tatggattggggagtcccagcc

SEQ ID NO: 16852 - DNA, 22 bp, Artificial Sequence
  Artificial sequence related to HLA knockouts in cell therapy
atggattggggagtcccagcct

SEQ ID NO: 16853 - DNA, 22 bp, Artificial Sequence
  Artificial sequence related to HLA knockouts in cell therapy
tggattggggagtcccagcctt

SEQ ID NO: 16854 - DNA, 22 bp, Artificial Sequence
  Artificial sequence related to HLA knockouts in cell therapy
cagccttggggattccccaact

SEQ ID NO: 16855 - DNA, 22 bp, Artificial Sequence
  Artificial sequence related to HLA knockouts in cell therapy
agccttggggattccccaactc

SEQ ID NO: 16856 - DNA, 22 bp, Artificial Sequence
  Artificial sequence related to HLA knockouts in cell therapy
ttggggattccccaactccgca

SEQ ID NO: 16857 - DNA, 22 bp, Artificial Sequence
  Artificial sequence related to HLA knockouts in cell therapy
gggattccccaactccgcagtt

SEQ ID NO: 16858 - DNA, 22 bp, Artificial Sequence
  Artificial sequence related to HLA knockouts in cell therapy
ggattccccaactccgcagttt

SEQ ID NO: 16859 - DNA, 22 bp, Artificial Sequence
  Artificial sequence related to HLA knockouts in cell therapy
gattccccaactccgcagtttc

SEQ ID NO: 16860 - DNA, 22 bp, Artificial Sequence
  Artificial sequence related to HLA knockouts in cell therapy
attccccaactccgcagtttct

SEQ ID NO: 16861 - DNA, 22 bp, Artificial Sequence
  Artificial sequence related to HLA knockouts in cell therapy
ttccccaactccgcagtttctt

SEQ ID NO: 16862 - DNA, 22 bp, Artificial Sequence
  Artificial sequence related to HLA knockouts in cell therapy
tccccaactccgcagtttcttt

SEQ ID NO: 16863 - DNA, 22 bp, Artificial Sequence
  Artificial sequence related to HLA knockouts in cell therapy
ccccaactccgcagtttctttt

SEQ ID NO: 16864 - DNA, 22 bp, Artificial Sequence
  Artificial sequence related to HLA knockouts in cell therapy
cccaactccgcagtttcttttc

SEQ ID NO: 16865 - DNA, 22 bp, Artificial Sequence
  Artificial sequence related to HLA knockouts in cell therapy
ccaactccgcagtttcttttct

SEQ ID NO: 16866 - DNA, 22 bp, Artificial Sequence
  Artificial sequence related to HLA knockouts in cell therapy
caactccgcagtttcttttctc

SEQ ID NO: 16867 - DNA, 22 bp, Artificial Sequence
  Artificial sequence related to HLA knockouts in cell therapy
aactccgcagtttcttttctcc

SEQ ID NO: 16868 - DNA, 22 bp, Artificial Sequence
  Artificial sequence related to HLA knockouts in cell therapy
actccgcagtttcttttctccc

SEQ ID NO: 16869 - DNA, 22 bp, Artificial Sequence
  Artificial sequence related to HLA knockouts in cell therapy
ctccgcagtttcttttctccct

SEQ ID NO: 16870 - DNA, 22 bp, Artificial Sequence
  Artificial sequence related to HLA knockouts in cell therapy
tccgcagtttcttttctccctc

SEQ ID NO: 16871 - DNA, 22 bp, Artificial Sequence
  Artificial sequence related to HLA knockouts in cell therapy
ccgcagtttcttttctccctct

SEQ ID NO: 16872 - DNA, 22 bp, Artificial Sequence
  Artificial sequence related to HLA knockouts in cell therapy
cgcagtttcttttctccctctc

SEQ ID NO: 16873 - DNA, 22 bp, Artificial Sequence
  Artificial sequence related to HLA knockouts in cell therapy
gcagtttcttttctccctctcc

SEQ ID NO: 16874 - DNA, 22 bp, Artificial Sequence
  Artificial sequence related to HLA knockouts in cell therapy
cagtttcttttctccctctccc

SEQ ID NO: 16875 - DNA, 22 bp, Artificial Sequence
  Artificial sequence related to HLA knockouts in cell therapy
agtttcttttctccctctccca

SEQ ID NO: 16876 - DNA, 22 bp, Artificial Sequence
  Artificial sequence related to HLA knockouts in cell therapy
gtttcttttctccctctcccaa

SEQ ID NO: 16877 - DNA, 22 bp, Artificial Sequence
  Artificial sequence related to HLA knockouts in cell therapy
tttcttttctccctctcccaac

SEQ ID NO: 16878 - DNA, 22 bp, Artificial Sequence
  Artificial sequence related to HLA knockouts in cell therapy
ttcttttctccctctcccaacc

SEQ ID NO: 16879 - DNA, 22 bp, Artificial Sequence
  Artificial sequence related to HLA knockouts in cell therapy
tcttttctccctctcccaacct

SEQ ID NO: 16880 - DNA, 22 bp, Artificial Sequence
  Artificial sequence related to HLA knockouts in cell therapy
cttttctccctctcccaaccta

SEQ ID NO: 16881 - DNA, 22 bp, Artificial Sequence
  Artificial sequence related to HLA knockouts in cell therapy
ttttctccctctcccaacctat

SEQ ID NO: 16882 - DNA, 22 bp, Artificial Sequence
  Artificial sequence related to HLA knockouts in cell therapy
accgggactcagattctcccca

SEQ ID NO: 16883 - DNA, 22 bp, Artificial Sequence
  Artificial sequence related to HLA knockouts in cell therapy
cgggactcagattctccccaga

SEQ ID NO: 16884 - DNA, 22 bp, Artificial Sequence
  Artificial sequence related to HLA knockouts in cell therapy
gggactcagattctccccagac

SEQ ID NO: 16885 - DNA, 22 bp, Artificial Sequence
  Artificial sequence related to HLA knockouts in cell therapy
ggactcagattctccccagacg

SEQ ID NO: 16886 - DNA, 22 bp, Artificial Sequence
  Artificial sequence related to HLA knockouts in cell therapy
gactcagattctccccagacgc

SEQ ID NO: 16887 - DNA, 22 bp, Artificial Sequence
  Artificial sequence related to HLA knockouts in cell therapy
actcagattctccccagacgcc

SEQ ID NO: 16888 - DNA, 22 bp, Artificial Sequence
  Artificial sequence related to HLA knockouts in cell therapy
tcagattctccccagacgccga

SEQ ID NO: 16889 - DNA, 22 bp, Artificial Sequence
  Artificial sequence related to HLA knockouts in cell therapy
attctccccagacgccgaggat

SEQ ID NO: 16890 - DNA, 22 bp, Artificial Sequence
  Artificial sequence related to HLA knockouts in cell therapy
ggagtattgggacggggagaca

SEQ ID NO: 16891 - DNA, 22 bp, Artificial Sequence
  Artificial sequence related to HLA knockouts in cell therapy
gagtattgggacggggagacac

SEQ ID NO: 16892 - DNA, 22 bp, Artificial Sequence
  Artificial sequence related to HLA knockouts in cell therapy
agtattgggacggggagacacg

SEQ ID NO: 16893 - DNA, 22 bp, Artificial Sequence
  Artificial sequence related to HLA knockouts in cell therapy
tattgggacggggagacacgga

SEQ ID NO: 16894 - DNA, 22 bp, Artificial Sequence
  Artificial sequence related to HLA knockouts in cell therapy
attgggacggggagacacggaa

SEQ ID NO: 16895 - DNA, 22 bp, Artificial Sequence
  Artificial sequence related to HLA knockouts in cell therapy
ttgggacggggagacacggaaa

SEQ ID NO: 16896 - DNA, 22 bp, Artificial Sequence
  Artificial sequence related to HLA knockouts in cell therapy
gacggggagacacggaaagtga

SEQ ID NO: 16897 - DNA, 22 bp, Artificial Sequence
  Artificial sequence related to HLA knockouts in cell therapy
acggggagacacggaaagtgaa

SEQ ID NO: 16898 - DNA, 22 bp, Artificial Sequence
  Artificial sequence related to HLA knockouts in cell therapy
cggggagacacggaaagtgaag

SEQ ID NO: 16899 - DNA, 22 bp, Artificial Sequence
  Artificial sequence related to HLA knockouts in cell therapy
ggggagacacggaaagtgaagg

SEQ ID NO: 16900 - DNA, 22 bp, Artificial Sequence
  Artificial sequence related to HLA knockouts in cell therapy
ctgcgcggctactacaaccaga

SEQ ID NO: 16901 - DNA, 22 bp, Artificial Sequence
  Artificial sequence related to HLA knockouts in cell therapy
tgcgcggctactacaaccagag

SEQ ID NO: 16902 - DNA, 22 bp, Artificial Sequence
  Artificial sequence related to HLA knockouts in cell therapy
atgtatggctgcgacgtggggt

SEQ ID NO: 16903 - DNA, 22 bp, Artificial Sequence
  Artificial sequence related to HLA knockouts in cell therapy
acggacgcccccaaaacgcata

SEQ ID NO: 16904 - DNA, 22 bp, Artificial Sequence
  Artificial sequence related to HLA knockouts in cell therapy
cggacgcccccaaaacgcatat

SEQ ID NO: 16905 - DNA, 22 bp, Artificial Sequence
  Artificial sequence related to HLA knockouts in cell therapy
ggacgcccccaaaacgcatatg

SEQ ID NO: 16906 - DNA, 22 bp, Artificial Sequence
  Artificial sequence related to HLA knockouts in cell therapy
gacgcccccaaaacgcatatga

SEQ ID NO: 16907 - DNA, 22 bp, Artificial Sequence
  Artificial sequence related to HLA knockouts in cell therapy
acgcccccaaaacgcatatgac

SEQ ID NO: 16908 - DNA, 22 bp, Artificial Sequence
  Artificial sequence related to HLA knockouts in cell therapy
cgcccccaaaacgcatatgact

SEQ ID NO: 16909 - DNA, 22 bp, Artificial Sequence
  Artificial sequence related to HLA knockouts in cell therapy
gcccccaaaacgcatatgactc

SEQ ID NO: 16910 - DNA, 22 bp, Artificial Sequence
  Artificial sequence related to HLA knockouts in cell therapy
cccccaaaacgcatatgactca

SEQ ID NO: 16911 - DNA, 22 bp, Artificial Sequence
  Artificial sequence related to HLA knockouts in cell therapy
ccccaaaacgcatatgactcac

SEQ ID NO: 16912 - DNA, 22 bp, Artificial Sequence
  Artificial sequence related to HLA knockouts in cell therapy
cccaaaacgcatatgactcacc

SEQ ID NO: 16913 - DNA, 22 bp, Artificial Sequence
  Artificial sequence related to HLA knockouts in cell therapy
ccaaaacgcatatgactcacca

SEQ ID NO: 16914 - DNA, 22 bp, Artificial Sequence
  Artificial sequence related to HLA knockouts in cell therapy
caaaacgcatatgactcaccac

SEQ ID NO: 16915 - DNA, 22 bp, Artificial Sequence
  Artificial sequence related to HLA knockouts in cell therapy
aaaacgcatatgactcaccacg

SEQ ID NO: 16916 - DNA, 22 bp, Artificial Sequence
  Artificial sequence related to HLA knockouts in cell therapy
ctgcaggggatggaaccttcca

SEQ ID NO: 16917 - DNA, 22 bp, Artificial Sequence
  Artificial sequence related to HLA knockouts in cell therapy
tgcaggggatggaaccttccag

SEQ ID NO: 16918 - DNA, 22 bp, Artificial Sequence
  Artificial sequence related to HLA knockouts in cell therapy
gcaggggatggaaccttccaga

SEQ ID NO: 16919 - DNA, 22 bp, Artificial Sequence
  Artificial sequence related to HLA knockouts in cell therapy
caggggatggaaccttccagaa

SEQ ID NO: 16920 - DNA, 22 bp, Artificial Sequence
  Artificial sequence related to HLA knockouts in cell therapy
aggggatggaaccttccagaag

SEQ ID NO: 16921 - DNA, 22 bp, Artificial Sequence
  Artificial sequence related to HLA knockouts in cell therapy
ggggatggaaccttccagaagt

SEQ ID NO: 16922 - DNA, 22 bp, Artificial Sequence
  Artificial sequence related to HLA knockouts in cell therapy
aaccttccagaagtgggcggct

SEQ ID NO: 16923 - DNA, 22 bp, Artificial Sequence
  Artificial sequence related to HLA knockouts in cell therapy
atgagggtttgcccaagcccct

SEQ ID NO: 16924 - DNA, 22 bp, Artificial Sequence
  Artificial sequence related to HLA knockouts in cell therapy
accatccccatcgtgggcatca

SEQ ID NO: 16925 - DNA, 22 bp, Artificial Sequence
  Artificial sequence related to HLA knockouts in cell therapy
ccatccccatcgtgggcatcat

SEQ ID NO: 16926 - DNA, 22 bp, Artificial Sequence
  Artificial sequence related to HLA knockouts in cell therapy
catccccatcgtgggcatcatt

SEQ ID NO: 16927 - DNA, 22 bp, Artificial Sequence
  Artificial sequence related to HLA knockouts in cell therapy
atccccatcgtgggcatcattg

SEQ ID NO: 16928 - DNA, 22 bp, Artificial Sequence
  Artificial sequence related to HLA knockouts in cell therapy
tccccatcgtgggcatcattgc

SEQ ID NO: 16929 - DNA, 22 bp, Artificial Sequence
  Artificial sequence related to HLA knockouts in cell therapy
ccccatcgtgggcatcattgct

SEQ ID NO: 16930 - DNA, 22 bp, Artificial Sequence
  Artificial sequence related to HLA knockouts in cell therapy
gaggaagagctcagatagaaaa

SEQ ID NO: 16931 - DNA, 22 bp, Artificial Sequence
  Artificial sequence related to HLA knockouts in cell therapy
aggaagagctcagatagaaaag

SEQ ID NO: 16932 - DNA, 22 bp, Artificial Sequence
  Artificial sequence related to HLA knockouts in cell therapy
ggaagagctcagatagaaaagg

SEQ ID NO: 16933 - DNA, 22 bp, Artificial Sequence
  Artificial sequence related to HLA knockouts in cell therapy
gaagagctcagatagaaaagga

SEQ ID NO: 16934 - DNA, 22 bp, Artificial Sequence
  Artificial sequence related to HLA knockouts in cell therapy
aagagctcagatagaaaaggag

SEQ ID NO: 16935 - DNA, 22 bp, Artificial Sequence
  Artificial sequence related to HLA knockouts in cell therapy
agagctcagatagaaaaggagg

SEQ ID NO: 16936 - DNA, 22 bp, Artificial Sequence
  Artificial sequence related to HLA knockouts in cell therapy
gagctcagatagaaaaggaggg

SEQ ID NO: 16937 - DNA, 22 bp, Artificial Sequence
  Artificial sequence related to HLA knockouts in cell therapy
agctcagatagaaaaggaggga

SEQ ID NO: 16938 - DNA, 22 bp, Artificial Sequence
  Artificial sequence related to HLA knockouts in cell therapy
gctcagatagaaaaggagggag

SEQ ID NO: 16939 - DNA, 22 bp, Artificial Sequence
  Artificial sequence related to HLA knockouts in cell therapy
ctcagatagaaaaggagggagc

SEQ ID NO: 16940 - DNA, 22 bp, Artificial Sequence
  Artificial sequence related to HLA knockouts in cell therapy
tcagatagaaaaggagggagct

SEQ ID NO: 16941 - DNA, 22 bp, Artificial Sequence
  Artificial sequence related to HLA knockouts in cell therapy
cagatagaaaaggagggagcta

SEQ ID NO: 16942 - DNA, 22 bp, Artificial Sequence
  Artificial sequence related to HLA knockouts in cell therapy
agatagaaaaggagggagctac

SEQ ID NO: 16943 - DNA, 22 bp, Artificial Sequence
  Artificial sequence related to HLA knockouts in cell therapy
gatagaaaaggagggagctact

SEQ ID NO: 16944 - DNA, 22 bp, Artificial Sequence
  Artificial sequence related to HLA knockouts in cell therapy
atagaaaaggagggagctactc

SEQ ID NO: 16945 - DNA, 22 bp, Artificial Sequence
  Artificial sequence related to HLA knockouts in cell therapy
tagaaaaggagggagctactct

SEQ ID NO: 16946 - DNA, 22 bp, Artificial Sequence
  Artificial sequence related to HLA knockouts in cell therapy
agaaaaggagggagctactctc

SEQ ID NO: 16947 - DNA, 22 bp, Artificial Sequence
  Artificial sequence related to HLA knockouts in cell therapy
gaaaaggagggagctactctca

SEQ ID NO: 16948 - DNA, 22 bp, Artificial Sequence
  Artificial sequence related to HLA knockouts in cell therapy
aaaaggagggagctactctcag

SEQ ID NO: 16949 - DNA, 22 bp, Artificial Sequence
  Artificial sequence related to HLA knockouts in cell therapy
ggcataatgtgaggaggtgggg

SEQ ID NO: 16950 - DNA, 22 bp, Artificial Sequence
  Artificial sequence related to HLA knockouts in cell therapy
gcataatgtgaggaggtgggga

SEQ ID NO: 16951 - DNA, 22 bp, Artificial Sequence
  Artificial sequence related to HLA knockouts in cell therapy
cataatgtgaggaggtggggag

SEQ ID NO: 16952 - DNA, 22 bp, Artificial Sequence
  Artificial sequence related to HLA knockouts in cell therapy
ataatgtgaggaggtggggaga

SEQ ID NO: 16953 - DNA, 22 bp, Artificial Sequence
  Artificial sequence related to HLA knockouts in cell therapy
taatgtgaggaggtggggagac

SEQ ID NO: 16954 - DNA, 22 bp, Artificial Sequence
  Artificial sequence related to HLA knockouts in cell therapy
aatgtgaggaggtggggagacc

SEQ ID NO: 16955 - DNA, 22 bp, Artificial Sequence
  Artificial sequence related to HLA knockouts in cell therapy
atgtgaggaggtggggagacca

SEQ ID NO: 16956 - DNA, 22 bp, Artificial Sequence
  Artificial sequence related to HLA knockouts in cell therapy
tgacctgtgctccctccccaat

SEQ ID NO: 16957 - DNA, 22 bp, Artificial Sequence
  Artificial sequence related to HLA knockouts in cell therapy
acctgtgctccctccccaatca

SEQ ID NO: 16958 - DNA, 22 bp, Artificial Sequence
  Artificial sequence related to HLA knockouts in cell therapy
cctgtgctccctccccaatcat

SEQ ID NO: 16959 - DNA, 22 bp, Artificial Sequence
  Artificial sequence related to HLA knockouts in cell therapy
ctgtgctccctccccaatcatc

SEQ ID NO: 16960 - DNA, 22 bp, Artificial Sequence
  Artificial sequence related to HLA knockouts in cell therapy
tgtgctccctccccaatcatct

SEQ ID NO: 16961 - DNA, 22 bp, Artificial Sequence
  Artificial sequence related to HLA knockouts in cell therapy
gtgctccctccccaatcatctt

SEQ ID NO: 16962 - DNA, 22 bp, Artificial Sequence
  Artificial sequence related to HLA knockouts in cell therapy
tgctccctccccaatcatcttt

SEQ ID NO: 16963 - DNA, 22 bp, Artificial Sequence
  Artificial sequence related to HLA knockouts in cell therapy
gctccctccccaatcatctttc

SEQ ID NO: 16964 - DNA, 22 bp, Artificial Sequence
  Artificial sequence related to HLA knockouts in cell therapy
ctccctccccaatcatctttcc

SEQ ID NO: 16965 - DNA, 22 bp, Artificial Sequence
  Artificial sequence related to HLA knockouts in cell therapy
tccctccccaatcatctttcct

SEQ ID NO: 16966 - DNA, 22 bp, Artificial Sequence
  Artificial sequence related to HLA knockouts in cell therapy
ccctccccaatcatctttcctg

SEQ ID NO: 16967 - DNA, 22 bp, Artificial Sequence
  Artificial sequence related to HLA knockouts in cell therapy
cctccccaatcatctttcctgt

SEQ ID NO: 16968 - DNA, 22 bp, Artificial Sequence
  Artificial sequence related to HLA knockouts in cell therapy
ctccccaatcatctttcctgtt

SEQ ID NO: 16969 - DNA, 22 bp, Artificial Sequence
  Artificial sequence related to HLA knockouts in cell therapy
tccccaatcatctttcctgttc

SEQ ID NO: 16970 - DNA, 22 bp, Artificial Sequence
  Artificial sequence related to HLA knockouts in cell therapy
ccccaatcatctttcctgttcc

SEQ ID NO: 16971 - DNA, 22 bp, Artificial Sequence
  Artificial sequence related to HLA knockouts in cell therapy
ttcctgttccagagaggtgggg

SEQ ID NO: 16972 - DNA, 22 bp, Artificial Sequence
  Artificial sequence related to HLA knockouts in cell therapy
tgttccagagaggtggggctga

SEQ ID NO: 16973 - DNA, 22 bp, Artificial Sequence
  Artificial sequence related to HLA knockouts in cell therapy
tggggctgaggtgtctccatct

SEQ ID NO: 16974 - DNA, 20 bp, Artificial Sequence
  Artificial sequence related to HLA knockouts in cell therapy
ttcttccttccctattaaaa

SEQ ID NO: 16975 - DNA, 22 bp, Artificial Sequence
  Artificial sequence related to HLA knockouts in cell therapy
acttcttccttccctattaaaa

SEQ ID NO: 16976 - DNA, 18 bp, Artificial Sequence
  Artificial sequence related to HLA knockouts in cell therapy
cagaagcagaggggtcag

SEQ ID NO: 16977 - DNA, 18 bp, Artificial Sequence
  Artificial sequence related to HLA knockouts in cell therapy
aagcagaggggtcagggc

SEQ ID NO: 16978 - DNA, 18 bp, Artificial Sequence
  Artificial sequence related to HLA knockouts in cell therapy
agcagaggggtcagggcg

SEQ ID NO: 16979 - DNA, 18 bp, Artificial Sequence
  Artificial sequence related to HLA knockouts in cell therapy
gcagaggggtcagggcga

SEQ ID NO: 16980 - DNA, 18 bp, Artificial Sequence
  Artificial sequence related to HLA knockouts in cell therapy
cagaggggtcagggcgaa

SEQ ID NO: 16981 - DNA, 18 bp, Artificial Sequence
  Artificial sequence related to HLA knockouts in cell therapy
agaggggtcagggcgaag

SEQ ID NO: 16982 - DNA, 18 bp, Artificial Sequence
  Artificial sequence related to HLA knockouts in cell therapy
gaggggtcagggcgaagt

SEQ ID NO: 16983 - DNA, 18 bp, Artificial Sequence
  Artificial sequence related to HLA knockouts in cell therapy
aggggtcagggcgaagtc

SEQ ID NO: 16984 - DNA, 18 bp, Artificial Sequence
  Artificial sequence related to HLA knockouts in cell therapy
ggggtcagggcgaagtcc

SEQ ID NO: 16985 - DNA, 18 bp, Artificial Sequence
  Artificial sequence related to HLA knockouts in cell therapy
gggtcagggcgaagtccc

SEQ ID NO: 16986 - DNA, 18 bp, Artificial Sequence
  Artificial sequence related to HLA knockouts in cell therapy
ggtcagggcgaagtccca

SEQ ID NO: 16987 - DNA, 18 bp, Artificial Sequence
  Artificial sequence related to HLA knockouts in cell therapy
gtcagggcgaagtcccag

SEQ ID NO: 16988 - DNA, 18 bp, Artificial Sequence
  Artificial sequence related to HLA knockouts in cell therapy
tcagggcgaagtcccagg

SEQ ID NO: 16989 - DNA, 18 bp, Artificial Sequence
  Artificial sequence related to HLA knockouts in cell therapy
cagggcgaagtcccaggg

SEQ ID NO: 16990 - DNA, 18 bp, Artificial Sequence
  Artificial sequence related to HLA knockouts in cell therapy
agggcgaagtcccagggc

SEQ ID NO: 16991 - DNA, 18 bp, Artificial Sequence
  Artificial sequence related to HLA knockouts in cell therapy
gggcgaagtcccagggcc

SEQ ID NO: 16992 - DNA, 18 bp, Artificial Sequence
  Artificial sequence related to HLA knockouts in cell therapy
ggcgaagtcccagggccc

SEQ ID NO: 16993 - DNA, 18 bp, Artificial Sequence
  Artificial sequence related to HLA knockouts in cell therapy
gcgaagtcccagggcccc

SEQ ID NO: 16994 - DNA, 18 bp, Artificial Sequence
  Artificial sequence related to HLA knockouts in cell therapy
cgaagtcccagggcccca

SEQ ID NO: 16995 - DNA, 18 bp, Artificial Sequence
  Artificial sequence related to HLA knockouts in cell therapy
gaagtcccagggccccag

SEQ ID NO: 16996 - DNA, 18 bp, Artificial Sequence
  Artificial sequence related to HLA knockouts in cell therapy
aagtcccagggccccagg

SEQ ID NO: 16997 - DNA, 18 bp, Artificial Sequence
  Artificial sequence related to HLA knockouts in cell therapy
agtcccagggccccaggc

SEQ ID NO: 16998 - DNA, 18 bp, Artificial Sequence
  Artificial sequence related to HLA knockouts in cell therapy
gtcccagggccccaggcg

SEQ ID NO: 16999 - DNA, 18 bp, Artificial Sequence
  Artificial sequence related to HLA knockouts in cell therapy
tcccagggccccaggcgt

SEQ ID NO: 17000 - DNA, 18 bp, Artificial Sequence
  Artificial sequence related to HLA knockouts in cell therapy
cccagggccccaggcgtg

SEQ ID NO: 17001 - DNA, 18 bp, Artificial Sequence
  Artificial sequence related to HLA knockouts in cell therapy
ccagggccccaggcgtgg

SEQ ID NO: 17002 - DNA, 18 bp, Artificial Sequence
  Artificial sequence related to HLA knockouts in cell therapy
cagggccccaggcgtggc

SEQ ID NO: 17003 - DNA, 18 bp, Artificial Sequence
  Artificial sequence related to HLA knockouts in cell therapy
agggccccaggcgtggct

SEQ ID NO: 17004 - DNA, 18 bp, Artificial Sequence
  Artificial sequence related to HLA knockouts in cell therapy
gggccccaggcgtggctc

SEQ ID NO: 17005 - DNA, 18 bp, Artificial Sequence
  Artificial sequence related to HLA knockouts in cell therapy
ggccccaggcgtggctct

SEQ ID NO: 17006 - DNA, 18 bp, Artificial Sequence
  Artificial sequence related to HLA knockouts in cell therapy
gccccaggcgtggctctc

SEQ ID NO: 17007 - DNA, 18 bp, Artificial Sequence
  Artificial sequence related to HLA knockouts in cell therapy
ccccaggcgtggctctca

SEQ ID NO: 17008 - DNA, 18 bp, Artificial Sequence
  Artificial sequence related to HLA knockouts in cell therapy
cccaggcgtggctctcag

SEQ ID NO: 17009 - DNA, 18 bp, Artificial Sequence
  Artificial sequence related to HLA knockouts in cell therapy
ccaggcgtggctctcagg

SEQ ID NO: 17010 - DNA, 18 bp, Artificial Sequence
  Artificial sequence related to HLA knockouts in cell therapy
caggcgtggctctcaggg

SEQ ID NO: 17011 - DNA, 18 bp, Artificial Sequence
  Artificial sequence related to HLA knockouts in cell therapy
aggcgtggctctcagggt

SEQ ID NO: 17012 - DNA, 18 bp, Artificial Sequence
  Artificial sequence related to HLA knockouts in cell therapy
ggcgtggctctcagggtc

SEQ ID NO: 17013 - DNA, 18 bp, Artificial Sequence
  Artificial sequence related to HLA knockouts in cell therapy
gcgtggctctcagggtct

SEQ ID NO: 17014 - DNA, 18 bp, Artificial Sequence
  Artificial sequence related to HLA knockouts in cell therapy
cgtggctctcagggtctc

SEQ ID NO: 17015 - DNA, 18 bp, Artificial Sequence
  Artificial sequence related to HLA knockouts in cell therapy
gtggctctcagggtctca

SEQ ID NO: 17016 - DNA, 18 bp, Artificial Sequence
  Artificial sequence related to HLA knockouts in cell therapy
tggctctcagggtctcag

SEQ ID NO: 17017 - DNA, 18 bp, Artificial Sequence
  Artificial sequence related to HLA knockouts in cell therapy
ggctctcagggtctcagg

SEQ ID NO: 17018 - DNA, 18 bp, Artificial Sequence
  Artificial sequence related to HLA knockouts in cell therapy
gctctcagggtctcaggc

SEQ ID NO: 17019 - DNA, 18 bp, Artificial Sequence
  Artificial sequence related to HLA knockouts in cell therapy
ctctcagggtctcaggcc

SEQ ID NO: 17020 - DNA, 18 bp, Artificial Sequence
  Artificial sequence related to HLA knockouts in cell therapy
tctcagggtctcaggccc

SEQ ID NO: 17021 - DNA, 18 bp, Artificial Sequence
  Artificial sequence related to HLA knockouts in cell therapy
ctcagggtctcaggcccc

SEQ ID NO: 17022 - DNA, 18 bp, Artificial Sequence
  Artificial sequence related to HLA knockouts in cell therapy
tcagggtctcaggccccg

SEQ ID NO: 17023 - DNA, 18 bp, Artificial Sequence
  Artificial sequence related to HLA knockouts in cell therapy
cagggtctcaggccccga

SEQ ID NO: 17024 - DNA, 18 bp, Artificial Sequence
  Artificial sequence related to HLA knockouts in cell therapy
agggtctcaggccccgaa

SEQ ID NO: 17025 - DNA, 18 bp, Artificial Sequence
  Artificial sequence related to HLA knockouts in cell therapy
gggtctcaggccccgaag

SEQ ID NO: 17026 - DNA, 18 bp, Artificial Sequence
  Artificial sequence related to HLA knockouts in cell therapy
ggtctcaggccccgaagg

SEQ ID NO: 17027 - DNA, 18 bp, Artificial Sequence
  Artificial sequence related to HLA knockouts in cell therapy
gtctcaggccccgaaggc

SEQ ID NO: 17028 - DNA, 18 bp, Artificial Sequence
  Artificial sequence related to HLA knockouts in cell therapy
tctcaggccccgaaggcg

SEQ ID NO: 17029 - DNA, 18 bp, Artificial Sequence
  Artificial sequence related to HLA knockouts in cell therapy
ctcaggccccgaaggcgg

SEQ ID NO: 17030 - DNA, 18 bp, Artificial Sequence
  Artificial sequence related to HLA knockouts in cell therapy
tcaggccccgaaggcggt

SEQ ID NO: 17031 - DNA, 18 bp, Artificial Sequence
  Artificial sequence related to HLA knockouts in cell therapy
caggccccgaaggcggtg

SEQ ID NO: 17032 - DNA, 18 bp, Artificial Sequence
  Artificial sequence related to HLA knockouts in cell therapy
aggccccgaaggcggtgt

SEQ ID NO: 17033 - DNA, 18 bp, Artificial Sequence
  Artificial sequence related to HLA knockouts in cell therapy
ggccccgaaggcggtgta

SEQ ID NO: 17034 - DNA, 18 bp, Artificial Sequence
  Artificial sequence related to HLA knockouts in cell therapy
gccccgaaggcggtgtat

SEQ ID NO: 17035 - DNA, 18 bp, Artificial Sequence
  Artificial sequence related to HLA knockouts in cell therapy
ccccgaaggcggtgtatg

SEQ ID NO: 17036 - DNA, 18 bp, Artificial Sequence
  Artificial sequence related to HLA knockouts in cell therapy
cccgaaggcggtgtatgg

SEQ ID NO: 17037 - DNA, 18 bp, Artificial Sequence
  Artificial sequence related to HLA knockouts in cell therapy
ccgaaggcggtgtatgga

SEQ ID NO: 17038 - DNA, 18 bp, Artificial Sequence
  Artificial sequence related to HLA knockouts in cell therapy
ggcggtgtatggattggg

SEQ ID NO: 17039 - DNA, 18 bp, Artificial Sequence
  Artificial sequence related to HLA knockouts in cell therapy
attggggagtcccagcct

SEQ ID NO: 17040 - DNA, 18 bp, Artificial Sequence
  Artificial sequence related to HLA knockouts in cell therapy
ttggggagtcccagcctt

SEQ ID NO: 17041 - DNA, 18 bp, Artificial Sequence
  Artificial sequence related to HLA knockouts in cell therapy
tcccagccttggggattc

SEQ ID NO: 17042 - DNA, 18 bp, Artificial Sequence
  Artificial sequence related to HLA knockouts in cell therapy
cccagccttggggattcc

SEQ ID NO: 17043 - DNA, 18 bp, Artificial Sequence
  Artificial sequence related to HLA knockouts in cell therapy
ccagccttggggattccc

SEQ ID NO: 17044 - DNA, 18 bp, Artificial Sequence
  Artificial sequence related to HLA knockouts in cell therapy
cagccttggggattcccc

SEQ ID NO: 17045 - DNA, 18 bp, Artificial Sequence
  Artificial sequence related to HLA knockouts in cell therapy
agccttggggattcccca

SEQ ID NO: 17046 - DNA, 18 bp, Artificial Sequence
  Artificial sequence related to HLA knockouts in cell therapy
gccttggggattccccaa

SEQ ID NO: 17047 - DNA, 18 bp, Artificial Sequence
  Artificial sequence related to HLA knockouts in cell therapy
ccttggggattccccaac

SEQ ID NO: 17048 - DNA, 18 bp, Artificial Sequence
  Artificial sequence related to HLA knockouts in cell therapy
tggggattccccaactcc

SEQ ID NO: 17049 - DNA, 18 bp, Artificial Sequence
  Artificial sequence related to HLA knockouts in cell therapy
ggggattccccaactccg

SEQ ID NO: 17050 - DNA, 18 bp, Artificial Sequence
  Artificial sequence related to HLA knockouts in cell therapy
gggattccccaactccgc

SEQ ID NO: 17051 - DNA, 18 bp, Artificial Sequence
  Artificial sequence related to HLA knockouts in cell therapy
ggattccccaactccgca

SEQ ID NO: 17052 - DNA, 18 bp, Artificial Sequence
  Artificial sequence related to HLA knockouts in cell therapy
gattccccaactccgcag

SEQ ID NO: 17053 - DNA, 18 bp, Artificial Sequence
  Artificial sequence related to HLA knockouts in cell therapy
ccccaactccgcagtttc

SEQ ID NO: 17054 - DNA, 18 bp, Artificial Sequence
  Artificial sequence related to HLA knockouts in cell therapy
cctggatactcacgacgc

SEQ ID NO: 17055 - DNA, 18 bp, Artificial Sequence
  Artificial sequence related to HLA knockouts in cell therapy
ctggatactcacgacgcg

SEQ ID NO: 17056 - DNA, 18 bp, Artificial Sequence
  Artificial sequence related to HLA knockouts in cell therapy
tggatactcacgacgcgg

SEQ ID NO: 17057 - DNA, 18 bp, Artificial Sequence
  Artificial sequence related to HLA knockouts in cell therapy
ggatactcacgacgcgga

SEQ ID NO: 17058 - DNA, 18 bp, Artificial Sequence
  Artificial sequence related to HLA knockouts in cell therapy
gatactcacgacgcggac

SEQ ID NO: 17059 - DNA, 18 bp, Artificial Sequence
  Artificial sequence related to HLA knockouts in cell therapy
atactcacgacgcggacc

SEQ ID NO: 17060 - DNA, 18 bp, Artificial Sequence
  Artificial sequence related to HLA knockouts in cell therapy
tactcacgacgcggaccc

SEQ ID NO: 17061 - DNA, 18 bp, Artificial Sequence
  Artificial sequence related to HLA knockouts in cell therapy
actcacgacgcggaccca

SEQ ID NO: 17062 - DNA, 18 bp, Artificial Sequence
  Artificial sequence related to HLA knockouts in cell therapy
ctcacgacgcggacccag

SEQ ID NO: 17063 - DNA, 18 bp, Artificial Sequence
  Artificial sequence related to HLA knockouts in cell therapy
tcacgacgcggacccagt

SEQ ID NO: 17064 - DNA, 18 bp, Artificial Sequence
  Artificial sequence related to HLA knockouts in cell therapy
cacgacgcggacccagtt

SEQ ID NO: 17065 - DNA, 18 bp, Artificial Sequence
  Artificial sequence related to HLA knockouts in cell therapy
acgacgcggacccagttc

SEQ ID NO: 17066 - DNA, 18 bp, Artificial Sequence
  Artificial sequence related to HLA knockouts in cell therapy
cgacgcggacccagttct

SEQ ID NO: 17067 - DNA, 18 bp, Artificial Sequence
  Artificial sequence related to HLA knockouts in cell therapy
gacgcggacccagttctc

SEQ ID NO: 17068 - DNA, 18 bp, Artificial Sequence
  Artificial sequence related to HLA knockouts in cell therapy
acgcggacccagttctca

SEQ ID NO: 17069 - DNA, 18 bp, Artificial Sequence
  Artificial sequence related to HLA knockouts in cell therapy
cgcggacccagttctcac

SEQ ID NO: 17070 - DNA, 18 bp, Artificial Sequence
  Artificial sequence related to HLA knockouts in cell therapy
gcggacccagttctcact

SEQ ID NO: 17071 - DNA, 18 bp, Artificial Sequence
  Artificial sequence related to HLA knockouts in cell therapy
cggacccagttctcactc

SEQ ID NO: 17072 - DNA, 18 bp, Artificial Sequence
  Artificial sequence related to HLA knockouts in cell therapy
ggacccagttctcactcc

SEQ ID NO: 17073 - DNA, 18 bp, Artificial Sequence
  Artificial sequence related to HLA knockouts in cell therapy
gacccagttctcactccc

SEQ ID NO: 17074 - DNA, 18 bp, Artificial Sequence
  Artificial sequence related to HLA knockouts in cell therapy
cactcccattgggtgtcg

SEQ ID NO: 17075 - DNA, 18 bp, Artificial Sequence
  Artificial sequence related to HLA knockouts in cell therapy
actcccattgggtgtcgg

SEQ ID NO: 17076 - DNA, 18 bp, Artificial Sequence
  Artificial sequence related to HLA knockouts in cell therapy
ctcccattgggtgtcggg

SEQ ID NO: 17077 - DNA, 18 bp, Artificial Sequence
  Artificial sequence related to HLA knockouts in cell therapy
tcccattgggtgtcgggt

SEQ ID NO: 17078 - DNA, 18 bp, Artificial Sequence
  Artificial sequence related to HLA knockouts in cell therapy
cccattgggtgtcgggtt

SEQ ID NO: 17079 - DNA, 18 bp, Artificial Sequence
  Artificial sequence related to HLA knockouts in cell therapy
tgggtgtcgggtttccag

SEQ ID NO: 17080 - DNA, 18 bp, Artificial Sequence
  Artificial sequence related to HLA knockouts in cell therapy
gggtgtcgggtttccaga

SEQ ID NO: 17081 - DNA, 18 bp, Artificial Sequence
  Artificial sequence related to HLA knockouts in cell therapy
ggtgtcgggtttccagag

SEQ ID NO: 17082 - DNA, 18 bp, Artificial Sequence
  Artificial sequence related to HLA knockouts in cell therapy
cgggtttccagagaagcc

SEQ ID NO: 17083 - DNA, 18 bp, Artificial Sequence
  Artificial sequence related to HLA knockouts in cell therapy
gccaatcagtgtcgtcgc

SEQ ID NO: 17084 - DNA, 18 bp, Artificial Sequence
  Artificial sequence related to HLA knockouts in cell therapy
ccaatcagtgtcgtcgcg

SEQ ID NO: 17085 - DNA, 18 bp, Artificial Sequence
  Artificial sequence related to HLA knockouts in cell therapy
caatcagtgtcgtcgcgg

SEQ ID NO: 17086 - DNA, 18 bp, Artificial Sequence
  Artificial sequence related to HLA knockouts in cell therapy
atcagtgtcgtcgcggtc

SEQ ID NO: 17087 - DNA, 18 bp, Artificial Sequence
  Artificial sequence related to HLA knockouts in cell therapy
tcagtgtcgtcgcggtcg

SEQ ID NO: 17088 - DNA, 18 bp, Artificial Sequence
  Artificial sequence related to HLA knockouts in cell therapy
cagtgtcgtcgcggtcgc

SEQ ID NO: 17089 - DNA, 18 bp, Artificial Sequence
  Artificial sequence related to HLA knockouts in cell therapy
agtgtcgtcgcggtcgcg

SEQ ID NO: 17090 - DNA, 18 bp, Artificial Sequence
  Artificial sequence related to HLA knockouts in cell therapy
gtgtcgtcgcggtcgcgg

SEQ ID NO: 17091 - DNA, 18 bp, Artificial Sequence
  Artificial sequence related to HLA knockouts in cell therapy
tgtcgtcgcggtcgcggt

SEQ ID NO: 17092 - DNA, 18 bp, Artificial Sequence
  Artificial sequence related to HLA knockouts in cell therapy
gtcgtcgcggtcgcggtt

SEQ ID NO: 17093 - DNA, 18 bp, Artificial Sequence
  Artificial sequence related to HLA knockouts in cell therapy
tcgtcgcggtcgcggttc

SEQ ID NO: 17094 - DNA, 18 bp, Artificial Sequence
  Artificial sequence related to HLA knockouts in cell therapy
cgtcgcggtcgcggttct

SEQ ID NO: 17095 - DNA, 18 bp, Artificial Sequence
  Artificial sequence related to HLA knockouts in cell therapy
gtcgcggtcgcggttcta

SEQ ID NO: 17096 - DNA, 18 bp, Artificial Sequence
  Artificial sequence related to HLA knockouts in cell therapy
tcgcggtcgcggttctaa

SEQ ID NO: 17097 - DNA, 18 bp, Artificial Sequence
  Artificial sequence related to HLA knockouts in cell therapy
cgcggtcgcggttctaaa

SEQ ID NO: 17098 - DNA, 18 bp, Artificial Sequence
  Artificial sequence related to HLA knockouts in cell therapy
gcggtcgcggttctaaag

SEQ ID NO: 17099 - DNA, 18 bp, Artificial Sequence
  Artificial sequence related to HLA knockouts in cell therapy
cgcggttctaaagtccgc

SEQ ID NO: 17100 - DNA, 18 bp, Artificial Sequence
  Artificial sequence related to HLA knockouts in cell therapy
ctaaagtccgcacgcacc

SEQ ID NO: 17101 - DNA, 18 bp, Artificial Sequence
  Artificial sequence related to HLA knockouts in cell therapy
taaagtccgcacgcaccc

SEQ ID NO: 17102 - DNA, 18 bp, Artificial Sequence
  Artificial sequence related to HLA knockouts in cell therapy
aaagtccgcacgcaccca

SEQ ID NO: 17103 - DNA, 18 bp, Artificial Sequence
  Artificial sequence related to HLA knockouts in cell therapy
aagtccgcacgcacccac

SEQ ID NO: 17104 - DNA, 18 bp, Artificial Sequence
  Artificial sequence related to HLA knockouts in cell therapy
agtccgcacgcacccacc

SEQ ID NO: 17105 - DNA, 18 bp, Artificial Sequence
  Artificial sequence related to HLA knockouts in cell therapy
gtccgcacgcacccaccg

SEQ ID NO: 17106 - DNA, 18 bp, Artificial Sequence
  Artificial sequence related to HLA knockouts in cell therapy
tccgcacgcacccaccgg

SEQ ID NO: 17107 - DNA, 18 bp, Artificial Sequence
  Artificial sequence related to HLA knockouts in cell therapy
ccgcacgcacccaccggg

SEQ ID NO: 17108 - DNA, 18 bp, Artificial Sequence
  Artificial sequence related to HLA knockouts in cell therapy
cgcacgcacccaccggga

SEQ ID NO: 17109 - DNA, 18 bp, Artificial Sequence
  Artificial sequence related to HLA knockouts in cell therapy
gcacgcacccaccgggac

SEQ ID NO: 17110 - DNA, 18 bp, Artificial Sequence
  Artificial sequence related to HLA knockouts in cell therapy
cacgcacccaccgggact

SEQ ID NO: 17111 - DNA, 18 bp, Artificial Sequence
  Artificial sequence related to HLA knockouts in cell therapy
acgcacccaccgggactc

SEQ ID NO: 17112 - DNA, 18 bp, Artificial Sequence
  Artificial sequence related to HLA knockouts in cell therapy
cgcacccaccgggactca

SEQ ID NO: 17113 - DNA, 18 bp, Artificial Sequence
  Artificial sequence related to HLA knockouts in cell therapy
gcacccaccgggactcag

SEQ ID NO: 17114 - DNA, 18 bp, Artificial Sequence
  Artificial sequence related to HLA knockouts in cell therapy
cacccaccgggactcaga

SEQ ID NO: 17115 - DNA, 18 bp, Artificial Sequence
  Artificial sequence related to HLA knockouts in cell therapy
acccaccgggactcagat

SEQ ID NO: 17116 - DNA, 18 bp, Artificial Sequence
  Artificial sequence related to HLA knockouts in cell therapy
cccaccgggactcagatt

SEQ ID NO: 17117 - DNA, 18 bp, Artificial Sequence
  Artificial sequence related to HLA knockouts in cell therapy
ccaccgggactcagattc

SEQ ID NO: 17118 - DNA, 18 bp, Artificial Sequence
  Artificial sequence related to HLA knockouts in cell therapy
ccgggactcagattctcc

SEQ ID NO: 17119 - DNA, 18 bp, Artificial Sequence
  Artificial sequence related to HLA knockouts in cell therapy
cgggactcagattctccc

SEQ ID NO: 17120 - DNA, 18 bp, Artificial Sequence
  Artificial sequence related to HLA knockouts in cell therapy
gggactcagattctcccc

SEQ ID NO: 17121 - DNA, 18 bp, Artificial Sequence
  Artificial sequence related to HLA knockouts in cell therapy
cagattctccccagacgc

SEQ ID NO: 17122 - DNA, 18 bp, Artificial Sequence
  Artificial sequence related to HLA knockouts in cell therapy
agattctccccagacgcc

SEQ ID NO: 17123 - DNA, 18 bp, Artificial Sequence
  Artificial sequence related to HLA knockouts in cell therapy
gattctccccagacgccg

SEQ ID NO: 17124 - DNA, 18 bp, Artificial Sequence
  Artificial sequence related to HLA knockouts in cell therapy
attctccccagacgccga

SEQ ID NO: 17125 - DNA, 18 bp, Artificial Sequence
  Artificial sequence related to HLA knockouts in cell therapy
ttctccccagacgccgag

SEQ ID NO: 17126 - DNA, 18 bp, Artificial Sequence
  Artificial sequence related to HLA knockouts in cell therapy
tctccccagacgccgagg

SEQ ID NO: 17127 - DNA, 18 bp, Artificial Sequence
  Artificial sequence related to HLA knockouts in cell therapy
ctccccagacgccgagga

SEQ ID NO: 17128 - DNA, 18 bp, Artificial Sequence
  Artificial sequence related to HLA knockouts in cell therapy
tccccagacgccgaggat

SEQ ID NO: 17129 - DNA, 18 bp, Artificial Sequence
  Artificial sequence related to HLA knockouts in cell therapy
ccccagacgccgaggatg

SEQ ID NO: 17130 - DNA, 18 bp, Artificial Sequence
  Artificial sequence related to HLA knockouts in cell therapy
cccagacgccgaggatgg

SEQ ID NO: 17131 - DNA, 18 bp, Artificial Sequence
  Artificial sequence related to HLA knockouts in cell therapy
ccagacgccgaggatggc

SEQ ID NO: 17132 - DNA, 18 bp, Artificial Sequence
  Artificial sequence related to HLA knockouts in cell therapy
cagacgccgaggatggcc

SEQ ID NO: 17133 - DNA, 18 bp, Artificial Sequence
  Artificial sequence related to HLA knockouts in cell therapy
agacgccgaggatggccg

SEQ ID NO: 17134 - DNA, 18 bp, Artificial Sequence
  Artificial sequence related to HLA knockouts in cell therapy
gacgccgaggatggccgt

SEQ ID NO: 17135 - DNA, 18 bp, Artificial Sequence
  Artificial sequence related to HLA knockouts in cell therapy
acgccgaggatggccgtc

SEQ ID NO: 17136 - DNA, 18 bp, Artificial Sequence
  Artificial sequence related to HLA knockouts in cell therapy
cgccgaggatggccgtca

SEQ ID NO: 17137 - DNA, 18 bp, Artificial Sequence
  Artificial sequence related to HLA knockouts in cell therapy
gccgaggatggccgtcat

SEQ ID NO: 17138 - DNA, 18 bp, Artificial Sequence
  Artificial sequence related to HLA knockouts in cell therapy
ccgaggatggccgtcatg

SEQ ID NO: 17139 - DNA, 18 bp, Artificial Sequence
  Artificial sequence related to HLA knockouts in cell therapy
cgaggatggccgtcatgg

SEQ ID NO: 17140 - DNA, 18 bp, Artificial Sequence
  Artificial sequence related to HLA knockouts in cell therapy
gaggatggccgtcatggc

SEQ ID NO: 17141 - DNA, 18 bp, Artificial Sequence
  Artificial sequence related to HLA knockouts in cell therapy
aggatggccgtcatggcg

SEQ ID NO: 17142 - DNA, 18 bp, Artificial Sequence
  Artificial sequence related to HLA knockouts in cell therapy
ggatggccgtcatggcgc

SEQ ID NO: 17143 - DNA, 18 bp, Artificial Sequence
  Artificial sequence related to HLA knockouts in cell therapy
gatggccgtcatggcgcc

SEQ ID NO: 17144 - DNA, 18 bp, Artificial Sequence
  Artificial sequence related to HLA knockouts in cell therapy
atggccgtcatggcgccc

SEQ ID NO: 17145 - DNA, 18 bp, Artificial Sequence
  Artificial sequence related to HLA knockouts in cell therapy
tggccgtcatggcgcccc

SEQ ID NO: 17146 - DNA, 18 bp, Artificial Sequence
  Artificial sequence related to HLA knockouts in cell therapy
ggccgtcatggcgccccg

SEQ ID NO: 17147 - DNA, 18 bp, Artificial Sequence
  Artificial sequence related to HLA knockouts in cell therapy
gccgtcatggcgccccga

SEQ ID NO: 17148 - DNA, 18 bp, Artificial Sequence
  Artificial sequence related to HLA knockouts in cell therapy
ccgtcatggcgccccgaa

SEQ ID NO: 17149 - DNA, 18 bp, Artificial Sequence
  Artificial sequence related to HLA knockouts in cell therapy
cgtcatggcgccccgaac

SEQ ID NO: 17150 - DNA, 18 bp, Artificial Sequence
  Artificial sequence related to HLA knockouts in cell therapy
gtcatggcgccccgaacc

SEQ ID NO: 17151 - DNA, 18 bp, Artificial Sequence
  Artificial sequence related to HLA knockouts in cell therapy
tcatggcgccccgaaccc

SEQ ID NO: 17152 - DNA, 18 bp, Artificial Sequence
  Artificial sequence related to HLA knockouts in cell therapy
catggcgccccgaaccct

SEQ ID NO: 17153 - DNA, 18 bp, Artificial Sequence
  Artificial sequence related to HLA knockouts in cell therapy
atggcgccccgaaccctc

SEQ ID NO: 17154 - DNA, 18 bp, Artificial Sequence
  Artificial sequence related to HLA knockouts in cell therapy
tggcgccccgaaccctcg

SEQ ID NO: 17155 - DNA, 18 bp, Artificial Sequence
  Artificial sequence related to HLA knockouts in cell therapy
ggcgccccgaaccctcgt

SEQ ID NO: 17156 - DNA, 18 bp, Artificial Sequence
  Artificial sequence related to HLA knockouts in cell therapy
gcgccccgaaccctcgtc

SEQ ID NO: 17157 - DNA, 18 bp, Artificial Sequence
  Artificial sequence related to HLA knockouts in cell therapy
cgccccgaaccctcgtcc

SEQ ID NO: 17158 - DNA, 18 bp, Artificial Sequence
  Artificial sequence related to HLA knockouts in cell therapy
gccccgaaccctcgtcct

SEQ ID NO: 17159 - DNA, 18 bp, Artificial Sequence
  Artificial sequence related to HLA knockouts in cell therapy
ccccgaaccctcgtcctg

SEQ ID NO: 17160 - DNA, 18 bp, Artificial Sequence
  Artificial sequence related to HLA knockouts in cell therapy
cccgaaccctcgtcctgc

SEQ ID NO: 17161 - DNA, 18 bp, Artificial Sequence
  Artificial sequence related to HLA knockouts in cell therapy
ccgaaccctcgtcctgct

SEQ ID NO: 17162 - DNA, 18 bp, Artificial Sequence
  Artificial sequence related to HLA knockouts in cell therapy
cgaaccctcgtcctgcta

SEQ ID NO: 17163 - DNA, 18 bp, Artificial Sequence
  Artificial sequence related to HLA knockouts in cell therapy
gaaccctcgtcctgctac

SEQ ID NO: 17164 - DNA, 18 bp, Artificial Sequence
  Artificial sequence related to HLA knockouts in cell therapy
accctcgtcctgctactc

SEQ ID NO: 17165 - DNA, 18 bp, Artificial Sequence
  Artificial sequence related to HLA knockouts in cell therapy
ccctcgtcctgctactct

SEQ ID NO: 17166 - DNA, 18 bp, Artificial Sequence
  Artificial sequence related to HLA knockouts in cell therapy
cctcgtcctgctactctc

SEQ ID NO: 17167 - DNA, 18 bp, Artificial Sequence
  Artificial sequence related to HLA knockouts in cell therapy
ctcgtcctgctactctcg

SEQ ID NO: 17168 - DNA, 18 bp, Artificial Sequence
  Artificial sequence related to HLA knockouts in cell therapy
tcgtcctgctactctcgg

SEQ ID NO: 17169 - DNA, 18 bp, Artificial Sequence
  Artificial sequence related to HLA knockouts in cell therapy
cgtcctgctactctcggg

SEQ ID NO: 17170 - DNA, 18 bp, Artificial Sequence
  Artificial sequence related to HLA knockouts in cell therapy
gtcctgctactctcgggg

SEQ ID NO: 17171 - DNA, 18 bp, Artificial Sequence
  Artificial sequence related to HLA knockouts in cell therapy
tcctgctactctcggggg

SEQ ID NO: 17172 - DNA, 18 bp, Artificial Sequence
  Artificial sequence related to HLA knockouts in cell therapy
cctgctactctcgggggc

SEQ ID NO: 17173 - DNA, 18 bp, Artificial Sequence
  Artificial sequence related to HLA knockouts in cell therapy
ctgctactctcgggggct

SEQ ID NO: 17174 - DNA, 18 bp, Artificial Sequence
  Artificial sequence related to HLA knockouts in cell therapy
tgctactctcgggggctc

SEQ ID NO: 17175 - DNA, 18 bp, Artificial Sequence
  Artificial sequence related to HLA knockouts in cell therapy
gctactctcgggggctct

SEQ ID NO: 17176 - DNA, 18 bp, Artificial Sequence
  Artificial sequence related to HLA knockouts in cell therapy
ctactctcgggggctctg

SEQ ID NO: 17177 - DNA, 18 bp, Artificial Sequence
  Artificial sequence related to HLA knockouts in cell therapy
tactctcgggggctctgg

SEQ ID NO: 17178 - DNA, 18 bp, Artificial Sequence
  Artificial sequence related to HLA knockouts in cell therapy
actctcgggggctctggc

SEQ ID NO: 17179 - DNA, 18 bp, Artificial Sequence
  Artificial sequence related to HLA knockouts in cell therapy
ctctcgggggctctggcc

SEQ ID NO: 17180 - DNA, 18 bp, Artificial Sequence
  Artificial sequence related to HLA knockouts in cell therapy
tctcgggggctctggccc

SEQ ID NO: 17181 - DNA, 18 bp, Artificial Sequence
  Artificial sequence related to HLA knockouts in cell therapy
ctcgggggctctggccct

SEQ ID NO: 17182 - DNA, 18 bp, Artificial Sequence
  Artificial sequence related to HLA knockouts in cell therapy
tcgggggctctggccctg

SEQ ID NO: 17183 - DNA, 18 bp, Artificial Sequence
  Artificial sequence related to HLA knockouts in cell therapy
cgggggctctggccctga

SEQ ID NO: 17184 - DNA, 18 bp, Artificial Sequence
  Artificial sequence related to HLA knockouts in cell therapy
gggggctctggccctgac

SEQ ID NO: 17185 - DNA, 18 bp, Artificial Sequence
  Artificial sequence related to HLA knockouts in cell therapy
ggggctctggccctgacc

SEQ ID NO: 17186 - DNA, 18 bp, Artificial Sequence
  Artificial sequence related to HLA knockouts in cell therapy
gggctctggccctgaccc

SEQ ID NO: 17187 - DNA, 18 bp, Artificial Sequence
  Artificial sequence related to HLA knockouts in cell therapy
ggctctggccctgaccca

SEQ ID NO: 17188 - DNA, 18 bp, Artificial Sequence
  Artificial sequence related to HLA knockouts in cell therapy
gctctggccctgacccag

SEQ ID NO: 17189 - DNA, 18 bp, Artificial Sequence
  Artificial sequence related to HLA knockouts in cell therapy
ctctggccctgacccaga

SEQ ID NO: 17190 - DNA, 18 bp, Artificial Sequence
  Artificial sequence related to HLA knockouts in cell therapy
tctggccctgacccagac

SEQ ID NO: 17191 - DNA, 18 bp, Artificial Sequence
  Artificial sequence related to HLA knockouts in cell therapy
ctggccctgacccagacc

SEQ ID NO: 17192 - DNA, 18 bp, Artificial Sequence
  Artificial sequence related to HLA knockouts in cell therapy
tggccctgacccagacct

SEQ ID NO: 17193 - DNA, 18 bp, Artificial Sequence
  Artificial sequence related to HLA knockouts in cell therapy
ggccctgacccagacctg

SEQ ID NO: 17194 - DNA, 18 bp, Artificial Sequence
  Artificial sequence related to HLA knockouts in cell therapy
gccctgacccagacctgg

SEQ ID NO: 17195 - DNA, 18 bp, Artificial Sequence
  Artificial sequence related to HLA knockouts in cell therapy
ccctgacccagacctggg

SEQ ID NO: 17196 - DNA, 18 bp, Artificial Sequence
  Artificial sequence related to HLA knockouts in cell therapy
cctgacccagacctgggc

SEQ ID NO: 17197 - DNA, 18 bp, Artificial Sequence
  Artificial sequence related to HLA knockouts in cell therapy
ctgacccagacctgggcg

SEQ ID NO: 17198 - DNA, 18 bp, Artificial Sequence
  Artificial sequence related to HLA knockouts in cell therapy
tgacccagacctgggcgg

SEQ ID NO: 17199 - DNA, 18 bp, Artificial Sequence
  Artificial sequence related to HLA knockouts in cell therapy
gacccagacctgggcggg

SEQ ID NO: 17200 - DNA, 18 bp, Artificial Sequence
  Artificial sequence related to HLA knockouts in cell therapy
acccagacctgggcgggc

SEQ ID NO: 17201 - DNA, 18 bp, Artificial Sequence
  Artificial sequence related to HLA knockouts in cell therapy
cccagacctgggcgggct

SEQ ID NO: 17202 - DNA, 18 bp, Artificial Sequence
  Artificial sequence related to HLA knockouts in cell therapy
ccagacctgggcgggctc

SEQ ID NO: 17203 - DNA, 18 bp, Artificial Sequence
  Artificial sequence related to HLA knockouts in cell therapy
cagacctgggcgggctct

SEQ ID NO: 17204 - DNA, 18 bp, Artificial Sequence
  Artificial sequence related to HLA knockouts in cell therapy
agacctgggcgggctctc

SEQ ID NO: 17205 - DNA, 18 bp, Artificial Sequence
  Artificial sequence related to HLA knockouts in cell therapy
gacctgggcgggctctca

SEQ ID NO: 17206 - DNA, 18 bp, Artificial Sequence
  Artificial sequence related to HLA knockouts in cell therapy
acctgggcgggctctcac

SEQ ID NO: 17207 - DNA, 18 bp, Artificial Sequence
  Artificial sequence related to HLA knockouts in cell therapy
cctgggcgggctctcact

SEQ ID NO: 17208 - DNA, 18 bp, Artificial Sequence
  Artificial sequence related to HLA knockouts in cell therapy
ctgggcgggctctcactc

SEQ ID NO: 17209 - DNA, 18 bp, Artificial Sequence
  Artificial sequence related to HLA knockouts in cell therapy
tgggcgggctctcactcc

SEQ ID NO: 17210 - DNA, 18 bp, Artificial Sequence
  Artificial sequence related to HLA knockouts in cell therapy
gggcgggctctcactcca

SEQ ID NO: 17211 - DNA, 18 bp, Artificial Sequence
  Artificial sequence related to HLA knockouts in cell therapy
ggcgggctctcactccat

SEQ ID NO: 17212 - DNA, 18 bp, Artificial Sequence
  Artificial sequence related to HLA knockouts in cell therapy
gcgggctctcactccatg

SEQ ID NO: 17213 - DNA, 18 bp, Artificial Sequence
  Artificial sequence related to HLA knockouts in cell therapy
cgggctctcactccatga

SEQ ID NO: 17214 - DNA, 18 bp, Artificial Sequence
  Artificial sequence related to HLA knockouts in cell therapy
gggctctcactccatgag

SEQ ID NO: 17215 - DNA, 18 bp, Artificial Sequence
  Artificial sequence related to HLA knockouts in cell therapy
ggctctcactccatgagg

SEQ ID NO: 17216 - DNA, 18 bp, Artificial Sequence
  Artificial sequence related to HLA knockouts in cell therapy
cttcacatccgtgtcccg

SEQ ID NO: 17217 - DNA, 18 bp, Artificial Sequence
  Artificial sequence related to HLA knockouts in cell therapy
ttcacatccgtgtcccgg

SEQ ID NO: 17218 - DNA, 18 bp, Artificial Sequence
  Artificial sequence related to HLA knockouts in cell therapy
tcacatccgtgtcccggc

SEQ ID NO: 17219 - DNA, 18 bp, Artificial Sequence
  Artificial sequence related to HLA knockouts in cell therapy
cacatccgtgtcccggcc

SEQ ID NO: 17220 - DNA, 18 bp, Artificial Sequence
  Artificial sequence related to HLA knockouts in cell therapy
acatccgtgtcccggccc

SEQ ID NO: 17221 - DNA, 18 bp, Artificial Sequence
  Artificial sequence related to HLA knockouts in cell therapy
catccgtgtcccggcccg

SEQ ID NO: 17222 - DNA, 18 bp, Artificial Sequence
  Artificial sequence related to HLA knockouts in cell therapy
atccgtgtcccggcccgg

SEQ ID NO: 17223 - DNA, 18 bp, Artificial Sequence
  Artificial sequence related to HLA knockouts in cell therapy
tccgtgtcccggcccggc

SEQ ID NO: 17224 - DNA, 18 bp, Artificial Sequence
  Artificial sequence related to HLA knockouts in cell therapy
ccgtgtcccggcccggcc

SEQ ID NO: 17225 - DNA, 18 bp, Artificial Sequence
  Artificial sequence related to HLA knockouts in cell therapy
cgtgtcccggcccggccg

SEQ ID NO: 17226 - DNA, 18 bp, Artificial Sequence
  Artificial sequence related to HLA knockouts in cell therapy
gtgtcccggcccggccgc

SEQ ID NO: 17227 - DNA, 18 bp, Artificial Sequence
  Artificial sequence related to HLA knockouts in cell therapy
tgtcccggcccggccgcg

SEQ ID NO: 17228 - DNA, 18 bp, Artificial Sequence
  Artificial sequence related to HLA knockouts in cell therapy
gtcccggcccggccgcgg

SEQ ID NO: 17229 - DNA, 18 bp, Artificial Sequence
  Artificial sequence related to HLA knockouts in cell therapy
tcccggcccggccgcggg

SEQ ID NO: 17230 - DNA, 18 bp, Artificial Sequence
  Artificial sequence related to HLA knockouts in cell therapy
cccggcccggccgcgggg

SEQ ID NO: 17231 - DNA, 18 bp, Artificial Sequence
  Artificial sequence related to HLA knockouts in cell therapy
ccggcccggccgcgggga

SEQ ID NO: 17232 - DNA, 18 bp, Artificial Sequence
  Artificial sequence related to HLA knockouts in cell therapy
cggcccggccgcggggag

SEQ ID NO: 17233 - DNA, 18 bp, Artificial Sequence
  Artificial sequence related to HLA knockouts in cell therapy
ggcccggccgcggggagc

SEQ ID NO: 17234 - DNA, 18 bp, Artificial Sequence
  Artificial sequence related to HLA knockouts in cell therapy
gcccggccgcggggagcc

SEQ ID NO: 17235 - DNA, 18 bp, Artificial Sequence
  Artificial sequence related to HLA knockouts in cell therapy
cccggccgcggggagccc

SEQ ID NO: 17236 - DNA, 18 bp, Artificial Sequence
  Artificial sequence related to HLA knockouts in cell therapy
ccggccgcggggagcccc

SEQ ID NO: 17237 - DNA, 18 bp, Artificial Sequence
  Artificial sequence related to HLA knockouts in cell therapy
cggccgcggggagccccg

SEQ ID NO: 17238 - DNA, 18 bp, Artificial Sequence
  Artificial sequence related to HLA knockouts in cell therapy
ggccgcggggagccccgc

SEQ ID NO: 17239 - DNA, 18 bp, Artificial Sequence
  Artificial sequence related to HLA knockouts in cell therapy
gccgcggggagccccgct

SEQ ID NO: 17240 - DNA, 18 bp, Artificial Sequence
  Artificial sequence related to HLA knockouts in cell therapy
ccgcggggagccccgctt

SEQ ID NO: 17241 - DNA, 18 bp, Artificial Sequence
  Artificial sequence related to HLA knockouts in cell therapy
cgcggggagccccgcttc

SEQ ID NO: 17242 - DNA, 18 bp, Artificial Sequence
  Artificial sequence related to HLA knockouts in cell therapy
gcggggagccccgcttca

SEQ ID NO: 17243 - DNA, 18 bp, Artificial Sequence
  Artificial sequence related to HLA knockouts in cell therapy
cggggagccccgcttcat

SEQ ID NO: 17244 - DNA, 18 bp, Artificial Sequence
  Artificial sequence related to HLA knockouts in cell therapy
ggggagccccgcttcatc

SEQ ID NO: 17245 - DNA, 18 bp, Artificial Sequence
  Artificial sequence related to HLA knockouts in cell therapy
gggagccccgcttcatcg

SEQ ID NO: 17246 - DNA, 18 bp, Artificial Sequence
  Artificial sequence related to HLA knockouts in cell therapy
ggagccccgcttcatcgc

SEQ ID NO: 17247 - DNA, 18 bp, Artificial Sequence
  Artificial sequence related to HLA knockouts in cell therapy
gagccccgcttcatcgca

SEQ ID NO: 17248 - DNA, 18 bp, Artificial Sequence
  Artificial sequence related to HLA knockouts in cell therapy
agccccgcttcatcgcag

SEQ ID NO: 17249 - DNA, 18 bp, Artificial Sequence
  Artificial sequence related to HLA knockouts in cell therapy
gccccgcttcatcgcagt

SEQ ID NO: 17250 - DNA, 18 bp, Artificial Sequence
  Artificial sequence related to HLA knockouts in cell therapy
ccccgcttcatcgcagtg

SEQ ID NO: 17251 - DNA, 18 bp, Artificial Sequence
  Artificial sequence related to HLA knockouts in cell therapy
cccgcttcatcgcagtgg

SEQ ID NO: 17252 - DNA, 18 bp, Artificial Sequence
  Artificial sequence related to HLA knockouts in cell therapy
ccgcttcatcgcagtggg

SEQ ID NO: 17253 - DNA, 18 bp, Artificial Sequence
  Artificial sequence related to HLA knockouts in cell therapy
cgcttcatcgcagtgggc

SEQ ID NO: 17254 - DNA, 18 bp, Artificial Sequence
  Artificial sequence related to HLA knockouts in cell therapy
gcttcatcgcagtgggct

SEQ ID NO: 17255 - DNA, 18 bp, Artificial Sequence
  Artificial sequence related to HLA knockouts in cell therapy
tcatcgcagtgggctacg

SEQ ID NO: 17256 - DNA, 18 bp, Artificial Sequence
  Artificial sequence related to HLA knockouts in cell therapy
catcgcagtgggctacgt

SEQ ID NO: 17257 - DNA, 18 bp, Artificial Sequence
  Artificial sequence related to HLA knockouts in cell therapy
atcgcagtgggctacgtg

SEQ ID NO: 17258 - DNA, 18 bp, Artificial Sequence
  Artificial sequence related to HLA knockouts in cell therapy
tcgcagtgggctacgtgg

SEQ ID NO: 17259 - DNA, 18 bp, Artificial Sequence
  Artificial sequence related to HLA knockouts in cell therapy
cgcagtgggctacgtgga

SEQ ID NO: 17260 - DNA, 18 bp, Artificial Sequence
  Artificial sequence related to HLA knockouts in cell therapy
gcagtgggctacgtggac

SEQ ID NO: 17261 - DNA, 18 bp, Artificial Sequence
  Artificial sequence related to HLA knockouts in cell therapy
cagtgggctacgtggacg

SEQ ID NO: 17262 - DNA, 18 bp, Artificial Sequence
  Artificial sequence related to HLA knockouts in cell therapy
agtgggctacgtggacga

SEQ ID NO: 17263 - DNA, 18 bp, Artificial Sequence
  Artificial sequence related to HLA knockouts in cell therapy
gtgggctacgtggacgac

SEQ ID NO: 17264 - DNA, 18 bp, Artificial Sequence
  Artificial sequence related to HLA knockouts in cell therapy
tgggctacgtggacgaca

SEQ ID NO: 17265 - DNA, 18 bp, Artificial Sequence
  Artificial sequence related to HLA knockouts in cell therapy
gggctacgtggacgacac

SEQ ID NO: 17266 - DNA, 18 bp, Artificial Sequence
  Artificial sequence related to HLA knockouts in cell therapy
ggctacgtggacgacacg

SEQ ID NO: 17267 - DNA, 18 bp, Artificial Sequence
  Artificial sequence related to HLA knockouts in cell therapy
gctacgtggacgacacgc

SEQ ID NO: 17268 - DNA, 18 bp, Artificial Sequence
  Artificial sequence related to HLA knockouts in cell therapy
ctacgtggacgacacgca

SEQ ID NO: 17269 - DNA, 18 bp, Artificial Sequence
  Artificial sequence related to HLA knockouts in cell therapy
tacgtggacgacacgcag

SEQ ID NO: 17270 - DNA, 18 bp, Artificial Sequence
  Artificial sequence related to HLA knockouts in cell therapy
acgtggacgacacgcagt

SEQ ID NO: 17271 - DNA, 18 bp, Artificial Sequence
  Artificial sequence related to HLA knockouts in cell therapy
cgtggacgacacgcagtt

SEQ ID NO: 17272 - DNA, 18 bp, Artificial Sequence
  Artificial sequence related to HLA knockouts in cell therapy
gtggacgacacgcagttc

SEQ ID NO: 17273 - DNA, 18 bp, Artificial Sequence
  Artificial sequence related to HLA knockouts in cell therapy
tggacgacacgcagttcg

SEQ ID NO: 17274 - DNA, 18 bp, Artificial Sequence
  Artificial sequence related to HLA knockouts in cell therapy
ggacgacacgcagttcgt

SEQ ID NO: 17275 - DNA, 18 bp, Artificial Sequence
  Artificial sequence related to HLA knockouts in cell therapy
gacgacacgcagttcgtg

SEQ ID NO: 17276 - DNA, 18 bp, Artificial Sequence
  Artificial sequence related to HLA knockouts in cell therapy
acgacacgcagttcgtgc

SEQ ID NO: 17277 - DNA, 18 bp, Artificial Sequence
  Artificial sequence related to HLA knockouts in cell therapy
cgacacgcagttcgtgcg

SEQ ID NO: 17278 - DNA, 18 bp, Artificial Sequence
  Artificial sequence related to HLA knockouts in cell therapy
gacacgcagttcgtgcgg

SEQ ID NO: 17279 - DNA, 18 bp, Artificial Sequence
  Artificial sequence related to HLA knockouts in cell therapy
acacgcagttcgtgcggt

SEQ ID NO: 17280 - DNA, 18 bp, Artificial Sequence
  Artificial sequence related to HLA knockouts in cell therapy
cacgcagttcgtgcggtt

SEQ ID NO: 17281 - DNA, 18 bp, Artificial Sequence
  Artificial sequence related to HLA knockouts in cell therapy
acgcagttcgtgcggttc

SEQ ID NO: 17282 - DNA, 18 bp, Artificial Sequence
  Artificial sequence related to HLA knockouts in cell therapy
cgcagttcgtgcggttcg

SEQ ID NO: 17283 - DNA, 18 bp, Artificial Sequence
  Artificial sequence related to HLA knockouts in cell therapy
gcagttcgtgcggttcga

SEQ ID NO: 17284 - DNA, 18 bp, Artificial Sequence
  Artificial sequence related to HLA knockouts in cell therapy
cagttcgtgcggttcgac

SEQ ID NO: 17285 - DNA, 18 bp, Artificial Sequence
  Artificial sequence related to HLA knockouts in cell therapy
gttcgtgcggttcgacag

SEQ ID NO: 17286 - DNA, 18 bp, Artificial Sequence
  Artificial sequence related to HLA knockouts in cell therapy
ttcgtgcggttcgacagc

SEQ ID NO: 17287 - DNA, 18 bp, Artificial Sequence
  Artificial sequence related to HLA knockouts in cell therapy
tcgtgcggttcgacagcg

SEQ ID NO: 17288 - DNA, 18 bp, Artificial Sequence
  Artificial sequence related to HLA knockouts in cell therapy
cgtgcggttcgacagcga

SEQ ID NO: 17289 - DNA, 18 bp, Artificial Sequence
  Artificial sequence related to HLA knockouts in cell therapy
gtgcggttcgacagcgac

SEQ ID NO: 17290 - DNA, 18 bp, Artificial Sequence
  Artificial sequence related to HLA knockouts in cell therapy
tgcggttcgacagcgacg

SEQ ID NO: 17291 - DNA, 18 bp, Artificial Sequence
  Artificial sequence related to HLA knockouts in cell therapy
gcggttcgacagcgacgc

SEQ ID NO: 17292 - DNA, 18 bp, Artificial Sequence
  Artificial sequence related to HLA knockouts in cell therapy
cggttcgacagcgacgcc

SEQ ID NO: 17293 - DNA, 18 bp, Artificial Sequence
  Artificial sequence related to HLA knockouts in cell therapy
ggttcgacagcgacgccg

SEQ ID NO: 17294 - DNA, 18 bp, Artificial Sequence
  Artificial sequence related to HLA knockouts in cell therapy
gttcgacagcgacgccgc

SEQ ID NO: 17295 - DNA, 18 bp, Artificial Sequence
  Artificial sequence related to HLA knockouts in cell therapy
ttcgacagcgacgccgcg

SEQ ID NO: 17296 - DNA, 18 bp, Artificial Sequence
  Artificial sequence related to HLA knockouts in cell therapy
tcgacagcgacgccgcga

SEQ ID NO: 17297 - DNA, 18 bp, Artificial Sequence
  Artificial sequence related to HLA knockouts in cell therapy
cgacagcgacgccgcgag

SEQ ID NO: 17298 - DNA, 18 bp, Artificial Sequence
  Artificial sequence related to HLA knockouts in cell therapy
gacagcgacgccgcgagc

SEQ ID NO: 17299 - DNA, 18 bp, Artificial Sequence
  Artificial sequence related to HLA knockouts in cell therapy
acagcgacgccgcgagcc

SEQ ID NO: 17300 - DNA, 18 bp, Artificial Sequence
  Artificial sequence related to HLA knockouts in cell therapy
cagcgacgccgcgagcca

SEQ ID NO: 17301 - DNA, 18 bp, Artificial Sequence
  Artificial sequence related to HLA knockouts in cell therapy
agcgacgccgcgagccag

SEQ ID NO: 17302 - DNA, 18 bp, Artificial Sequence
  Artificial sequence related to HLA knockouts in cell therapy
gcgacgccgcgagccaga

SEQ ID NO: 17303 - DNA, 18 bp, Artificial Sequence
  Artificial sequence related to HLA knockouts in cell therapy
cgacgccgcgagccagag

SEQ ID NO: 17304 - DNA, 18 bp, Artificial Sequence
  Artificial sequence related to HLA knockouts in cell therapy
gacgccgcgagccagagg

SEQ ID NO: 17305 - DNA, 18 bp, Artificial Sequence
  Artificial sequence related to HLA knockouts in cell therapy
acgccgcgagccagagga

SEQ ID NO: 17306 - DNA, 18 bp, Artificial Sequence
  Artificial sequence related to HLA knockouts in cell therapy
cgccgcgagccagaggat

SEQ ID NO: 17307 - DNA, 18 bp, Artificial Sequence
  Artificial sequence related to HLA knockouts in cell therapy
gccgcgagccagaggatg

SEQ ID NO: 17308 - DNA, 18 bp, Artificial Sequence
  Artificial sequence related to HLA knockouts in cell therapy
ccgcgagccagaggatgg

SEQ ID NO: 17309 - DNA, 18 bp, Artificial Sequence
  Artificial sequence related to HLA knockouts in cell therapy
cgcgagccagaggatgga

SEQ ID NO: 17310 - DNA, 18 bp, Artificial Sequence
  Artificial sequence related to HLA knockouts in cell therapy
gcgagccagaggatggag

SEQ ID NO: 17311 - DNA, 18 bp, Artificial Sequence
  Artificial sequence related to HLA knockouts in cell therapy
cgagccagaggatggagc

SEQ ID NO: 17312 - DNA, 18 bp, Artificial Sequence
  Artificial sequence related to HLA knockouts in cell therapy
gagccagaggatggagcc

SEQ ID NO: 17313 - DNA, 18 bp, Artificial Sequence
  Artificial sequence related to HLA knockouts in cell therapy
agccagaggatggagccg

SEQ ID NO: 17314 - DNA, 18 bp, Artificial Sequence
  Artificial sequence related to HLA knockouts in cell therapy
gccagaggatggagccgc

SEQ ID NO: 17315 - DNA, 18 bp, Artificial Sequence
  Artificial sequence related to HLA knockouts in cell therapy
ccagaggatggagccgcg

SEQ ID NO: 17316 - DNA, 18 bp, Artificial Sequence
  Artificial sequence related to HLA knockouts in cell therapy
cagaggatggagccgcgg

SEQ ID NO: 17317 - DNA, 18 bp, Artificial Sequence
  Artificial sequence related to HLA knockouts in cell therapy
agaggatggagccgcggg

SEQ ID NO: 17318 - DNA, 18 bp, Artificial Sequence
  Artificial sequence related to HLA knockouts in cell therapy
gaggatggagccgcgggc

SEQ ID NO: 17319 - DNA, 18 bp, Artificial Sequence
  Artificial sequence related to HLA knockouts in cell therapy
aggatggagccgcgggcg

SEQ ID NO: 17320 - DNA, 18 bp, Artificial Sequence
  Artificial sequence related to HLA knockouts in cell therapy
ggatggagccgcgggcgc

SEQ ID NO: 17321 - DNA, 18 bp, Artificial Sequence
  Artificial sequence related to HLA knockouts in cell therapy
gatggagccgcgggcgcc

SEQ ID NO: 17322 - DNA, 18 bp, Artificial Sequence
  Artificial sequence related to HLA knockouts in cell therapy
atggagccgcgggcgccg

SEQ ID NO: 17323 - DNA, 18 bp, Artificial Sequence
  Artificial sequence related to HLA knockouts in cell therapy
tggagccgcgggcgccgt

SEQ ID NO: 17324 - DNA, 18 bp, Artificial Sequence
  Artificial sequence related to HLA knockouts in cell therapy
ggagccgcgggcgccgtg

SEQ ID NO: 17325 - DNA, 18 bp, Artificial Sequence
  Artificial sequence related to HLA knockouts in cell therapy
gagccgcgggcgccgtgg

SEQ ID NO: 17326 - DNA, 18 bp, Artificial Sequence
  Artificial sequence related to HLA knockouts in cell therapy
agccgcgggcgccgtgga

SEQ ID NO: 17327 - DNA, 18 bp, Artificial Sequence
  Artificial sequence related to HLA knockouts in cell therapy
gccgcgggcgccgtggat

SEQ ID NO: 17328 - DNA, 18 bp, Artificial Sequence
  Artificial sequence related to HLA knockouts in cell therapy
ccgcgggcgccgtggata

SEQ ID NO: 17329 - DNA, 18 bp, Artificial Sequence
  Artificial sequence related to HLA knockouts in cell therapy
cgcgggcgccgtggatag

SEQ ID NO: 17330 - DNA, 18 bp, Artificial Sequence
  Artificial sequence related to HLA knockouts in cell therapy
gcgggcgccgtggataga

SEQ ID NO: 17331 - DNA, 18 bp, Artificial Sequence
  Artificial sequence related to HLA knockouts in cell therapy
cgggcgccgtggatagag

SEQ ID NO: 17332 - DNA, 18 bp, Artificial Sequence
  Artificial sequence related to HLA knockouts in cell therapy
gggcgccgtggatagagc

SEQ ID NO: 17333 - DNA, 18 bp, Artificial Sequence
  Artificial sequence related to HLA knockouts in cell therapy
ggcgccgtggatagagca

SEQ ID NO: 17334 - DNA, 18 bp, Artificial Sequence
  Artificial sequence related to HLA knockouts in cell therapy
gcgccgtggatagagcag

SEQ ID NO: 17335 - DNA, 18 bp, Artificial Sequence
  Artificial sequence related to HLA knockouts in cell therapy
cgccgtggatagagcagg

SEQ ID NO: 17336 - DNA, 18 bp, Artificial Sequence
  Artificial sequence related to HLA knockouts in cell therapy
gccgtggatagagcagga

SEQ ID NO: 17337 - DNA, 18 bp, Artificial Sequence
  Artificial sequence related to HLA knockouts in cell therapy
ccgtggatagagcaggag

SEQ ID NO: 17338 - DNA, 18 bp, Artificial Sequence
  Artificial sequence related to HLA knockouts in cell therapy
cgtggatagagcaggagg

SEQ ID NO: 17339 - DNA, 18 bp, Artificial Sequence
  Artificial sequence related to HLA knockouts in cell therapy
gtggatagagcaggaggg

SEQ ID NO: 17340 - DNA, 18 bp, Artificial Sequence
  Artificial sequence related to HLA knockouts in cell therapy
ggatagagcaggagggtc

SEQ ID NO: 17341 - DNA, 18 bp, Artificial Sequence
  Artificial sequence related to HLA knockouts in cell therapy
gatagagcaggagggtcc

SEQ ID NO: 17342 - DNA, 18 bp, Artificial Sequence
  Artificial sequence related to HLA knockouts in cell therapy
atagagcaggagggtccg

SEQ ID NO: 17343 - DNA, 18 bp, Artificial Sequence
  Artificial sequence related to HLA knockouts in cell therapy
tagagcaggagggtccgg

SEQ ID NO: 17344 - DNA, 18 bp, Artificial Sequence
  Artificial sequence related to HLA knockouts in cell therapy
agagcaggagggtccgga

SEQ ID NO: 17345 - DNA, 18 bp, Artificial Sequence
  Artificial sequence related to HLA knockouts in cell therapy
gagcaggagggtccggag

SEQ ID NO: 17346 - DNA, 18 bp, Artificial Sequence
  Artificial sequence related to HLA knockouts in cell therapy
agcaggagggtccggagt

SEQ ID NO: 17347 - DNA, 18 bp, Artificial Sequence
  Artificial sequence related to HLA knockouts in cell therapy
gcaggagggtccggagta

SEQ ID NO: 17348 - DNA, 18 bp, Artificial Sequence
  Artificial sequence related to HLA knockouts in cell therapy
caggagggtccggagtat

SEQ ID NO: 17349 - DNA, 18 bp, Artificial Sequence
  Artificial sequence related to HLA knockouts in cell therapy
ggagggtccggagtattg

SEQ ID NO: 17350 - DNA, 18 bp, Artificial Sequence
  Artificial sequence related to HLA knockouts in cell therapy
gagggtccggagtattgg

SEQ ID NO: 17351 - DNA, 18 bp, Artificial Sequence
  Artificial sequence related to HLA knockouts in cell therapy
agggtccggagtattggg

SEQ ID NO: 17352 - DNA, 18 bp, Artificial Sequence
  Artificial sequence related to HLA knockouts in cell therapy
gggtccggagtattggga

SEQ ID NO: 17353 - DNA, 18 bp, Artificial Sequence
  Artificial sequence related to HLA knockouts in cell therapy
ggtccggagtattgggac

SEQ ID NO: 17354 - DNA, 18 bp, Artificial Sequence
  Artificial sequence related to HLA knockouts in cell therapy
gtccggagtattgggacg

SEQ ID NO: 17355 - DNA, 18 bp, Artificial Sequence
  Artificial sequence related to HLA knockouts in cell therapy
tccggagtattgggacgg

SEQ ID NO: 17356 - DNA, 18 bp, Artificial Sequence
  Artificial sequence related to HLA knockouts in cell therapy
ccggagtattgggacggg

SEQ ID NO: 17357 - DNA, 18 bp, Artificial Sequence
  Artificial sequence related to HLA knockouts in cell therapy
cggagtattgggacgggg

SEQ ID NO: 17358 - DNA, 18 bp, Artificial Sequence
  Artificial sequence related to HLA knockouts in cell therapy
ggagtattgggacgggga

SEQ ID NO: 17359 - DNA, 18 bp, Artificial Sequence
  Artificial sequence related to HLA knockouts in cell therapy
gagtattgggacggggag

SEQ ID NO: 17360 - DNA, 18 bp, Artificial Sequence
  Artificial sequence related to HLA knockouts in cell therapy
gtattgggacggggagac

SEQ ID NO: 17361 - DNA, 18 bp, Artificial Sequence
  Artificial sequence related to HLA knockouts in cell therapy
attgggacggggagacac

SEQ ID NO: 17362 - DNA, 18 bp, Artificial Sequence
  Artificial sequence related to HLA knockouts in cell therapy
ttgggacggggagacacg

SEQ ID NO: 17363 - DNA, 18 bp, Artificial Sequence
  Artificial sequence related to HLA knockouts in cell therapy
tgggacggggagacacgg

SEQ ID NO: 17364 - DNA, 18 bp, Artificial Sequence
  Artificial sequence related to HLA knockouts in cell therapy
gggacggggagacacgga

SEQ ID NO: 17365 - DNA, 18 bp, Artificial Sequence
  Artificial sequence related to HLA knockouts in cell therapy
ggacggggagacacggaa

SEQ ID NO: 17366 - DNA, 18 bp, Artificial Sequence
  Artificial sequence related to HLA knockouts in cell therapy
gacggggagacacggaaa

SEQ ID NO: 17367 - DNA, 18 bp, Artificial Sequence
  Artificial sequence related to HLA knockouts in cell therapy
acggggagacacggaaag

SEQ ID NO: 17368 - DNA, 18 bp, Artificial Sequence
  Artificial sequence related to HLA knockouts in cell therapy
cggggagacacggaaagt

SEQ ID NO: 17369 - DNA, 18 bp, Artificial Sequence
  Artificial sequence related to HLA knockouts in cell therapy
ggggagacacggaaagtg

SEQ ID NO: 17370 - DNA, 18 bp, Artificial Sequence
  Artificial sequence related to HLA knockouts in cell therapy
cacggaaagtgaaggccc

SEQ ID NO: 17371 - DNA, 18 bp, Artificial Sequence
  Artificial sequence related to HLA knockouts in cell therapy
cggaaagtgaaggcccac

SEQ ID NO: 17372 - DNA, 18 bp, Artificial Sequence
  Artificial sequence related to HLA knockouts in cell therapy
gtgaaggcccactcacag

SEQ ID NO: 17373 - DNA, 18 bp, Artificial Sequence
  Artificial sequence related to HLA knockouts in cell therapy
gaaggcccactcacagac

SEQ ID NO: 17374 - DNA, 18 bp, Artificial Sequence
  Artificial sequence related to HLA knockouts in cell therapy
aggcccactcacagactc

SEQ ID NO: 17375 - DNA, 18 bp, Artificial Sequence
  Artificial sequence related to HLA knockouts in cell therapy
ggcccactcacagactca

SEQ ID NO: 17376 - DNA, 18 bp, Artificial Sequence
  Artificial sequence related to HLA knockouts in cell therapy
gcccactcacagactcac

SEQ ID NO: 17377 - DNA, 18 bp, Artificial Sequence
  Artificial sequence related to HLA knockouts in cell therapy
cccactcacagactcacc

SEQ ID NO: 17378 - DNA, 18 bp, Artificial Sequence
  Artificial sequence related to HLA knockouts in cell therapy
ccactcacagactcaccg

SEQ ID NO: 17379 - DNA, 18 bp, Artificial Sequence
  Artificial sequence related to HLA knockouts in cell therapy
cacagactcaccgagtgg

SEQ ID NO: 17380 - DNA, 18 bp, Artificial Sequence
  Artificial sequence related to HLA knockouts in cell therapy
cagactcaccgagtggac

SEQ ID NO: 17381 - DNA, 18 bp, Artificial Sequence
  Artificial sequence related to HLA knockouts in cell therapy
agactcaccgagtggacc

SEQ ID NO: 17382 - DNA, 18 bp, Artificial Sequence
  Artificial sequence related to HLA knockouts in cell therapy
gactcaccgagtggacct

SEQ ID NO: 17383 - DNA, 18 bp, Artificial Sequence
  Artificial sequence related to HLA knockouts in cell therapy
actcaccgagtggacctg

SEQ ID NO: 17384 - DNA, 18 bp, Artificial Sequence
  Artificial sequence related to HLA knockouts in cell therapy
ctcaccgagtggacctgg

SEQ ID NO: 17385 - DNA, 18 bp, Artificial Sequence
  Artificial sequence related to HLA knockouts in cell therapy
tcaccgagtggacctggg

SEQ ID NO: 17386 - DNA, 18 bp, Artificial Sequence
  Artificial sequence related to HLA knockouts in cell therapy
caccgagtggacctgggg

SEQ ID NO: 17387 - DNA, 18 bp, Artificial Sequence
  Artificial sequence related to HLA knockouts in cell therapy
accgagtggacctgggga

SEQ ID NO: 17388 - DNA, 18 bp, Artificial Sequence
  Artificial sequence related to HLA knockouts in cell therapy
ccgagtggacctggggac

SEQ ID NO: 17389 - DNA, 18 bp, Artificial Sequence
  Artificial sequence related to HLA knockouts in cell therapy
cgagtggacctggggacc

SEQ ID NO: 17390 - DNA, 18 bp, Artificial Sequence
  Artificial sequence related to HLA knockouts in cell therapy
gagtggacctggggaccc

SEQ ID NO: 17391 - DNA, 18 bp, Artificial Sequence
  Artificial sequence related to HLA knockouts in cell therapy
agtggacctggggaccct

SEQ ID NO: 17392 - DNA, 18 bp, Artificial Sequence
  Artificial sequence related to HLA knockouts in cell therapy
gtggacctggggaccctg

SEQ ID NO: 17393 - DNA, 18 bp, Artificial Sequence
  Artificial sequence related to HLA knockouts in cell therapy
tggacctggggaccctgc

SEQ ID NO: 17394 - DNA, 18 bp, Artificial Sequence
  Artificial sequence related to HLA knockouts in cell therapy
ggacctggggaccctgcg

SEQ ID NO: 17395 - DNA, 18 bp, Artificial Sequence
  Artificial sequence related to HLA knockouts in cell therapy
gacctggggaccctgcgc

SEQ ID NO: 17396 - DNA, 18 bp, Artificial Sequence
  Artificial sequence related to HLA knockouts in cell therapy
acctggggaccctgcgcg

SEQ ID NO: 17397 - DNA, 18 bp, Artificial Sequence
  Artificial sequence related to HLA knockouts in cell therapy
cctggggaccctgcgcgg

SEQ ID NO: 17398 - DNA, 18 bp, Artificial Sequence
  Artificial sequence related to HLA knockouts in cell therapy
ctggggaccctgcgcggc

SEQ ID NO: 17399 - DNA, 18 bp, Artificial Sequence
  Artificial sequence related to HLA knockouts in cell therapy
tggggaccctgcgcggct

SEQ ID NO: 17400 - DNA, 18 bp, Artificial Sequence
  Artificial sequence related to HLA knockouts in cell therapy
ggggaccctgcgcggcta

SEQ ID NO: 17401 - DNA, 18 bp, Artificial Sequence
  Artificial sequence related to HLA knockouts in cell therapy
gggaccctgcgcggctac

SEQ ID NO: 17402 - DNA, 18 bp, Artificial Sequence
  Artificial sequence related to HLA knockouts in cell therapy
ggaccctgcgcggctact

SEQ ID NO: 17403 - DNA, 18 bp, Artificial Sequence
  Artificial sequence related to HLA knockouts in cell therapy
gaccctgcgcggctacta

SEQ ID NO: 17404 - DNA, 18 bp, Artificial Sequence
  Artificial sequence related to HLA knockouts in cell therapy
accctgcgcggctactac

SEQ ID NO: 17405 - DNA, 18 bp, Artificial Sequence
  Artificial sequence related to HLA knockouts in cell therapy
ccctgcgcggctactaca

SEQ ID NO: 17406 - DNA, 18 bp, Artificial Sequence
  Artificial sequence related to HLA knockouts in cell therapy
cctgcgcggctactacaa

SEQ ID NO: 17407 - DNA, 18 bp, Artificial Sequence
  Artificial sequence related to HLA knockouts in cell therapy
ctgcgcggctactacaac

SEQ ID NO: 17408 - DNA, 18 bp, Artificial Sequence
  Artificial sequence related to HLA knockouts in cell therapy
tgcgcggctactacaacc

SEQ ID NO: 17409 - DNA, 18 bp, Artificial Sequence
  Artificial sequence related to HLA knockouts in cell therapy
gcgcggctactacaacca

SEQ ID NO: 17410 - DNA, 18 bp, Artificial Sequence
  Artificial sequence related to HLA knockouts in cell therapy
cgcggctactacaaccag

SEQ ID NO: 17411 - DNA, 18 bp, Artificial Sequence
  Artificial sequence related to HLA knockouts in cell therapy
ctacaaccagagcgaggc

SEQ ID NO: 17412 - DNA, 18 bp, Artificial Sequence
  Artificial sequence related to HLA knockouts in cell therapy
tacaaccagagcgaggcc

SEQ ID NO: 17413 - DNA, 18 bp, Artificial Sequence
  Artificial sequence related to HLA knockouts in cell therapy
acaaccagagcgaggccg

SEQ ID NO: 17414 - DNA, 18 bp, Artificial Sequence
  Artificial sequence related to HLA knockouts in cell therapy
caaccagagcgaggccgg

SEQ ID NO: 17415 - DNA, 18 bp, Artificial Sequence
  Artificial sequence related to HLA knockouts in cell therapy
aaccagagcgaggccggt

SEQ ID NO: 17416 - DNA, 18 bp, Artificial Sequence
  Artificial sequence related to HLA knockouts in cell therapy
accagagcgaggccggtt

SEQ ID NO: 17417 - DNA, 18 bp, Artificial Sequence
  Artificial sequence related to HLA knockouts in cell therapy
ccagagcgaggccggttc

SEQ ID NO: 17418 - DNA, 18 bp, Artificial Sequence
  Artificial sequence related to HLA knockouts in cell therapy
cagagcgaggccggttct

SEQ ID NO: 17419 - DNA, 18 bp, Artificial Sequence
  Artificial sequence related to HLA knockouts in cell therapy
agagcgaggccggttctc

SEQ ID NO: 17420 - DNA, 18 bp, Artificial Sequence
  Artificial sequence related to HLA knockouts in cell therapy
gagcgaggccggttctca

SEQ ID NO: 17421 - DNA, 18 bp, Artificial Sequence
  Artificial sequence related to HLA knockouts in cell therapy
agcgaggccggttctcac

SEQ ID NO: 17422 - DNA, 18 bp, Artificial Sequence
  Artificial sequence related to HLA knockouts in cell therapy
gcgaggccggttctcaca

SEQ ID NO: 17423 - DNA, 18 bp, Artificial Sequence
  Artificial sequence related to HLA knockouts in cell therapy
cgaggccggttctcacac

SEQ ID NO: 17424 - DNA, 18 bp, Artificial Sequence
  Artificial sequence related to HLA knockouts in cell therapy
gaggccggttctcacacc

SEQ ID NO: 17425 - DNA, 18 bp, Artificial Sequence
  Artificial sequence related to HLA knockouts in cell therapy
aggccggttctcacaccg

SEQ ID NO: 17426 - DNA, 18 bp, Artificial Sequence
  Artificial sequence related to HLA knockouts in cell therapy
ggccggttctcacaccgt

SEQ ID NO: 17427 - DNA, 18 bp, Artificial Sequence
  Artificial sequence related to HLA knockouts in cell therapy
gccggttctcacaccgtc

SEQ ID NO: 17428 - DNA, 18 bp, Artificial Sequence
  Artificial sequence related to HLA knockouts in cell therapy
ccggttctcacaccgtcc

SEQ ID NO: 17429 - DNA, 18 bp, Artificial Sequence
  Artificial sequence related to HLA knockouts in cell therapy
cggttctcacaccgtcca

SEQ ID NO: 17430 - DNA, 18 bp, Artificial Sequence
  Artificial sequence related to HLA knockouts in cell therapy
ggttctcacaccgtccag

SEQ ID NO: 17431 - DNA, 18 bp, Artificial Sequence
  Artificial sequence related to HLA knockouts in cell therapy
tctcacaccgtccagagg

SEQ ID NO: 17432 - DNA, 18 bp, Artificial Sequence
  Artificial sequence related to HLA knockouts in cell therapy
ctcacaccgtccagagga

SEQ ID NO: 17433 - DNA, 18 bp, Artificial Sequence
  Artificial sequence related to HLA knockouts in cell therapy
cacaccgtccagaggatg

SEQ ID NO: 17434 - DNA, 18 bp, Artificial Sequence
  Artificial sequence related to HLA knockouts in cell therapy
ggatgtatggctgcgacg

SEQ ID NO: 17435 - DNA, 18 bp, Artificial Sequence
  Artificial sequence related to HLA knockouts in cell therapy
tgtatggctgcgacgtgg

SEQ ID NO: 17436 - DNA, 18 bp, Artificial Sequence
  Artificial sequence related to HLA knockouts in cell therapy
gtatggctgcgacgtggg

SEQ ID NO: 17437 - DNA, 18 bp, Artificial Sequence
  Artificial sequence related to HLA knockouts in cell therapy
tatggctgcgacgtgggg

SEQ ID NO: 17438 - DNA, 18 bp, Artificial Sequence
  Artificial sequence related to HLA knockouts in cell therapy
atggctgcgacgtggggt

SEQ ID NO: 17439 - DNA, 18 bp, Artificial Sequence
  Artificial sequence related to HLA knockouts in cell therapy
tggctgcgacgtggggtc

SEQ ID NO: 17440 - DNA, 18 bp, Artificial Sequence
  Artificial sequence related to HLA knockouts in cell therapy
ggctgcgacgtggggtcg

SEQ ID NO: 17441 - DNA, 18 bp, Artificial Sequence
  Artificial sequence related to HLA knockouts in cell therapy
gctgcgacgtggggtcgg

SEQ ID NO: 17442 - DNA, 18 bp, Artificial Sequence
  Artificial sequence related to HLA knockouts in cell therapy
ctgcgacgtggggtcgga

SEQ ID NO: 17443 - DNA, 18 bp, Artificial Sequence
  Artificial sequence related to HLA knockouts in cell therapy
tgcgacgtggggtcggac

SEQ ID NO: 17444 - DNA, 18 bp, Artificial Sequence
  Artificial sequence related to HLA knockouts in cell therapy
gcgacgtggggtcggact

SEQ ID NO: 17445 - DNA, 18 bp, Artificial Sequence
  Artificial sequence related to HLA knockouts in cell therapy
cgacgtggggtcggactg

SEQ ID NO: 17446 - DNA, 18 bp, Artificial Sequence
  Artificial sequence related to HLA knockouts in cell therapy
gacgtggggtcggactgg

SEQ ID NO: 17447 - DNA, 18 bp, Artificial Sequence
  Artificial sequence related to HLA knockouts in cell therapy
acgtggggtcggactggc

SEQ ID NO: 17448 - DNA, 18 bp, Artificial Sequence
  Artificial sequence related to HLA knockouts in cell therapy
cgtggggtcggactggcg

SEQ ID NO: 17449 - DNA, 18 bp, Artificial Sequence
  Artificial sequence related to HLA knockouts in cell therapy
gtggggtcggactggcgc

SEQ ID NO: 17450 - DNA, 18 bp, Artificial Sequence
  Artificial sequence related to HLA knockouts in cell therapy
tggggtcggactggcgct

SEQ ID NO: 17451 - DNA, 18 bp, Artificial Sequence
  Artificial sequence related to HLA knockouts in cell therapy
ggggtcggactggcgctt

SEQ ID NO: 17452 - DNA, 18 bp, Artificial Sequence
  Artificial sequence related to HLA knockouts in cell therapy
gggtcggactggcgcttc

SEQ ID NO: 17453 - DNA, 18 bp, Artificial Sequence
  Artificial sequence related to HLA knockouts in cell therapy
ggtcggactggcgcttcc

SEQ ID NO: 17454 - DNA, 18 bp, Artificial Sequence
  Artificial sequence related to HLA knockouts in cell therapy
gtcggactggcgcttcct

SEQ ID NO: 17455 - DNA, 18 bp, Artificial Sequence
  Artificial sequence related to HLA knockouts in cell therapy
tcggactggcgcttcctc

SEQ ID NO: 17456 - DNA, 18 bp, Artificial Sequence
  Artificial sequence related to HLA knockouts in cell therapy
cggactggcgcttcctcc

SEQ ID NO: 17457 - DNA, 18 bp, Artificial Sequence
  Artificial sequence related to HLA knockouts in cell therapy
ggactggcgcttcctccg

SEQ ID NO: 17458 - DNA, 18 bp, Artificial Sequence
  Artificial sequence related to HLA knockouts in cell therapy
gactggcgcttcctccgc

SEQ ID NO: 17459 - DNA, 18 bp, Artificial Sequence
  Artificial sequence related to HLA knockouts in cell therapy
actggcgcttcctccgcg

SEQ ID NO: 17460 - DNA, 18 bp, Artificial Sequence
  Artificial sequence related to HLA knockouts in cell therapy
ctggcgcttcctccgcgg

SEQ ID NO: 17461 - DNA, 18 bp, Artificial Sequence
  Artificial sequence related to HLA knockouts in cell therapy
tggcgcttcctccgcggg

SEQ ID NO: 17462 - DNA, 18 bp, Artificial Sequence
  Artificial sequence related to HLA knockouts in cell therapy
ggcgcttcctccgcgggt

SEQ ID NO: 17463 - DNA, 18 bp, Artificial Sequence
  Artificial sequence related to HLA knockouts in cell therapy
gcgcttcctccgcgggta

SEQ ID NO: 17464 - DNA, 18 bp, Artificial Sequence
  Artificial sequence related to HLA knockouts in cell therapy
cgcttcctccgcgggtac

SEQ ID NO: 17465 - DNA, 18 bp, Artificial Sequence
  Artificial sequence related to HLA knockouts in cell therapy
gcttcctccgcgggtacc

SEQ ID NO: 17466 - DNA, 18 bp, Artificial Sequence
  Artificial sequence related to HLA knockouts in cell therapy
cttcctccgcgggtacca

SEQ ID NO: 17467 - DNA, 18 bp, Artificial Sequence
  Artificial sequence related to HLA knockouts in cell therapy
ttcctccgcgggtaccac

SEQ ID NO: 17468 - DNA, 18 bp, Artificial Sequence
  Artificial sequence related to HLA knockouts in cell therapy
tcctccgcgggtaccacc

SEQ ID NO: 17469 - DNA, 18 bp, Artificial Sequence
  Artificial sequence related to HLA knockouts in cell therapy
cctccgcgggtaccacca

SEQ ID NO: 17470 - DNA, 18 bp, Artificial Sequence
  Artificial sequence related to HLA knockouts in cell therapy
ctccgcgggtaccaccag

SEQ ID NO: 17471 - DNA, 18 bp, Artificial Sequence
  Artificial sequence related to HLA knockouts in cell therapy
tccgcgggtaccaccagt

SEQ ID NO: 17472 - DNA, 18 bp, Artificial Sequence
  Artificial sequence related to HLA knockouts in cell therapy
ccgcgggtaccaccagta

SEQ ID NO: 17473 - DNA, 18 bp, Artificial Sequence
  Artificial sequence related to HLA knockouts in cell therapy
cgcgggtaccaccagtac

SEQ ID NO: 17474 - DNA, 18 bp, Artificial Sequence
  Artificial sequence related to HLA knockouts in cell therapy
gcgggtaccaccagtacg

SEQ ID NO: 17475 - DNA, 18 bp, Artificial Sequence
  Artificial sequence related to HLA knockouts in cell therapy
cgggtaccaccagtacgc

SEQ ID NO: 17476 - DNA, 18 bp, Artificial Sequence
  Artificial sequence related to HLA knockouts in cell therapy
gggtaccaccagtacgcc

SEQ ID NO: 17477 - DNA, 18 bp, Artificial Sequence
  Artificial sequence related to HLA knockouts in cell therapy
ggtaccaccagtacgcct

SEQ ID NO: 17478 - DNA, 18 bp, Artificial Sequence
  Artificial sequence related to HLA knockouts in cell therapy
accaccagtacgcctacg

SEQ ID NO: 17479 - DNA, 18 bp, Artificial Sequence
  Artificial sequence related to HLA knockouts in cell therapy
ccaccagtacgcctacga

SEQ ID NO: 17480 - DNA, 18 bp, Artificial Sequence
  Artificial sequence related to HLA knockouts in cell therapy
caccagtacgcctacgac

SEQ ID NO: 17481 - DNA, 18 bp, Artificial Sequence
  Artificial sequence related to HLA knockouts in cell therapy
accagtacgcctacgacg

SEQ ID NO: 17482 - DNA, 18 bp, Artificial Sequence
  Artificial sequence related to HLA knockouts in cell therapy
ccagtacgcctacgacgg

SEQ ID NO: 17483 - DNA, 18 bp, Artificial Sequence
  Artificial sequence related to HLA knockouts in cell therapy
cagtacgcctacgacggc

SEQ ID NO: 17484 - DNA, 18 bp, Artificial Sequence
  Artificial sequence related to HLA knockouts in cell therapy
agtacgcctacgacggca

SEQ ID NO: 17485 - DNA, 18 bp, Artificial Sequence
  Artificial sequence related to HLA knockouts in cell therapy
gtacgcctacgacggcaa

SEQ ID NO: 17486 - DNA, 18 bp, Artificial Sequence
  Artificial sequence related to HLA knockouts in cell therapy
tacgcctacgacggcaag

SEQ ID NO: 17487 - DNA, 18 bp, Artificial Sequence
  Artificial sequence related to HLA knockouts in cell therapy
acgcctacgacggcaagg

SEQ ID NO: 17488 - DNA, 18 bp, Artificial Sequence
  Artificial sequence related to HLA knockouts in cell therapy
cgcctacgacggcaagga

SEQ ID NO: 17489 - DNA, 18 bp, Artificial Sequence
  Artificial sequence related to HLA knockouts in cell therapy
gcctacgacggcaaggat

SEQ ID NO: 17490 - DNA, 18 bp, Artificial Sequence
  Artificial sequence related to HLA knockouts in cell therapy
tcgccctgaaagaggacc

SEQ ID NO: 17491 - DNA, 18 bp, Artificial Sequence
  Artificial sequence related to HLA knockouts in cell therapy
cgccctgaaagaggacct

SEQ ID NO: 17492 - DNA, 18 bp, Artificial Sequence
  Artificial sequence related to HLA knockouts in cell therapy
gccctgaaagaggacctg

SEQ ID NO: 17493 - DNA, 18 bp, Artificial Sequence
  Artificial sequence related to HLA knockouts in cell therapy
ccctgaaagaggacctgc

SEQ ID NO: 17494 - DNA, 18 bp, Artificial Sequence
  Artificial sequence related to HLA knockouts in cell therapy
cctgaaagaggacctgcg

SEQ ID NO: 17495 - DNA, 18 bp, Artificial Sequence
  Artificial sequence related to HLA knockouts in cell therapy
ctgaaagaggacctgcgc

SEQ ID NO: 17496 - DNA, 18 bp, Artificial Sequence
  Artificial sequence related to HLA knockouts in cell therapy
gaaagaggacctgcgctc

SEQ ID NO: 17497 - DNA, 18 bp, Artificial Sequence
  Artificial sequence related to HLA knockouts in cell therapy
agaggacctgcgctcttg

SEQ ID NO: 17498 - DNA, 18 bp, Artificial Sequence
  Artificial sequence related to HLA knockouts in cell therapy
gaggacctgcgctcttgg

SEQ ID NO: 17499 - DNA, 18 bp, Artificial Sequence
  Artificial sequence related to HLA knockouts in cell therapy
aggacctgcgctcttgga

SEQ ID NO: 17500 - DNA, 18 bp, Artificial Sequence
  Artificial sequence related to HLA knockouts in cell therapy
ggacctgcgctcttggac

SEQ ID NO: 17501 - DNA, 18 bp, Artificial Sequence
  Artificial sequence related to HLA knockouts in cell therapy
gacctgcgctcttggacc

SEQ ID NO: 17502 - DNA, 18 bp, Artificial Sequence
  Artificial sequence related to HLA knockouts in cell therapy
acctgcgctcttggaccg

SEQ ID NO: 17503 - DNA, 18 bp, Artificial Sequence
  Artificial sequence related to HLA knockouts in cell therapy
cctgcgctcttggaccgc

SEQ ID NO: 17504 - DNA, 18 bp, Artificial Sequence
  Artificial sequence related to HLA knockouts in cell therapy
ctgcgctcttggaccgcg

SEQ ID NO: 17505 - DNA, 18 bp, Artificial Sequence
  Artificial sequence related to HLA knockouts in cell therapy
tgcgctcttggaccgcgg

SEQ ID NO: 17506 - DNA, 18 bp, Artificial Sequence
  Artificial sequence related to HLA knockouts in cell therapy
gcgctcttggaccgcggc

SEQ ID NO: 17507 - DNA, 18 bp, Artificial Sequence
  Artificial sequence related to HLA knockouts in cell therapy
cgctcttggaccgcggcg

SEQ ID NO: 17508 - DNA, 18 bp, Artificial Sequence
  Artificial sequence related to HLA knockouts in cell therapy
gctcttggaccgcggcgg

SEQ ID NO: 17509 - DNA, 18 bp, Artificial Sequence
  Artificial sequence related to HLA knockouts in cell therapy
ctcttggaccgcggcgga

SEQ ID NO: 17510 - DNA, 18 bp, Artificial Sequence
  Artificial sequence related to HLA knockouts in cell therapy
tcttggaccgcggcggac

SEQ ID NO: 17511 - DNA, 18 bp, Artificial Sequence
  Artificial sequence related to HLA knockouts in cell therapy
cttggaccgcggcggaca

SEQ ID NO: 17512 - DNA, 18 bp, Artificial Sequence
  Artificial sequence related to HLA knockouts in cell therapy
ttggaccgcggcggacat

SEQ ID NO: 17513 - DNA, 18 bp, Artificial Sequence
  Artificial sequence related to HLA knockouts in cell therapy
tggaccgcggcggacatg

SEQ ID NO: 17514 - DNA, 18 bp, Artificial Sequence
  Artificial sequence related to HLA knockouts in cell therapy
ggaccgcggcggacatgg

SEQ ID NO: 17515 - DNA, 18 bp, Artificial Sequence
  Artificial sequence related to HLA knockouts in cell therapy
gaccgcggcggacatggc

SEQ ID NO: 17516 - DNA, 18 bp, Artificial Sequence
  Artificial sequence related to HLA knockouts in cell therapy
accgcggcggacatggca

SEQ ID NO: 17517 - DNA, 18 bp, Artificial Sequence
  Artificial sequence related to HLA knockouts in cell therapy
ccgcggcggacatggcag

SEQ ID NO: 17518 - DNA, 18 bp, Artificial Sequence
  Artificial sequence related to HLA knockouts in cell therapy
cgcggcggacatggcagc

SEQ ID NO: 17519 - DNA, 18 bp, Artificial Sequence
  Artificial sequence related to HLA knockouts in cell therapy
gcggcggacatggcagct

SEQ ID NO: 17520 - DNA, 18 bp, Artificial Sequence
  Artificial sequence related to HLA knockouts in cell therapy
cggcggacatggcagctc

SEQ ID NO: 17521 - DNA, 18 bp, Artificial Sequence
  Artificial sequence related to HLA knockouts in cell therapy
ggcggacatggcagctca

SEQ ID NO: 17522 - DNA, 18 bp, Artificial Sequence
  Artificial sequence related to HLA knockouts in cell therapy
gcggacatggcagctcag

SEQ ID NO: 17523 - DNA, 18 bp, Artificial Sequence
  Artificial sequence related to HLA knockouts in cell therapy
cggacatggcagctcaga

SEQ ID NO: 17524 - DNA, 18 bp, Artificial Sequence
  Artificial sequence related to HLA knockouts in cell therapy
ggacatggcagctcagac

SEQ ID NO: 17525 - DNA, 18 bp, Artificial Sequence
  Artificial sequence related to HLA knockouts in cell therapy
gacatggcagctcagacc

SEQ ID NO: 17526 - DNA, 18 bp, Artificial Sequence
  Artificial sequence related to HLA knockouts in cell therapy
catggcagctcagaccac

SEQ ID NO: 17527 - DNA, 18 bp, Artificial Sequence
  Artificial sequence related to HLA knockouts in cell therapy
atggcagctcagaccacc

SEQ ID NO: 17528 - DNA, 18 bp, Artificial Sequence
  Artificial sequence related to HLA knockouts in cell therapy
tggcagctcagaccacca

SEQ ID NO: 17529 - DNA, 18 bp, Artificial Sequence
  Artificial sequence related to HLA knockouts in cell therapy
ggcagctcagaccaccaa

SEQ ID NO: 17530 - DNA, 18 bp, Artificial Sequence
  Artificial sequence related to HLA knockouts in cell therapy
gcagctcagaccaccaag

SEQ ID NO: 17531 - DNA, 18 bp, Artificial Sequence
  Artificial sequence related to HLA knockouts in cell therapy
cagctcagaccaccaagc

SEQ ID NO: 17532 - DNA, 18 bp, Artificial Sequence
  Artificial sequence related to HLA knockouts in cell therapy
gctcagaccaccaagcac

SEQ ID NO: 17533 - DNA, 18 bp, Artificial Sequence
  Artificial sequence related to HLA knockouts in cell therapy
ccaccaagcacaagtggg

SEQ ID NO: 17534 - DNA, 18 bp, Artificial Sequence
  Artificial sequence related to HLA knockouts in cell therapy
ccaagcacaagtgggagg

SEQ ID NO: 17535 - DNA, 18 bp, Artificial Sequence
  Artificial sequence related to HLA knockouts in cell therapy
caagcacaagtgggaggc

SEQ ID NO: 17536 - DNA, 18 bp, Artificial Sequence
  Artificial sequence related to HLA knockouts in cell therapy
aagcacaagtgggaggcg

SEQ ID NO: 17537 - DNA, 18 bp, Artificial Sequence
  Artificial sequence related to HLA knockouts in cell therapy
agcacaagtgggaggcgg

SEQ ID NO: 17538 - DNA, 18 bp, Artificial Sequence
  Artificial sequence related to HLA knockouts in cell therapy
gcacaagtgggaggcggc

SEQ ID NO: 17539 - DNA, 18 bp, Artificial Sequence
  Artificial sequence related to HLA knockouts in cell therapy
cacaagtgggaggcggcc

SEQ ID NO: 17540 - DNA, 18 bp, Artificial Sequence
  Artificial sequence related to HLA knockouts in cell therapy
acaagtgggaggcggccc

SEQ ID NO: 17541 - DNA, 18 bp, Artificial Sequence
  Artificial sequence related to HLA knockouts in cell therapy
caagtgggaggcggccca

SEQ ID NO: 17542 - DNA, 18 bp, Artificial Sequence
  Artificial sequence related to HLA knockouts in cell therapy
aagtgggaggcggcccat

SEQ ID NO: 17543 - DNA, 18 bp, Artificial Sequence
  Artificial sequence related to HLA knockouts in cell therapy
agtgggaggcggcccatg

SEQ ID NO: 17544 - DNA, 18 bp, Artificial Sequence
  Artificial sequence related to HLA knockouts in cell therapy
gtgggaggcggcccatgt

SEQ ID NO: 17545 - DNA, 18 bp, Artificial Sequence
  Artificial sequence related to HLA knockouts in cell therapy
tgggaggcggcccatgtg

SEQ ID NO: 17546 - DNA, 18 bp, Artificial Sequence
  Artificial sequence related to HLA knockouts in cell therapy
gggaggcggcccatgtgg

SEQ ID NO: 17547 - DNA, 18 bp, Artificial Sequence
  Artificial sequence related to HLA knockouts in cell therapy
ggaggcggcccatgtggc

SEQ ID NO: 17548 - DNA, 18 bp, Artificial Sequence
  Artificial sequence related to HLA knockouts in cell therapy
gaggcggcccatgtggcg

SEQ ID NO: 17549 - DNA, 18 bp, Artificial Sequence
  Artificial sequence related to HLA knockouts in cell therapy
aggcggcccatgtggcgg

SEQ ID NO: 17550 - DNA, 18 bp, Artificial Sequence
  Artificial sequence related to HLA knockouts in cell therapy
ggcggcccatgtggcgga

SEQ ID NO: 17551 - DNA, 18 bp, Artificial Sequence
  Artificial sequence related to HLA knockouts in cell therapy
gcggcccatgtggcggag

SEQ ID NO: 17552 - DNA, 18 bp, Artificial Sequence
  Artificial sequence related to HLA knockouts in cell therapy
cggcccatgtggcggagc

SEQ ID NO: 17553 - DNA, 18 bp, Artificial Sequence
  Artificial sequence related to HLA knockouts in cell therapy
ggcccatgtggcggagca

SEQ ID NO: 17554 - DNA, 18 bp, Artificial Sequence
  Artificial sequence related to HLA knockouts in cell therapy
gcccatgtggcggagcag

SEQ ID NO: 17555 - DNA, 18 bp, Artificial Sequence
  Artificial sequence related to HLA knockouts in cell therapy
cccatgtggcggagcagt

SEQ ID NO: 17556 - DNA, 18 bp, Artificial Sequence
  Artificial sequence related to HLA knockouts in cell therapy
ccatgtggcggagcagtt

SEQ ID NO: 17557 - DNA, 18 bp, Artificial Sequence
  Artificial sequence related to HLA knockouts in cell therapy
catgtggcggagcagttg

SEQ ID NO: 17558 - DNA, 18 bp, Artificial Sequence
  Artificial sequence related to HLA knockouts in cell therapy
tgtggcggagcagttgag

SEQ ID NO: 17559 - DNA, 18 bp, Artificial Sequence
  Artificial sequence related to HLA knockouts in cell therapy
gtggcggagcagttgaga

SEQ ID NO: 17560 - DNA, 18 bp, Artificial Sequence
  Artificial sequence related to HLA knockouts in cell therapy
tggcggagcagttgagag

SEQ ID NO: 17561 - DNA, 18 bp, Artificial Sequence
  Artificial sequence related to HLA knockouts in cell therapy
ggcggagcagttgagagc

SEQ ID NO: 17562 - DNA, 18 bp, Artificial Sequence
  Artificial sequence related to HLA knockouts in cell therapy
gcggagcagttgagagcc

SEQ ID NO: 17563 - DNA, 18 bp, Artificial Sequence
  Artificial sequence related to HLA knockouts in cell therapy
cggagcagttgagagcct

SEQ ID NO: 17564 - DNA, 18 bp, Artificial Sequence
  Artificial sequence related to HLA knockouts in cell therapy
tgagagcctacctggagg

SEQ ID NO: 17565 - DNA, 18 bp, Artificial Sequence
  Artificial sequence related to HLA knockouts in cell therapy
gagagcctacctggaggg

SEQ ID NO: 17566 - DNA, 18 bp, Artificial Sequence
  Artificial sequence related to HLA knockouts in cell therapy
agagcctacctggagggc

SEQ ID NO: 17567 - DNA, 18 bp, Artificial Sequence
  Artificial sequence related to HLA knockouts in cell therapy
gagcctacctggagggca

SEQ ID NO: 17568 - DNA, 18 bp, Artificial Sequence
  Artificial sequence related to HLA knockouts in cell therapy
agcctacctggagggcac

SEQ ID NO: 17569 - DNA, 18 bp, Artificial Sequence
  Artificial sequence related to HLA knockouts in cell therapy
gcctacctggagggcacg

SEQ ID NO: 17570 - DNA, 18 bp, Artificial Sequence
  Artificial sequence related to HLA knockouts in cell therapy
cctacctggagggcacgt

SEQ ID NO: 17571 - DNA, 18 bp, Artificial Sequence
  Artificial sequence related to HLA knockouts in cell therapy
ctacctggagggcacgtg

SEQ ID NO: 17572 - DNA, 18 bp, Artificial Sequence
  Artificial sequence related to HLA knockouts in cell therapy
tacctggagggcacgtgc

SEQ ID NO: 17573 - DNA, 18 bp, Artificial Sequence
  Artificial sequence related to HLA knockouts in cell therapy
acctggagggcacgtgcg

SEQ ID NO: 17574 - DNA, 18 bp, Artificial Sequence
  Artificial sequence related to HLA knockouts in cell therapy
cctggagggcacgtgcgt

SEQ ID NO: 17575 - DNA, 18 bp, Artificial Sequence
  Artificial sequence related to HLA knockouts in cell therapy
ctggagggcacgtgcgtg

SEQ ID NO: 17576 - DNA, 18 bp, Artificial Sequence
  Artificial sequence related to HLA knockouts in cell therapy
tggagggcacgtgcgtgg

SEQ ID NO: 17577 - DNA, 18 bp, Artificial Sequence
  Artificial sequence related to HLA knockouts in cell therapy
ggagggcacgtgcgtgga

SEQ ID NO: 17578 - DNA, 18 bp, Artificial Sequence
  Artificial sequence related to HLA knockouts in cell therapy
gagggcacgtgcgtggag

SEQ ID NO: 17579 - DNA, 18 bp, Artificial Sequence
  Artificial sequence related to HLA knockouts in cell therapy
agggcacgtgcgtggagt

SEQ ID NO: 17580 - DNA, 18 bp, Artificial Sequence
  Artificial sequence related to HLA knockouts in cell therapy
gggcacgtgcgtggagtg

SEQ ID NO: 17581 - DNA, 18 bp, Artificial Sequence
  Artificial sequence related to HLA knockouts in cell therapy
ggcacgtgcgtggagtgg

SEQ ID NO: 17582 - DNA, 18 bp, Artificial Sequence
  Artificial sequence related to HLA knockouts in cell therapy
gcacgtgcgtggagtggc

SEQ ID NO: 17583 - DNA, 18 bp, Artificial Sequence
  Artificial sequence related to HLA knockouts in cell therapy
cacgtgcgtggagtggct

SEQ ID NO: 17584 - DNA, 18 bp, Artificial Sequence
  Artificial sequence related to HLA knockouts in cell therapy
acgtgcgtggagtggctc

SEQ ID NO: 17585 - DNA, 18 bp, Artificial Sequence
  Artificial sequence related to HLA knockouts in cell therapy
cgtgcgtggagtggctcc

SEQ ID NO: 17586 - DNA, 18 bp, Artificial Sequence
  Artificial sequence related to HLA knockouts in cell therapy
gtgcgtggagtggctccg

SEQ ID NO: 17587 - DNA, 18 bp, Artificial Sequence
  Artificial sequence related to HLA knockouts in cell therapy
tgcgtggagtggctccgc

SEQ ID NO: 17588 - DNA, 18 bp, Artificial Sequence
  Artificial sequence related to HLA knockouts in cell therapy
gcgtggagtggctccgca

SEQ ID NO: 17589 - DNA, 18 bp, Artificial Sequence
  Artificial sequence related to HLA knockouts in cell therapy
cgtggagtggctccgcag

SEQ ID NO: 17590 - DNA, 18 bp, Artificial Sequence
  Artificial sequence related to HLA knockouts in cell therapy
gtggagtggctccgcaga

SEQ ID NO: 17591 - DNA, 18 bp, Artificial Sequence
  Artificial sequence related to HLA knockouts in cell therapy
tggagtggctccgcagat

SEQ ID NO: 17592 - DNA, 18 bp, Artificial Sequence
  Artificial sequence related to HLA knockouts in cell therapy
ggagtggctccgcagata

SEQ ID NO: 17593 - DNA, 18 bp, Artificial Sequence
  Artificial sequence related to HLA knockouts in cell therapy
gagtggctccgcagatac

SEQ ID NO: 17594 - DNA, 18 bp, Artificial Sequence
  Artificial sequence related to HLA knockouts in cell therapy
agtggctccgcagatacc

SEQ ID NO: 17595 - DNA, 18 bp, Artificial Sequence
  Artificial sequence related to HLA knockouts in cell therapy
gtggctccgcagatacct

SEQ ID NO: 17596 - DNA, 18 bp, Artificial Sequence
  Artificial sequence related to HLA knockouts in cell therapy
tggctccgcagatacctg

SEQ ID NO: 17597 - DNA, 18 bp, Artificial Sequence
  Artificial sequence related to HLA knockouts in cell therapy
ggctccgcagatacctgg

SEQ ID NO: 17598 - DNA, 18 bp, Artificial Sequence
  Artificial sequence related to HLA knockouts in cell therapy
gctccgcagatacctgga

SEQ ID NO: 17599 - DNA, 18 bp, Artificial Sequence
  Artificial sequence related to HLA knockouts in cell therapy
ctccgcagatacctggag

SEQ ID NO: 17600 - DNA, 18 bp, Artificial Sequence
  Artificial sequence related to HLA knockouts in cell therapy
acctggagaacgggaagg

SEQ ID NO: 17601 - DNA, 18 bp, Artificial Sequence
  Artificial sequence related to HLA knockouts in cell therapy
cctggagaacgggaagga

SEQ ID NO: 17602 - DNA, 18 bp, Artificial Sequence
  Artificial sequence related to HLA knockouts in cell therapy
ctggagaacgggaaggag

SEQ ID NO: 17603 - DNA, 18 bp, Artificial Sequence
  Artificial sequence related to HLA knockouts in cell therapy
ggagaacgggaaggagac

SEQ ID NO: 17604 - DNA, 18 bp, Artificial Sequence
  Artificial sequence related to HLA knockouts in cell therapy
gagaacgggaaggagacg

SEQ ID NO: 17605 - DNA, 18 bp, Artificial Sequence
  Artificial sequence related to HLA knockouts in cell therapy
agaacgggaaggagacgc

SEQ ID NO: 17606 - DNA, 18 bp, Artificial Sequence
  Artificial sequence related to HLA knockouts in cell therapy
gaacgggaaggagacgct

SEQ ID NO: 17607 - DNA, 18 bp, Artificial Sequence
  Artificial sequence related to HLA knockouts in cell therapy
aacgggaaggagacgctg

SEQ ID NO: 17608 - DNA, 18 bp, Artificial Sequence
  Artificial sequence related to HLA knockouts in cell therapy
acgggaaggagacgctgc

SEQ ID NO: 17609 - DNA, 18 bp, Artificial Sequence
  Artificial sequence related to HLA knockouts in cell therapy
cgggaaggagacgctgca

SEQ ID NO: 17610 - DNA, 18 bp, Artificial Sequence
  Artificial sequence related to HLA knockouts in cell therapy
gggaaggagacgctgcag

SEQ ID NO: 17611 - DNA, 18 bp, Artificial Sequence
  Artificial sequence related to HLA knockouts in cell therapy
ggaaggagacgctgcagc

SEQ ID NO: 17612 - DNA, 18 bp, Artificial Sequence
  Artificial sequence related to HLA knockouts in cell therapy
gaaggagacgctgcagcg

SEQ ID NO: 17613 - DNA, 18 bp, Artificial Sequence
  Artificial sequence related to HLA knockouts in cell therapy
aaggagacgctgcagcgc

SEQ ID NO: 17614 - DNA, 18 bp, Artificial Sequence
  Artificial sequence related to HLA knockouts in cell therapy
aggagacgctgcagcgca

SEQ ID NO: 17615 - DNA, 18 bp, Artificial Sequence
  Artificial sequence related to HLA knockouts in cell therapy
ggagacgctgcagcgcac

SEQ ID NO: 17616 - DNA, 18 bp, Artificial Sequence
  Artificial sequence related to HLA knockouts in cell therapy
gagacgctgcagcgcacg

SEQ ID NO: 17617 - DNA, 18 bp, Artificial Sequence
  Artificial sequence related to HLA knockouts in cell therapy
agacgctgcagcgcacgg

SEQ ID NO: 17618 - DNA, 18 bp, Artificial Sequence
  Artificial sequence related to HLA knockouts in cell therapy
gacgctgcagcgcacgga

SEQ ID NO: 17619 - DNA, 18 bp, Artificial Sequence
  Artificial sequence related to HLA knockouts in cell therapy
acgctgcagcgcacggac

SEQ ID NO: 17620 - DNA, 18 bp, Artificial Sequence
  Artificial sequence related to HLA knockouts in cell therapy
cgctgcagcgcacggacg

SEQ ID NO: 17621 - DNA, 18 bp, Artificial Sequence
  Artificial sequence related to HLA knockouts in cell therapy
gctgcagcgcacggacgc

SEQ ID NO: 17622 - DNA, 18 bp, Artificial Sequence
  Artificial sequence related to HLA knockouts in cell therapy
ctgcagcgcacggacgcc

SEQ ID NO: 17623 - DNA, 18 bp, Artificial Sequence
  Artificial sequence related to HLA knockouts in cell therapy
tgcagcgcacggacgccc

SEQ ID NO: 17624 - DNA, 18 bp, Artificial Sequence
  Artificial sequence related to HLA knockouts in cell therapy
gcagcgcacggacgcccc

SEQ ID NO: 17625 - DNA, 18 bp, Artificial Sequence
  Artificial sequence related to HLA knockouts in cell therapy
cagcgcacggacgccccc

SEQ ID NO: 17626 - DNA, 18 bp, Artificial Sequence
  Artificial sequence related to HLA knockouts in cell therapy
agcgcacggacgccccca

SEQ ID NO: 17627 - DNA, 18 bp, Artificial Sequence
  Artificial sequence related to HLA knockouts in cell therapy
gcgcacggacgcccccaa

SEQ ID NO: 17628 - DNA, 18 bp, Artificial Sequence
  Artificial sequence related to HLA knockouts in cell therapy
cgcacggacgcccccaaa

SEQ ID NO: 17629 - DNA, 18 bp, Artificial Sequence
  Artificial sequence related to HLA knockouts in cell therapy
gcacggacgcccccaaaa

SEQ ID NO: 17630 - DNA, 18 bp, Artificial Sequence
  Artificial sequence related to HLA knockouts in cell therapy
cacggacgcccccaaaac

SEQ ID NO: 17631 - DNA, 18 bp, Artificial Sequence
  Artificial sequence related to HLA knockouts in cell therapy
acggacgcccccaaaacg

SEQ ID NO: 17632 - DNA, 18 bp, Artificial Sequence
  Artificial sequence related to HLA knockouts in cell therapy
cggacgcccccaaaacgc

SEQ ID NO: 17633 - DNA, 18 bp, Artificial Sequence
  Artificial sequence related to HLA knockouts in cell therapy
ggacgcccccaaaacgca

SEQ ID NO: 17634 - DNA, 18 bp, Artificial Sequence
  Artificial sequence related to HLA knockouts in cell therapy
gacgcccccaaaacgcat

SEQ ID NO: 17635 - DNA, 18 bp, Artificial Sequence
  Artificial sequence related to HLA knockouts in cell therapy
gactcaccacgctgtctc

SEQ ID NO: 17636 - DNA, 18 bp, Artificial Sequence
  Artificial sequence related to HLA knockouts in cell therapy
ctcaccacgctgtctctg

SEQ ID NO: 17637 - DNA, 18 bp, Artificial Sequence
  Artificial sequence related to HLA knockouts in cell therapy
caccacgctgtctctgac

SEQ ID NO: 17638 - DNA, 18 bp, Artificial Sequence
  Artificial sequence related to HLA knockouts in cell therapy
accacgctgtctctgacc

SEQ ID NO: 17639 - DNA, 18 bp, Artificial Sequence
  Artificial sequence related to HLA knockouts in cell therapy
ccacgctgtctctgacca

SEQ ID NO: 17640 - DNA, 18 bp, Artificial Sequence
  Artificial sequence related to HLA knockouts in cell therapy
ctgaccatgaagccaccc

SEQ ID NO: 17641 - DNA, 18 bp, Artificial Sequence
  Artificial sequence related to HLA knockouts in cell therapy
gaccatgaagccaccctg

SEQ ID NO: 17642 - DNA, 18 bp, Artificial Sequence
  Artificial sequence related to HLA knockouts in cell therapy
ccatgaagccaccctgag

SEQ ID NO: 17643 - DNA, 18 bp, Artificial Sequence
  Artificial sequence related to HLA knockouts in cell therapy
catgaagccaccctgagg

SEQ ID NO: 17644 - DNA, 18 bp, Artificial Sequence
  Artificial sequence related to HLA knockouts in cell therapy
tgaagccaccctgaggtg

SEQ ID NO: 17645 - DNA, 18 bp, Artificial Sequence
  Artificial sequence related to HLA knockouts in cell therapy
gaagccaccctgaggtgc

SEQ ID NO: 17646 - DNA, 18 bp, Artificial Sequence
  Artificial sequence related to HLA knockouts in cell therapy
aagccaccctgaggtgct

SEQ ID NO: 17647 - DNA, 18 bp, Artificial Sequence
  Artificial sequence related to HLA knockouts in cell therapy
agccaccctgaggtgctg

SEQ ID NO: 17648 - DNA, 18 bp, Artificial Sequence
  Artificial sequence related to HLA knockouts in cell therapy
gccaccctgaggtgctgg

SEQ ID NO: 17649 - DNA, 18 bp, Artificial Sequence
  Artificial sequence related to HLA knockouts in cell therapy
ccaccctgaggtgctggg

SEQ ID NO: 17650 - DNA, 18 bp, Artificial Sequence
  Artificial sequence related to HLA knockouts in cell therapy
caccctgaggtgctgggc

SEQ ID NO: 17651 - DNA, 18 bp, Artificial Sequence
  Artificial sequence related to HLA knockouts in cell therapy
accctgaggtgctgggcc

SEQ ID NO: 17652 - DNA, 18 bp, Artificial Sequence
  Artificial sequence related to HLA knockouts in cell therapy
ccctgaggtgctgggccc

SEQ ID NO: 17653 - DNA, 18 bp, Artificial Sequence
  Artificial sequence related to HLA knockouts in cell therapy
cctgaggtgctgggccct

SEQ ID NO: 17654 - DNA, 18 bp, Artificial Sequence
  Artificial sequence related to HLA knockouts in cell therapy
ctgaggtgctgggccctg

SEQ ID NO: 17655 - DNA, 18 bp, Artificial Sequence
  Artificial sequence related to HLA knockouts in cell therapy
tgaggtgctgggccctga

SEQ ID NO: 17656 - DNA, 18 bp, Artificial Sequence
  Artificial sequence related to HLA knockouts in cell therapy
gaggtgctgggccctgag

SEQ ID NO: 17657 - DNA, 18 bp, Artificial Sequence
  Artificial sequence related to HLA knockouts in cell therapy
aggtgctgggccctgagc

SEQ ID NO: 17658 - DNA, 18 bp, Artificial Sequence
  Artificial sequence related to HLA knockouts in cell therapy
ggtgctgggccctgagct

SEQ ID NO: 17659 - DNA, 18 bp, Artificial Sequence
  Artificial sequence related to HLA knockouts in cell therapy
gtgctgggccctgagctt

SEQ ID NO: 17660 - DNA, 18 bp, Artificial Sequence
  Artificial sequence related to HLA knockouts in cell therapy
tgctgggccctgagcttc

SEQ ID NO: 17661 - DNA, 18 bp, Artificial Sequence
  Artificial sequence related to HLA knockouts in cell therapy
gctgggccctgagcttct

SEQ ID NO: 17662 - DNA, 18 bp, Artificial Sequence
  Artificial sequence related to HLA knockouts in cell therapy
ctgggccctgagcttcta

SEQ ID NO: 17663 - DNA, 18 bp, Artificial Sequence
  Artificial sequence related to HLA knockouts in cell therapy
tgggccctgagcttctac

SEQ ID NO: 17664 - DNA, 18 bp, Artificial Sequence
  Artificial sequence related to HLA knockouts in cell therapy
gggccctgagcttctacc

SEQ ID NO: 17665 - DNA, 18 bp, Artificial Sequence
  Artificial sequence related to HLA knockouts in cell therapy
ggccctgagcttctaccc

SEQ ID NO: 17666 - DNA, 18 bp, Artificial Sequence
  Artificial sequence related to HLA knockouts in cell therapy
gccctgagcttctaccct

SEQ ID NO: 17667 - DNA, 18 bp, Artificial Sequence
  Artificial sequence related to HLA knockouts in cell therapy
ccctgagcttctaccctg

SEQ ID NO: 17668 - DNA, 18 bp, Artificial Sequence
  Artificial sequence related to HLA knockouts in cell therapy
cctgagcttctaccctgc

SEQ ID NO: 17669 - DNA, 18 bp, Artificial Sequence
  Artificial sequence related to HLA knockouts in cell therapy
ctgagcttctaccctgcg

SEQ ID NO: 17670 - DNA, 18 bp, Artificial Sequence
  Artificial sequence related to HLA knockouts in cell therapy
tgagcttctaccctgcgg

SEQ ID NO: 17671 - DNA, 18 bp, Artificial Sequence
  Artificial sequence related to HLA knockouts in cell therapy
gagcttctaccctgcgga

SEQ ID NO: 17672 - DNA, 18 bp, Artificial Sequence
  Artificial sequence related to HLA knockouts in cell therapy
agcttctaccctgcggag

SEQ ID NO: 17673 - DNA, 18 bp, Artificial Sequence
  Artificial sequence related to HLA knockouts in cell therapy
gcttctaccctgcggaga

SEQ ID NO: 17674 - DNA, 18 bp, Artificial Sequence
  Artificial sequence related to HLA knockouts in cell therapy
ctaccctgcggagatcac

SEQ ID NO: 17675 - DNA, 18 bp, Artificial Sequence
  Artificial sequence related to HLA knockouts in cell therapy
accctgcggagatcacac

SEQ ID NO: 17676 - DNA, 18 bp, Artificial Sequence
  Artificial sequence related to HLA knockouts in cell therapy
ccctgcggagatcacact

SEQ ID NO: 17677 - DNA, 18 bp, Artificial Sequence
  Artificial sequence related to HLA knockouts in cell therapy
cctgcggagatcacactg

SEQ ID NO: 17678 - DNA, 18 bp, Artificial Sequence
  Artificial sequence related to HLA knockouts in cell therapy
gcggagatcacactgacc

SEQ ID NO: 17679 - DNA, 18 bp, Artificial Sequence
  Artificial sequence related to HLA knockouts in cell therapy
tcacactgacctggcagc

SEQ ID NO: 17680 - DNA, 18 bp, Artificial Sequence
  Artificial sequence related to HLA knockouts in cell therapy
cacactgacctggcagcg

SEQ ID NO: 17681 - DNA, 18 bp, Artificial Sequence
  Artificial sequence related to HLA knockouts in cell therapy
acactgacctggcagcgg

SEQ ID NO: 17682 - DNA, 18 bp, Artificial Sequence
  Artificial sequence related to HLA knockouts in cell therapy
cactgacctggcagcggg

SEQ ID NO: 17683 - DNA, 18 bp, Artificial Sequence
  Artificial sequence related to HLA knockouts in cell therapy
actgacctggcagcggga

SEQ ID NO: 17684 - DNA, 18 bp, Artificial Sequence
  Artificial sequence related to HLA knockouts in cell therapy
ctgacctggcagcgggat

SEQ ID NO: 17685 - DNA, 18 bp, Artificial Sequence
  Artificial sequence related to HLA knockouts in cell therapy
tgacctggcagcgggatg

SEQ ID NO: 17686 - DNA, 18 bp, Artificial Sequence
  Artificial sequence related to HLA knockouts in cell therapy
gacctggcagcgggatgg

SEQ ID NO: 17687 - DNA, 18 bp, Artificial Sequence
  Artificial sequence related to HLA knockouts in cell therapy
acctggcagcgggatggg

SEQ ID NO: 17688 - DNA, 18 bp, Artificial Sequence
  Artificial sequence related to HLA knockouts in cell therapy
cctggcagcgggatgggg

SEQ ID NO: 17689 - DNA, 18 bp, Artificial Sequence
  Artificial sequence related to HLA knockouts in cell therapy
ctggcagcgggatgggga

SEQ ID NO: 17690 - DNA, 18 bp, Artificial Sequence
  Artificial sequence related to HLA knockouts in cell therapy
tggcagcgggatggggag

SEQ ID NO: 17691 - DNA, 18 bp, Artificial Sequence
  Artificial sequence related to HLA knockouts in cell therapy
ggcagcgggatggggagg

SEQ ID NO: 17692 - DNA, 18 bp, Artificial Sequence
  Artificial sequence related to HLA knockouts in cell therapy
gcagcgggatggggagga

SEQ ID NO: 17693 - DNA, 18 bp, Artificial Sequence
  Artificial sequence related to HLA knockouts in cell therapy
cagcgggatggggaggac

SEQ ID NO: 17694 - DNA, 18 bp, Artificial Sequence
  Artificial sequence related to HLA knockouts in cell therapy
agcgggatggggaggacc

SEQ ID NO: 17695 - DNA, 18 bp, Artificial Sequence
  Artificial sequence related to HLA knockouts in cell therapy
gcgggatggggaggacca

SEQ ID NO: 17696 - DNA, 18 bp, Artificial Sequence
  Artificial sequence related to HLA knockouts in cell therapy
cgggatggggaggaccag

SEQ ID NO: 17697 - DNA, 18 bp, Artificial Sequence
  Artificial sequence related to HLA knockouts in cell therapy
gggatggggaggaccaga

SEQ ID NO: 17698 - DNA, 18 bp, Artificial Sequence
  Artificial sequence related to HLA knockouts in cell therapy
ggatggggaggaccagac

SEQ ID NO: 17699 - DNA, 18 bp, Artificial Sequence
  Artificial sequence related to HLA knockouts in cell therapy
gatggggaggaccagacc

SEQ ID NO: 17700 - DNA, 18 bp, Artificial Sequence
  Artificial sequence related to HLA knockouts in cell therapy
atggggaggaccagaccc

SEQ ID NO: 17701 - DNA, 18 bp, Artificial Sequence
  Artificial sequence related to HLA knockouts in cell therapy
tggggaggaccagaccca

SEQ ID NO: 17702 - DNA, 18 bp, Artificial Sequence
  Artificial sequence related to HLA knockouts in cell therapy
ggggaggaccagacccag

SEQ ID NO: 17703 - DNA, 18 bp, Artificial Sequence
  Artificial sequence related to HLA knockouts in cell therapy
gggaggaccagacccagg

SEQ ID NO: 17704 - DNA, 18 bp, Artificial Sequence
  Artificial sequence related to HLA knockouts in cell therapy
ggaggaccagacccagga

SEQ ID NO: 17705 - DNA, 18 bp, Artificial Sequence
  Artificial sequence related to HLA knockouts in cell therapy
gaggaccagacccaggac

SEQ ID NO: 17706 - DNA, 18 bp, Artificial Sequence
  Artificial sequence related to HLA knockouts in cell therapy
aggaccagacccaggaca

SEQ ID NO: 17707 - DNA, 18 bp, Artificial Sequence
  Artificial sequence related to HLA knockouts in cell therapy
ggaccagacccaggacac

SEQ ID NO: 17708 - DNA, 18 bp, Artificial Sequence
  Artificial sequence related to HLA knockouts in cell therapy
gaccagacccaggacacg

SEQ ID NO: 17709 - DNA, 18 bp, Artificial Sequence
  Artificial sequence related to HLA knockouts in cell therapy
accagacccaggacacgg

SEQ ID NO: 17710 - DNA, 18 bp, Artificial Sequence
  Artificial sequence related to HLA knockouts in cell therapy
ccagacccaggacacgga

SEQ ID NO: 17711 - DNA, 18 bp, Artificial Sequence
  Artificial sequence related to HLA knockouts in cell therapy
cagacccaggacacggag

SEQ ID NO: 17712 - DNA, 18 bp, Artificial Sequence
  Artificial sequence related to HLA knockouts in cell therapy
agacccaggacacggagc

SEQ ID NO: 17713 - DNA, 18 bp, Artificial Sequence
  Artificial sequence related to HLA knockouts in cell therapy
gacccaggacacggagct

SEQ ID NO: 17714 - DNA, 18 bp, Artificial Sequence
  Artificial sequence related to HLA knockouts in cell therapy
acccaggacacggagctc

SEQ ID NO: 17715 - DNA, 18 bp, Artificial Sequence
  Artificial sequence related to HLA knockouts in cell therapy
cccaggacacggagctcg

SEQ ID NO: 17716 - DNA, 18 bp, Artificial Sequence
  Artificial sequence related to HLA knockouts in cell therapy
ccaggacacggagctcgt

SEQ ID NO: 17717 - DNA, 18 bp, Artificial Sequence
  Artificial sequence related to HLA knockouts in cell therapy
caggacacggagctcgtg

SEQ ID NO: 17718 - DNA, 18 bp, Artificial Sequence
  Artificial sequence related to HLA knockouts in cell therapy
aggacacggagctcgtgg

SEQ ID NO: 17719 - DNA, 18 bp, Artificial Sequence
  Artificial sequence related to HLA knockouts in cell therapy
ggacacggagctcgtgga

SEQ ID NO: 17720 - DNA, 18 bp, Artificial Sequence
  Artificial sequence related to HLA knockouts in cell therapy
gacacggagctcgtggag

SEQ ID NO: 17721 - DNA, 18 bp, Artificial Sequence
  Artificial sequence related to HLA knockouts in cell therapy
acacggagctcgtggaga

SEQ ID NO: 17722 - DNA, 18 bp, Artificial Sequence
  Artificial sequence related to HLA knockouts in cell therapy
cacggagctcgtggagac

SEQ ID NO: 17723 - DNA, 18 bp, Artificial Sequence
  Artificial sequence related to HLA knockouts in cell therapy
acggagctcgtggagacc

SEQ ID NO: 17724 - DNA, 18 bp, Artificial Sequence
  Artificial sequence related to HLA knockouts in cell therapy
cggagctcgtggagacca

SEQ ID NO: 17725 - DNA, 18 bp, Artificial Sequence
  Artificial sequence related to HLA knockouts in cell therapy
ggagctcgtggagaccag

SEQ ID NO: 17726 - DNA, 18 bp, Artificial Sequence
  Artificial sequence related to HLA knockouts in cell therapy
gagctcgtggagaccagg

SEQ ID NO: 17727 - DNA, 18 bp, Artificial Sequence
  Artificial sequence related to HLA knockouts in cell therapy
agctcgtggagaccaggc

SEQ ID NO: 17728 - DNA, 18 bp, Artificial Sequence
  Artificial sequence related to HLA knockouts in cell therapy
gctcgtggagaccaggcc

SEQ ID NO: 17729 - DNA, 18 bp, Artificial Sequence
  Artificial sequence related to HLA knockouts in cell therapy
ctcgtggagaccaggcct

SEQ ID NO: 17730 - DNA, 18 bp, Artificial Sequence
  Artificial sequence related to HLA knockouts in cell therapy
tcgtggagaccaggcctg

SEQ ID NO: 17731 - DNA, 18 bp, Artificial Sequence
  Artificial sequence related to HLA knockouts in cell therapy
cgtggagaccaggcctgc

SEQ ID NO: 17732 - DNA, 18 bp, Artificial Sequence
  Artificial sequence related to HLA knockouts in cell therapy
gtggagaccaggcctgca

SEQ ID NO: 17733 - DNA, 18 bp, Artificial Sequence
  Artificial sequence related to HLA knockouts in cell therapy
tggagaccaggcctgcag

SEQ ID NO: 17734 - DNA, 18 bp, Artificial Sequence
  Artificial sequence related to HLA knockouts in cell therapy
ggagaccaggcctgcagg

SEQ ID NO: 17735 - DNA, 18 bp, Artificial Sequence
  Artificial sequence related to HLA knockouts in cell therapy
gagaccaggcctgcaggg

SEQ ID NO: 17736 - DNA, 18 bp, Artificial Sequence
  Artificial sequence related to HLA knockouts in cell therapy
agaccaggcctgcagggg

SEQ ID NO: 17737 - DNA, 18 bp, Artificial Sequence
  Artificial sequence related to HLA knockouts in cell therapy
gaccaggcctgcagggga

SEQ ID NO: 17738 - DNA, 18 bp, Artificial Sequence
  Artificial sequence related to HLA knockouts in cell therapy
accaggcctgcaggggat

SEQ ID NO: 17739 - DNA, 18 bp, Artificial Sequence
  Artificial sequence related to HLA knockouts in cell therapy
ccaggcctgcaggggatg

SEQ ID NO: 17740 - DNA, 18 bp, Artificial Sequence
  Artificial sequence related to HLA knockouts in cell therapy
caggcctgcaggggatgg

SEQ ID NO: 17741 - DNA, 18 bp, Artificial Sequence
  Artificial sequence related to HLA knockouts in cell therapy
aggcctgcaggggatgga

SEQ ID NO: 17742 - DNA, 18 bp, Artificial Sequence
  Artificial sequence related to HLA knockouts in cell therapy
ggcctgcaggggatggaa

SEQ ID NO: 17743 - DNA, 18 bp, Artificial Sequence
  Artificial sequence related to HLA knockouts in cell therapy
gcctgcaggggatggaac

SEQ ID NO: 17744 - DNA, 18 bp, Artificial Sequence
  Artificial sequence related to HLA knockouts in cell therapy
cctgcaggggatggaacc

SEQ ID NO: 17745 - DNA, 18 bp, Artificial Sequence
  Artificial sequence related to HLA knockouts in cell therapy
ctgcaggggatggaacct

SEQ ID NO: 17746 - DNA, 18 bp, Artificial Sequence
  Artificial sequence related to HLA knockouts in cell therapy
gcaggggatggaaccttc

SEQ ID NO: 17747 - DNA, 18 bp, Artificial Sequence
  Artificial sequence related to HLA knockouts in cell therapy
caggggatggaaccttcc

SEQ ID NO: 17748 - DNA, 18 bp, Artificial Sequence
  Artificial sequence related to HLA knockouts in cell therapy
ggggatggaaccttccag

SEQ ID NO: 17749 - DNA, 18 bp, Artificial Sequence
  Artificial sequence related to HLA knockouts in cell therapy
accttccagaagtgggcg

SEQ ID NO: 17750 - DNA, 18 bp, Artificial Sequence
  Artificial sequence related to HLA knockouts in cell therapy
ccttccagaagtgggcgg

SEQ ID NO: 17751 - DNA, 18 bp, Artificial Sequence
  Artificial sequence related to HLA knockouts in cell therapy
cttccagaagtgggcggc

SEQ ID NO: 17752 - DNA, 18 bp, Artificial Sequence
  Artificial sequence related to HLA knockouts in cell therapy
ttccagaagtgggcggct

SEQ ID NO: 17753 - DNA, 18 bp, Artificial Sequence
  Artificial sequence related to HLA knockouts in cell therapy
tccagaagtgggcggctg

SEQ ID NO: 17754 - DNA, 18 bp, Artificial Sequence
  Artificial sequence related to HLA knockouts in cell therapy
ccagaagtgggcggctgt

SEQ ID NO: 17755 - DNA, 18 bp, Artificial Sequence
  Artificial sequence related to HLA knockouts in cell therapy
cagaagtgggcggctgtg

SEQ ID NO: 17756 - DNA, 18 bp, Artificial Sequence
  Artificial sequence related to HLA knockouts in cell therapy
agaagtgggcggctgtgg

SEQ ID NO: 17757 - DNA, 18 bp, Artificial Sequence
  Artificial sequence related to HLA knockouts in cell therapy
gaagtgggcggctgtggt

SEQ ID NO: 17758 - DNA, 18 bp, Artificial Sequence
  Artificial sequence related to HLA knockouts in cell therapy
aagtgggcggctgtggtg

SEQ ID NO: 17759 - DNA, 18 bp, Artificial Sequence
  Artificial sequence related to HLA knockouts in cell therapy
agtgggcggctgtggtgg

SEQ ID NO: 17760 - DNA, 18 bp, Artificial Sequence
  Artificial sequence related to HLA knockouts in cell therapy
gtgggcggctgtggtggt

SEQ ID NO: 17761 - DNA, 18 bp, Artificial Sequence
  Artificial sequence related to HLA knockouts in cell therapy
tgggcggctgtggtggtg

SEQ ID NO: 17762 - DNA, 18 bp, Artificial Sequence
  Artificial sequence related to HLA knockouts in cell therapy
gggcggctgtggtggtgc

SEQ ID NO: 17763 - DNA, 18 bp, Artificial Sequence
  Artificial sequence related to HLA knockouts in cell therapy
ggcggctgtggtggtgcc

SEQ ID NO: 17764 - DNA, 18 bp, Artificial Sequence
  Artificial sequence related to HLA knockouts in cell therapy
gcggctgtggtggtgcct

SEQ ID NO: 17765 - DNA, 18 bp, Artificial Sequence
  Artificial sequence related to HLA knockouts in cell therapy
cggctgtggtggtgcctt

SEQ ID NO: 17766 - DNA, 18 bp, Artificial Sequence
  Artificial sequence related to HLA knockouts in cell therapy
ggctgtggtggtgccttc

SEQ ID NO: 17767 - DNA, 18 bp, Artificial Sequence
  Artificial sequence related to HLA knockouts in cell therapy
gctgtggtggtgccttct

SEQ ID NO: 17768 - DNA, 18 bp, Artificial Sequence
  Artificial sequence related to HLA knockouts in cell therapy
ctgtggtggtgccttctg

SEQ ID NO: 17769 - DNA, 18 bp, Artificial Sequence
  Artificial sequence related to HLA knockouts in cell therapy
tgtggtggtgccttctgg

SEQ ID NO: 17770 - DNA, 18 bp, Artificial Sequence
  Artificial sequence related to HLA knockouts in cell therapy
gtggtggtgccttctgga

SEQ ID NO: 17771 - DNA, 18 bp, Artificial Sequence
  Artificial sequence related to HLA knockouts in cell therapy
tggtggtgccttctggac

SEQ ID NO: 17772 - DNA, 18 bp, Artificial Sequence
  Artificial sequence related to HLA knockouts in cell therapy
ggtggtgccttctggaca

SEQ ID NO: 17773 - DNA, 18 bp, Artificial Sequence
  Artificial sequence related to HLA knockouts in cell therapy
gtggtgccttctggacag

SEQ ID NO: 17774 - DNA, 18 bp, Artificial Sequence
  Artificial sequence related to HLA knockouts in cell therapy
tggtgccttctggacagg

SEQ ID NO: 17775 - DNA, 18 bp, Artificial Sequence
  Artificial sequence related to HLA knockouts in cell therapy
ggtgccttctggacagga

SEQ ID NO: 17776 - DNA, 18 bp, Artificial Sequence
  Artificial sequence related to HLA knockouts in cell therapy
gtgccttctggacaggag

SEQ ID NO: 17777 - DNA, 18 bp, Artificial Sequence
  Artificial sequence related to HLA knockouts in cell therapy
tgccttctggacaggagc

SEQ ID NO: 17778 - DNA, 18 bp, Artificial Sequence
  Artificial sequence related to HLA knockouts in cell therapy
gccttctggacaggagca

SEQ ID NO: 17779 - DNA, 18 bp, Artificial Sequence
  Artificial sequence related to HLA knockouts in cell therapy
ccttctggacaggagcag

SEQ ID NO: 17780 - DNA, 18 bp, Artificial Sequence
  Artificial sequence related to HLA knockouts in cell therapy
acacctgccatgtgcagc

SEQ ID NO: 17781 - DNA, 18 bp, Artificial Sequence
  Artificial sequence related to HLA knockouts in cell therapy
cacctgccatgtgcagca

SEQ ID NO: 17782 - DNA, 18 bp, Artificial Sequence
  Artificial sequence related to HLA knockouts in cell therapy
cctgccatgtgcagcatg

SEQ ID NO: 17783 - DNA, 18 bp, Artificial Sequence
  Artificial sequence related to HLA knockouts in cell therapy
gccatgtgcagcatgagg

SEQ ID NO: 17784 - DNA, 18 bp, Artificial Sequence
  Artificial sequence related to HLA knockouts in cell therapy
ccatgtgcagcatgaggg

SEQ ID NO: 17785 - DNA, 18 bp, Artificial Sequence
  Artificial sequence related to HLA knockouts in cell therapy
gcagcatgagggtttgcc

SEQ ID NO: 17786 - DNA, 18 bp, Artificial Sequence
  Artificial sequence related to HLA knockouts in cell therapy
cagcatgagggtttgccc

SEQ ID NO: 17787 - DNA, 18 bp, Artificial Sequence
  Artificial sequence related to HLA knockouts in cell therapy
tgagggtttgcccaagcc

SEQ ID NO: 17788 - DNA, 18 bp, Artificial Sequence
  Artificial sequence related to HLA knockouts in cell therapy
gagggtttgcccaagccc

SEQ ID NO: 17789 - DNA, 18 bp, Artificial Sequence
  Artificial sequence related to HLA knockouts in cell therapy
agggtttgcccaagcccc

SEQ ID NO: 17790 - DNA, 18 bp, Artificial Sequence
  Artificial sequence related to HLA knockouts in cell therapy
gggtttgcccaagcccct

SEQ ID NO: 17791 - DNA, 18 bp, Artificial Sequence
  Artificial sequence related to HLA knockouts in cell therapy
ggtttgcccaagcccctc

SEQ ID NO: 17792 - DNA, 18 bp, Artificial Sequence
  Artificial sequence related to HLA knockouts in cell therapy
gtttgcccaagcccctca

SEQ ID NO: 17793 - DNA, 18 bp, Artificial Sequence
  Artificial sequence related to HLA knockouts in cell therapy
tttgcccaagcccctcac

SEQ ID NO: 17794 - DNA, 18 bp, Artificial Sequence
  Artificial sequence related to HLA knockouts in cell therapy
ttgcccaagcccctcacc

SEQ ID NO: 17795 - DNA, 18 bp, Artificial Sequence
  Artificial sequence related to HLA knockouts in cell therapy
tgcccaagcccctcaccc

SEQ ID NO: 17796 - DNA, 18 bp, Artificial Sequence
  Artificial sequence related to HLA knockouts in cell therapy
gcccaagcccctcaccct

SEQ ID NO: 17797 - DNA, 18 bp, Artificial Sequence
  Artificial sequence related to HLA knockouts in cell therapy
cccaagcccctcaccctg

SEQ ID NO: 17798 - DNA, 18 bp, Artificial Sequence
  Artificial sequence related to HLA knockouts in cell therapy
ccaagcccctcaccctga

SEQ ID NO: 17799 - DNA, 18 bp, Artificial Sequence
  Artificial sequence related to HLA knockouts in cell therapy
caagcccctcaccctgag

SEQ ID NO: 17800 - DNA, 18 bp, Artificial Sequence
  Artificial sequence related to HLA knockouts in cell therapy
aagcccctcaccctgaga

SEQ ID NO: 17801 - DNA, 18 bp, Artificial Sequence
  Artificial sequence related to HLA knockouts in cell therapy
agcccctcaccctgagat

SEQ ID NO: 17802 - DNA, 18 bp, Artificial Sequence
  Artificial sequence related to HLA knockouts in cell therapy
gcccctcaccctgagatg

SEQ ID NO: 17803 - DNA, 18 bp, Artificial Sequence
  Artificial sequence related to HLA knockouts in cell therapy
cccctcaccctgagatgg

SEQ ID NO: 17804 - DNA, 18 bp, Artificial Sequence
  Artificial sequence related to HLA knockouts in cell therapy
ccctcaccctgagatggg

SEQ ID NO: 17805 - DNA, 18 bp, Artificial Sequence
  Artificial sequence related to HLA knockouts in cell therapy
cctcaccctgagatggga

SEQ ID NO: 17806 - DNA, 18 bp, Artificial Sequence
  Artificial sequence related to HLA knockouts in cell therapy
ctcaccctgagatgggag

SEQ ID NO: 17807 - DNA, 18 bp, Artificial Sequence
  Artificial sequence related to HLA knockouts in cell therapy
tcaccctgagatgggagc

SEQ ID NO: 17808 - DNA, 18 bp, Artificial Sequence
  Artificial sequence related to HLA knockouts in cell therapy
caccctgagatgggagcc

SEQ ID NO: 17809 - DNA, 18 bp, Artificial Sequence
  Artificial sequence related to HLA knockouts in cell therapy
accctgagatgggagccg

SEQ ID NO: 17810 - DNA, 18 bp, Artificial Sequence
  Artificial sequence related to HLA knockouts in cell therapy
ccctgagatgggagccgt

SEQ ID NO: 17811 - DNA, 18 bp, Artificial Sequence
  Artificial sequence related to HLA knockouts in cell therapy
cctgagatgggagccgtc

SEQ ID NO: 17812 - DNA, 18 bp, Artificial Sequence
  Artificial sequence related to HLA knockouts in cell therapy
ctgagatgggagccgtct

SEQ ID NO: 17813 - DNA, 18 bp, Artificial Sequence
  Artificial sequence related to HLA knockouts in cell therapy
gagatgggagccgtcttc

SEQ ID NO: 17814 - DNA, 18 bp, Artificial Sequence
  Artificial sequence related to HLA knockouts in cell therapy
agatgggagccgtcttcc

SEQ ID NO: 17815 - DNA, 18 bp, Artificial Sequence
  Artificial sequence related to HLA knockouts in cell therapy
gatgggagccgtcttccc

SEQ ID NO: 17816 - DNA, 18 bp, Artificial Sequence
  Artificial sequence related to HLA knockouts in cell therapy
atgggagccgtcttccca

SEQ ID NO: 17817 - DNA, 18 bp, Artificial Sequence
  Artificial sequence related to HLA knockouts in cell therapy
tgggagccgtcttcccag

SEQ ID NO: 17818 - DNA, 18 bp, Artificial Sequence
  Artificial sequence related to HLA knockouts in cell therapy
gggagccgtcttcccagc

SEQ ID NO: 17819 - DNA, 18 bp, Artificial Sequence
  Artificial sequence related to HLA knockouts in cell therapy
ggagccgtcttcccagcc

SEQ ID NO: 17820 - DNA, 18 bp, Artificial Sequence
  Artificial sequence related to HLA knockouts in cell therapy
gagccgtcttcccagccc

SEQ ID NO: 17821 - DNA, 18 bp, Artificial Sequence
  Artificial sequence related to HLA knockouts in cell therapy
agccgtcttcccagccca

SEQ ID NO: 17822 - DNA, 18 bp, Artificial Sequence
  Artificial sequence related to HLA knockouts in cell therapy
gccgtcttcccagcccac

SEQ ID NO: 17823 - DNA, 18 bp, Artificial Sequence
  Artificial sequence related to HLA knockouts in cell therapy
ccgtcttcccagcccacc

SEQ ID NO: 17824 - DNA, 18 bp, Artificial Sequence
  Artificial sequence related to HLA knockouts in cell therapy
cgtcttcccagcccacca

SEQ ID NO: 17825 - DNA, 18 bp, Artificial Sequence
  Artificial sequence related to HLA knockouts in cell therapy
gtcttcccagcccaccat

SEQ ID NO: 17826 - DNA, 18 bp, Artificial Sequence
  Artificial sequence related to HLA knockouts in cell therapy
tcttcccagcccaccatc

SEQ ID NO: 17827 - DNA, 18 bp, Artificial Sequence
  Artificial sequence related to HLA knockouts in cell therapy
cttcccagcccaccatcc

SEQ ID NO: 17828 - DNA, 18 bp, Artificial Sequence
  Artificial sequence related to HLA knockouts in cell therapy
ttcccagcccaccatccc

SEQ ID NO: 17829 - DNA, 18 bp, Artificial Sequence
  Artificial sequence related to HLA knockouts in cell therapy
tcccagcccaccatcccc

SEQ ID NO: 17830 - DNA, 18 bp, Artificial Sequence
  Artificial sequence related to HLA knockouts in cell therapy
cccagcccaccatcccca

SEQ ID NO: 17831 - DNA, 18 bp, Artificial Sequence
  Artificial sequence related to HLA knockouts in cell therapy
ccagcccaccatccccat

SEQ ID NO: 17832 - DNA, 18 bp, Artificial Sequence
  Artificial sequence related to HLA knockouts in cell therapy
cagcccaccatccccatc

SEQ ID NO: 17833 - DNA, 18 bp, Artificial Sequence
  Artificial sequence related to HLA knockouts in cell therapy
agcccaccatccccatcg

SEQ ID NO: 17834 - DNA, 18 bp, Artificial Sequence
  Artificial sequence related to HLA knockouts in cell therapy
gcccaccatccccatcgt

SEQ ID NO: 17835 - DNA, 18 bp, Artificial Sequence
  Artificial sequence related to HLA knockouts in cell therapy
cccaccatccccatcgtg

SEQ ID NO: 17836 - DNA, 18 bp, Artificial Sequence
  Artificial sequence related to HLA knockouts in cell therapy
ccaccatccccatcgtgg

SEQ ID NO: 17837 - DNA, 18 bp, Artificial Sequence
  Artificial sequence related to HLA knockouts in cell therapy
caccatccccatcgtggg

SEQ ID NO: 17838 - DNA, 18 bp, Artificial Sequence
  Artificial sequence related to HLA knockouts in cell therapy
accatccccatcgtgggc

SEQ ID NO: 17839 - DNA, 18 bp, Artificial Sequence
  Artificial sequence related to HLA knockouts in cell therapy
ccatccccatcgtgggca

SEQ ID NO: 17840 - DNA, 18 bp, Artificial Sequence
  Artificial sequence related to HLA knockouts in cell therapy
catccccatcgtgggcat

SEQ ID NO: 17841 - DNA, 18 bp, Artificial Sequence
  Artificial sequence related to HLA knockouts in cell therapy
atccccatcgtgggcatc

SEQ ID NO: 17842 - DNA, 18 bp, Artificial Sequence
  Artificial sequence related to HLA knockouts in cell therapy
tccccatcgtgggcatca

SEQ ID NO: 17843 - DNA, 18 bp, Artificial Sequence
  Artificial sequence related to HLA knockouts in cell therapy
ccccatcgtgggcatcat

SEQ ID NO: 17844 - DNA, 18 bp, Artificial Sequence
  Artificial sequence related to HLA knockouts in cell therapy
cgtgggcatcattgctgg

SEQ ID NO: 17845 - DNA, 18 bp, Artificial Sequence
  Artificial sequence related to HLA knockouts in cell therapy
gtgggcatcattgctggc

SEQ ID NO: 17846 - DNA, 18 bp, Artificial Sequence
  Artificial sequence related to HLA knockouts in cell therapy
tgggcatcattgctggcc

SEQ ID NO: 17847 - DNA, 18 bp, Artificial Sequence
  Artificial sequence related to HLA knockouts in cell therapy
gggcatcattgctggcct

SEQ ID NO: 17848 - DNA, 18 bp, Artificial Sequence
  Artificial sequence related to HLA knockouts in cell therapy
ggcatcattgctggcctg

SEQ ID NO: 17849 - DNA, 18 bp, Artificial Sequence
  Artificial sequence related to HLA knockouts in cell therapy
gcatcattgctggcctgg

SEQ ID NO: 17850 - DNA, 18 bp, Artificial Sequence
  Artificial sequence related to HLA knockouts in cell therapy
tcactggagctgtggtcg

SEQ ID NO: 17851 - DNA, 18 bp, Artificial Sequence
  Artificial sequence related to HLA knockouts in cell therapy
cactggagctgtggtcgc

SEQ ID NO: 17852 - DNA, 18 bp, Artificial Sequence
  Artificial sequence related to HLA knockouts in cell therapy
actggagctgtggtcgct

SEQ ID NO: 17853 - DNA, 18 bp, Artificial Sequence
  Artificial sequence related to HLA knockouts in cell therapy
ctggagctgtggtcgctg

SEQ ID NO: 17854 - DNA, 18 bp, Artificial Sequence
  Artificial sequence related to HLA knockouts in cell therapy
tggagctgtggtcgctgc

SEQ ID NO: 17855 - DNA, 18 bp, Artificial Sequence
  Artificial sequence related to HLA knockouts in cell therapy
ggagctgtggtcgctgct

SEQ ID NO: 17856 - DNA, 18 bp, Artificial Sequence
  Artificial sequence related to HLA knockouts in cell therapy
gagctgtggtcgctgctg

SEQ ID NO: 17857 - DNA, 18 bp, Artificial Sequence
  Artificial sequence related to HLA knockouts in cell therapy
agctgtggtcgctgctgt

SEQ ID NO: 17858 - DNA, 18 bp, Artificial Sequence
  Artificial sequence related to HLA knockouts in cell therapy
gctgtggtcgctgctgtg

SEQ ID NO: 17859 - DNA, 18 bp, Artificial Sequence
  Artificial sequence related to HLA knockouts in cell therapy
ctgtggtcgctgctgtga

SEQ ID NO: 17860 - DNA, 18 bp, Artificial Sequence
  Artificial sequence related to HLA knockouts in cell therapy
gtggtcgctgctgtgatg

SEQ ID NO: 17861 - DNA, 18 bp, Artificial Sequence
  Artificial sequence related to HLA knockouts in cell therapy
ggtcgctgctgtgatgtg

SEQ ID NO: 17862 - DNA, 18 bp, Artificial Sequence
  Artificial sequence related to HLA knockouts in cell therapy
gtcgctgctgtgatgtgg

SEQ ID NO: 17863 - DNA, 18 bp, Artificial Sequence
  Artificial sequence related to HLA knockouts in cell therapy
cgctgctgtgatgtggag

SEQ ID NO: 17864 - DNA, 18 bp, Artificial Sequence
  Artificial sequence related to HLA knockouts in cell therapy
gctgctgtgatgtggagg

SEQ ID NO: 17865 - DNA, 18 bp, Artificial Sequence
  Artificial sequence related to HLA knockouts in cell therapy
gctgtgatgtggaggagg

SEQ ID NO: 17866 - DNA, 18 bp, Artificial Sequence
  Artificial sequence related to HLA knockouts in cell therapy
gtggaggaggaagagctc

SEQ ID NO: 17867 - DNA, 18 bp, Artificial Sequence
  Artificial sequence related to HLA knockouts in cell therapy
ggaggaggaagagctcag

SEQ ID NO: 17868 - DNA, 18 bp, Artificial Sequence
  Artificial sequence related to HLA knockouts in cell therapy
ggagggagctactctcag

SEQ ID NO: 17869 - DNA, 18 bp, Artificial Sequence
  Artificial sequence related to HLA knockouts in cell therapy
gagggagctactctcagg

SEQ ID NO: 17870 - DNA, 18 bp, Artificial Sequence
  Artificial sequence related to HLA knockouts in cell therapy
agggagctactctcaggc

SEQ ID NO: 17871 - DNA, 18 bp, Artificial Sequence
  Artificial sequence related to HLA knockouts in cell therapy
gggagctactctcaggct

SEQ ID NO: 17872 - DNA, 18 bp, Artificial Sequence
  Artificial sequence related to HLA knockouts in cell therapy
ggagctactctcaggctg

SEQ ID NO: 17873 - DNA, 18 bp, Artificial Sequence
  Artificial sequence related to HLA knockouts in cell therapy
gagctactctcaggctgc

SEQ ID NO: 17874 - DNA, 18 bp, Artificial Sequence
  Artificial sequence related to HLA knockouts in cell therapy
ctctcaggctgcaagcag

SEQ ID NO: 17875 - DNA, 18 bp, Artificial Sequence
  Artificial sequence related to HLA knockouts in cell therapy
ctcaggctgcaagcagtg

SEQ ID NO: 17876 - DNA, 18 bp, Artificial Sequence
  Artificial sequence related to HLA knockouts in cell therapy
caggctgcaagcagtgac

SEQ ID NO: 17877 - DNA, 18 bp, Artificial Sequence
  Artificial sequence related to HLA knockouts in cell therapy
ggctgcaagcagtgacag

SEQ ID NO: 17878 - DNA, 18 bp, Artificial Sequence
  Artificial sequence related to HLA knockouts in cell therapy
gcaagcagtgacagtgcc

SEQ ID NO: 17879 - DNA, 18 bp, Artificial Sequence
  Artificial sequence related to HLA knockouts in cell therapy
caagcagtgacagtgccc

SEQ ID NO: 17880 - DNA, 18 bp, Artificial Sequence
  Artificial sequence related to HLA knockouts in cell therapy
agcagtgacagtgcccag

SEQ ID NO: 17881 - DNA, 18 bp, Artificial Sequence
  Artificial sequence related to HLA knockouts in cell therapy
gcagtgacagtgcccagg

SEQ ID NO: 17882 - DNA, 18 bp, Artificial Sequence
  Artificial sequence related to HLA knockouts in cell therapy
cagtgacagtgcccaggg

SEQ ID NO: 17883 - DNA, 18 bp, Artificial Sequence
  Artificial sequence related to HLA knockouts in cell therapy
agtgacagtgcccagggc

SEQ ID NO: 17884 - DNA, 18 bp, Artificial Sequence
  Artificial sequence related to HLA knockouts in cell therapy
gtgacagtgcccagggct

SEQ ID NO: 17885 - DNA, 18 bp, Artificial Sequence
  Artificial sequence related to HLA knockouts in cell therapy
tgacagtgcccagggctc

SEQ ID NO: 17886 - DNA, 18 bp, Artificial Sequence
  Artificial sequence related to HLA knockouts in cell therapy
gacagtgcccagggctct

SEQ ID NO: 17887 - DNA, 18 bp, Artificial Sequence
  Artificial sequence related to HLA knockouts in cell therapy
acagtgcccagggctctg

SEQ ID NO: 17888 - DNA, 18 bp, Artificial Sequence
  Artificial sequence related to HLA knockouts in cell therapy
cagtgcccagggctctga

SEQ ID NO: 17889 - DNA, 18 bp, Artificial Sequence
  Artificial sequence related to HLA knockouts in cell therapy
agtgcccagggctctgat

SEQ ID NO: 17890 - DNA, 18 bp, Artificial Sequence
  Artificial sequence related to HLA knockouts in cell therapy
gtgcccagggctctgatg

SEQ ID NO: 17891 - DNA, 18 bp, Artificial Sequence
  Artificial sequence related to HLA knockouts in cell therapy
tgcccagggctctgatgt

SEQ ID NO: 17892 - DNA, 18 bp, Artificial Sequence
  Artificial sequence related to HLA knockouts in cell therapy
gcccagggctctgatgtg

SEQ ID NO: 17893 - DNA, 18 bp, Artificial Sequence
  Artificial sequence related to HLA knockouts in cell therapy
cccagggctctgatgtgt

SEQ ID NO: 17894 - DNA, 18 bp, Artificial Sequence
  Artificial sequence related to HLA knockouts in cell therapy
ccagggctctgatgtgtc

SEQ ID NO: 17895 - DNA, 18 bp, Artificial Sequence
  Artificial sequence related to HLA knockouts in cell therapy
gacagctgccttgtgtgg

SEQ ID NO: 17896 - DNA, 18 bp, Artificial Sequence
  Artificial sequence related to HLA knockouts in cell therapy
acagctgccttgtgtggg

SEQ ID NO: 17897 - DNA, 18 bp, Artificial Sequence
  Artificial sequence related to HLA knockouts in cell therapy
cagctgccttgtgtggga

SEQ ID NO: 17898 - DNA, 18 bp, Artificial Sequence
  Artificial sequence related to HLA knockouts in cell therapy
agctgccttgtgtgggac

SEQ ID NO: 17899 - DNA, 18 bp, Artificial Sequence
  Artificial sequence related to HLA knockouts in cell therapy
gctgccttgtgtgggact

SEQ ID NO: 17900 - DNA, 18 bp, Artificial Sequence
  Artificial sequence related to HLA knockouts in cell therapy
ctgccttgtgtgggactg

SEQ ID NO: 17901 - DNA, 18 bp, Artificial Sequence
  Artificial sequence related to HLA knockouts in cell therapy
gccttgtgtgggactgag

SEQ ID NO: 17902 - DNA, 18 bp, Artificial Sequence
  Artificial sequence related to HLA knockouts in cell therapy
tgtgtgggactgagaggc

SEQ ID NO: 17903 - DNA, 18 bp, Artificial Sequence
  Artificial sequence related to HLA knockouts in cell therapy
gtgtgggactgagaggca

SEQ ID NO: 17904 - DNA, 18 bp, Artificial Sequence
  Artificial sequence related to HLA knockouts in cell therapy
gtgggactgagaggcaag

SEQ ID NO: 17905 - DNA, 18 bp, Artificial Sequence
  Artificial sequence related to HLA knockouts in cell therapy
gggactgagaggcaagag

SEQ ID NO: 17906 - DNA, 18 bp, Artificial Sequence
  Artificial sequence related to HLA knockouts in cell therapy
gttgttcctgcccttccc

SEQ ID NO: 17907 - DNA, 18 bp, Artificial Sequence
  Artificial sequence related to HLA knockouts in cell therapy
cctgcccttccctttgtg

SEQ ID NO: 17908 - DNA, 18 bp, Artificial Sequence
  Artificial sequence related to HLA knockouts in cell therapy
ggcacctgcatgtgtctg

SEQ ID NO: 17909 - DNA, 18 bp, Artificial Sequence
  Artificial sequence related to HLA knockouts in cell therapy
atgtgaggaggtggggag

SEQ ID NO: 17910 - DNA, 18 bp, Artificial Sequence
  Artificial sequence related to HLA knockouts in cell therapy
tgtgaggaggtggggaga

SEQ ID NO: 17911 - DNA, 18 bp, Artificial Sequence
  Artificial sequence related to HLA knockouts in cell therapy
gtgaggaggtggggagac

SEQ ID NO: 17912 - DNA, 18 bp, Artificial Sequence
  Artificial sequence related to HLA knockouts in cell therapy
tgaggaggtggggagacc

SEQ ID NO: 17913 - DNA, 18 bp, Artificial Sequence
  Artificial sequence related to HLA knockouts in cell therapy
gaggaggtggggagacca

SEQ ID NO: 17914 - DNA, 18 bp, Artificial Sequence
  Artificial sequence related to HLA knockouts in cell therapy
aggaggtggggagaccac

SEQ ID NO: 17915 - DNA, 18 bp, Artificial Sequence
  Artificial sequence related to HLA knockouts in cell therapy
ggaggtggggagaccacc

SEQ ID NO: 17916 - DNA, 18 bp, Artificial Sequence
  Artificial sequence related to HLA knockouts in cell therapy
gaggtggggagaccaccc

SEQ ID NO: 17917 - DNA, 18 bp, Artificial Sequence
  Artificial sequence related to HLA knockouts in cell therapy
aggtggggagaccacccc

SEQ ID NO: 17918 - DNA, 18 bp, Artificial Sequence
  Artificial sequence related to HLA knockouts in cell therapy
ggtggggagaccacccca

SEQ ID NO: 17919 - DNA, 18 bp, Artificial Sequence
  Artificial sequence related to HLA knockouts in cell therapy
gtggggagaccaccccac

SEQ ID NO: 17920 - DNA, 18 bp, Artificial Sequence
  Artificial sequence related to HLA knockouts in cell therapy
tggggagaccaccccacc

SEQ ID NO: 17921 - DNA, 18 bp, Artificial Sequence
  Artificial sequence related to HLA knockouts in cell therapy
ggggagaccaccccaccc

SEQ ID NO: 17922 - DNA, 18 bp, Artificial Sequence
  Artificial sequence related to HLA knockouts in cell therapy
gggagaccaccccacccc

SEQ ID NO: 17923 - DNA, 18 bp, Artificial Sequence
  Artificial sequence related to HLA knockouts in cell therapy
ggagaccaccccaccccc

SEQ ID NO: 17924 - DNA, 18 bp, Artificial Sequence
  Artificial sequence related to HLA knockouts in cell therapy
gagaccaccccaccccca

SEQ ID NO: 17925 - DNA, 18 bp, Artificial Sequence
  Artificial sequence related to HLA knockouts in cell therapy
agaccaccccacccccat

SEQ ID NO: 17926 - DNA, 18 bp, Artificial Sequence
  Artificial sequence related to HLA knockouts in cell therapy
gaccaccccacccccatg

SEQ ID NO: 17927 - DNA, 18 bp, Artificial Sequence
  Artificial sequence related to HLA knockouts in cell therapy
accaccccacccccatgt

SEQ ID NO: 17928 - DNA, 18 bp, Artificial Sequence
  Artificial sequence related to HLA knockouts in cell therapy
ccaccccacccccatgtc

SEQ ID NO: 17929 - DNA, 18 bp, Artificial Sequence
  Artificial sequence related to HLA knockouts in cell therapy
caccccacccccatgtcc

SEQ ID NO: 17930 - DNA, 18 bp, Artificial Sequence
  Artificial sequence related to HLA knockouts in cell therapy
accccacccccatgtcca

SEQ ID NO: 17931 - DNA, 18 bp, Artificial Sequence
  Artificial sequence related to HLA knockouts in cell therapy
ccccacccccatgtccac

SEQ ID NO: 17932 - DNA, 18 bp, Artificial Sequence
  Artificial sequence related to HLA knockouts in cell therapy
cccacccccatgtccacc

SEQ ID NO: 17933 - DNA, 18 bp, Artificial Sequence
  Artificial sequence related to HLA knockouts in cell therapy
ccacccccatgtccacca

SEQ ID NO: 17934 - DNA, 18 bp, Artificial Sequence
  Artificial sequence related to HLA knockouts in cell therapy
cacccccatgtccaccat

SEQ ID NO: 17935 - DNA, 18 bp, Artificial Sequence
  Artificial sequence related to HLA knockouts in cell therapy
acccccatgtccaccatg

SEQ ID NO: 17936 - DNA, 18 bp, Artificial Sequence
  Artificial sequence related to HLA knockouts in cell therapy
cccccatgtccaccatga

SEQ ID NO: 17937 - DNA, 18 bp, Artificial Sequence
  Artificial sequence related to HLA knockouts in cell therapy
ccccatgtccaccatgac

SEQ ID NO: 17938 - DNA, 18 bp, Artificial Sequence
  Artificial sequence related to HLA knockouts in cell therapy
cccatgtccaccatgacc

SEQ ID NO: 17939 - DNA, 18 bp, Artificial Sequence
  Artificial sequence related to HLA knockouts in cell therapy
ccatgtccaccatgaccc

SEQ ID NO: 17940 - DNA, 18 bp, Artificial Sequence
  Artificial sequence related to HLA knockouts in cell therapy
ccaccatgaccctcttcc

SEQ ID NO: 17941 - DNA, 18 bp, Artificial Sequence
  Artificial sequence related to HLA knockouts in cell therapy
caccatgaccctcttccc

SEQ ID NO: 17942 - DNA, 18 bp, Artificial Sequence
  Artificial sequence related to HLA knockouts in cell therapy
ccatgaccctcttcccac

SEQ ID NO: 17943 - DNA, 18 bp, Artificial Sequence
  Artificial sequence related to HLA knockouts in cell therapy
catgaccctcttcccacg

SEQ ID NO: 17944 - DNA, 18 bp, Artificial Sequence
  Artificial sequence related to HLA knockouts in cell therapy
atgaccctcttcccacgc

SEQ ID NO: 17945 - DNA, 18 bp, Artificial Sequence
  Artificial sequence related to HLA knockouts in cell therapy
tgaccctcttcccacgct

SEQ ID NO: 17946 - DNA, 18 bp, Artificial Sequence
  Artificial sequence related to HLA knockouts in cell therapy
gaccctcttcccacgctg

SEQ ID NO: 17947 - DNA, 18 bp, Artificial Sequence
  Artificial sequence related to HLA knockouts in cell therapy
accctcttcccacgctga

SEQ ID NO: 17948 - DNA, 18 bp, Artificial Sequence
  Artificial sequence related to HLA knockouts in cell therapy
ccctcttcccacgctgac

SEQ ID NO: 17949 - DNA, 18 bp, Artificial Sequence
  Artificial sequence related to HLA knockouts in cell therapy
cctcttcccacgctgacc

SEQ ID NO: 17950 - DNA, 18 bp, Artificial Sequence
  Artificial sequence related to HLA knockouts in cell therapy
ctcttcccacgctgacct

SEQ ID NO: 17951 - DNA, 18 bp, Artificial Sequence
  Artificial sequence related to HLA knockouts in cell therapy
tcttcccacgctgacctg

SEQ ID NO: 17952 - DNA, 18 bp, Artificial Sequence
  Artificial sequence related to HLA knockouts in cell therapy
cttcccacgctgacctgt

SEQ ID NO: 17953 - DNA, 18 bp, Artificial Sequence
  Artificial sequence related to HLA knockouts in cell therapy
ttcccacgctgacctgtg

SEQ ID NO: 17954 - DNA, 18 bp, Artificial Sequence
  Artificial sequence related to HLA knockouts in cell therapy
tcccacgctgacctgtgc

SEQ ID NO: 17955 - DNA, 18 bp, Artificial Sequence
  Artificial sequence related to HLA knockouts in cell therapy
cccacgctgacctgtgct

SEQ ID NO: 17956 - DNA, 18 bp, Artificial Sequence
  Artificial sequence related to HLA knockouts in cell therapy
ccacgctgacctgtgctc

SEQ ID NO: 17957 - DNA, 18 bp, Artificial Sequence
  Artificial sequence related to HLA knockouts in cell therapy
cacgctgacctgtgctcc

SEQ ID NO: 17958 - DNA, 18 bp, Artificial Sequence
  Artificial sequence related to HLA knockouts in cell therapy
acgctgacctgtgctccc

SEQ ID NO: 17959 - DNA, 18 bp, Artificial Sequence
  Artificial sequence related to HLA knockouts in cell therapy
cgctgacctgtgctccct

SEQ ID NO: 17960 - DNA, 18 bp, Artificial Sequence
  Artificial sequence related to HLA knockouts in cell therapy
gctgacctgtgctccctc

SEQ ID NO: 17961 - DNA, 18 bp, Artificial Sequence
  Artificial sequence related to HLA knockouts in cell therapy
ctgacctgtgctccctcc

SEQ ID NO: 17962 - DNA, 18 bp, Artificial Sequence
  Artificial sequence related to HLA knockouts in cell therapy
tgacctgtgctccctccc

SEQ ID NO: 17963 - DNA, 18 bp, Artificial Sequence
  Artificial sequence related to HLA knockouts in cell therapy
gacctgtgctccctcccc

SEQ ID NO: 17964 - DNA, 18 bp, Artificial Sequence
  Artificial sequence related to HLA knockouts in cell therapy
acctgtgctccctcccca

SEQ ID NO: 17965 - DNA, 18 bp, Artificial Sequence
  Artificial sequence related to HLA knockouts in cell therapy
cctgtgctccctccccaa

SEQ ID NO: 17966 - DNA, 18 bp, Artificial Sequence
  Artificial sequence related to HLA knockouts in cell therapy
ctgtgctccctccccaat

SEQ ID NO: 17967 - DNA, 18 bp, Artificial Sequence
  Artificial sequence related to HLA knockouts in cell therapy
tgtgctccctccccaatc

SEQ ID NO: 17968 - DNA, 18 bp, Artificial Sequence
  Artificial sequence related to HLA knockouts in cell therapy
gtgctccctccccaatca

SEQ ID NO: 17969 - DNA, 18 bp, Artificial Sequence
  Artificial sequence related to HLA knockouts in cell therapy
gctccctccccaatcatc

SEQ ID NO: 17970 - DNA, 18 bp, Artificial Sequence
  Artificial sequence related to HLA knockouts in cell therapy
cctgttccagagaggtgg

SEQ ID NO: 17971 - DNA, 18 bp, Artificial Sequence
  Artificial sequence related to HLA knockouts in cell therapy
ctgttccagagaggtggg

SEQ ID NO: 17972 - DNA, 18 bp, Artificial Sequence
  Artificial sequence related to HLA knockouts in cell therapy
tgttccagagaggtgggg

SEQ ID NO: 17973 - DNA, 18 bp, Artificial Sequence
  Artificial sequence related to HLA knockouts in cell therapy
gttccagagaggtggggc

SEQ ID NO: 17974 - DNA, 18 bp, Artificial Sequence
  Artificial sequence related to HLA knockouts in cell therapy
ttccagagaggtggggct

SEQ ID NO: 17975 - DNA, 18 bp, Artificial Sequence
  Artificial sequence related to HLA knockouts in cell therapy
tccagagaggtggggctg

SEQ ID NO: 17976 - DNA, 18 bp, Artificial Sequence
  Artificial sequence related to HLA knockouts in cell therapy
ccagagaggtggggctga

SEQ ID NO: 17977 - DNA, 18 bp, Artificial Sequence
  Artificial sequence related to HLA knockouts in cell therapy
cagagaggtggggctgag

SEQ ID NO: 17978 - DNA, 18 bp, Artificial Sequence
  Artificial sequence related to HLA knockouts in cell therapy
agagaggtggggctgagg

SEQ ID NO: 17979 - DNA, 18 bp, Artificial Sequence
  Artificial sequence related to HLA knockouts in cell therapy
gagaggtggggctgaggt

SEQ ID NO: 17980 - DNA, 18 bp, Artificial Sequence
  Artificial sequence related to HLA knockouts in cell therapy
agaggtggggctgaggtg

SEQ ID NO: 17981 - DNA, 18 bp, Artificial Sequence
  Artificial sequence related to HLA knockouts in cell therapy
gaggtggggctgaggtgt

SEQ ID NO: 17982 - DNA, 18 bp, Artificial Sequence
  Artificial sequence related to HLA knockouts in cell therapy
aggtggggctgaggtgtc

SEQ ID NO: 17983 - DNA, 18 bp, Artificial Sequence
  Artificial sequence related to HLA knockouts in cell therapy
ggtggggctgaggtgtct

SEQ ID NO: 17984 - DNA, 18 bp, Artificial Sequence
  Artificial sequence related to HLA knockouts in cell therapy
gtggggctgaggtgtctc

SEQ ID NO: 17985 - DNA, 18 bp, Artificial Sequence
  Artificial sequence related to HLA knockouts in cell therapy
tggggctgaggtgtctcc

SEQ ID NO: 17986 - DNA, 18 bp, Artificial Sequence
  Artificial sequence related to HLA knockouts in cell therapy
ggggctgaggtgtctcca

SEQ ID NO: 17987 - DNA, 18 bp, Artificial Sequence
  Artificial sequence related to HLA knockouts in cell therapy
gggctgaggtgtctccat

SEQ ID NO: 17988 - DNA, 18 bp, Artificial Sequence
  Artificial sequence related to HLA knockouts in cell therapy
ggctgaggtgtctccatc

SEQ ID NO: 17989 - DNA, 19 bp, Artificial Sequence
  Artificial sequence related to HLA knockouts in cell therapy
cagaagcagaggggtcagg

SEQ ID NO: 17990 - DNA, 19 bp, Artificial Sequence
  Artificial sequence related to HLA knockouts in cell therapy
agaagcagaggggtcaggg

SEQ ID NO: 17991 - DNA, 19 bp, Artificial Sequence
  Artificial sequence related to HLA knockouts in cell therapy
gaagcagaggggtcagggc

SEQ ID NO: 17992 - DNA, 19 bp, Artificial Sequence
  Artificial sequence related to HLA knockouts in cell therapy
aagcagaggggtcagggcg

SEQ ID NO: 17993 - DNA, 19 bp, Artificial Sequence
  Artificial sequence related to HLA knockouts in cell therapy
agcagaggggtcagggcga

SEQ ID NO: 17994 - DNA, 19 bp, Artificial Sequence
  Artificial sequence related to HLA knockouts in cell therapy
gcagaggggtcagggcgaa

SEQ ID NO: 17995 - DNA, 19 bp, Artificial Sequence
  Artificial sequence related to HLA knockouts in cell therapy
cagaggggtcagggcgaag

SEQ ID NO: 17996 - DNA, 19 bp, Artificial Sequence
  Artificial sequence related to HLA knockouts in cell therapy
agaggggtcagggcgaagt

SEQ ID NO: 17997 - DNA, 19 bp, Artificial Sequence
  Artificial sequence related to HLA knockouts in cell therapy
gaggggtcagggcgaagtc

SEQ ID NO: 17998 - DNA, 19 bp, Artificial Sequence
  Artificial sequence related to HLA knockouts in cell therapy
aggggtcagggcgaagtcc

SEQ ID NO: 17999 - DNA, 19 bp, Artificial Sequence
  Artificial sequence related to HLA knockouts in cell therapy
ggggtcagggcgaagtccc

SEQ ID NO: 18000 - DNA, 19 bp, Artificial Sequence
  Artificial sequence related to HLA knockouts in cell therapy
gggtcagggcgaagtccca

SEQ ID NO: 18001 - DNA, 19 bp, Artificial Sequence
  Artificial sequence related to HLA knockouts in cell therapy
ggtcagggcgaagtcccag

SEQ ID NO: 18002 - DNA, 19 bp, Artificial Sequence
  Artificial sequence related to HLA knockouts in cell therapy
gtcagggcgaagtcccagg

SEQ ID NO: 18003 - DNA, 19 bp, Artificial Sequence
  Artificial sequence related to HLA knockouts in cell therapy
tcagggcgaagtcccaggg

SEQ ID NO: 18004 - DNA, 19 bp, Artificial Sequence
  Artificial sequence related to HLA knockouts in cell therapy
cagggcgaagtcccagggc

SEQ ID NO: 18005 - DNA, 19 bp, Artificial Sequence
  Artificial sequence related to HLA knockouts in cell therapy
agggcgaagtcccagggcc

SEQ ID NO: 18006 - DNA, 19 bp, Artificial Sequence
  Artificial sequence related to HLA knockouts in cell therapy
gggcgaagtcccagggccc

SEQ ID NO: 18007 - DNA, 19 bp, Artificial Sequence
  Artificial sequence related to HLA knockouts in cell therapy
ggcgaagtcccagggcccc

SEQ ID NO: 18008 - DNA, 19 bp, Artificial Sequence
  Artificial sequence related to HLA knockouts in cell therapy
gcgaagtcccagggcccca

SEQ ID NO: 18009 - DNA, 19 bp, Artificial Sequence
  Artificial sequence related to HLA knockouts in cell therapy
cgaagtcccagggccccag

SEQ ID NO: 18010 - DNA, 19 bp, Artificial Sequence
  Artificial sequence related to HLA knockouts in cell therapy
gaagtcccagggccccagg

SEQ ID NO: 18011 - DNA, 19 bp, Artificial Sequence
  Artificial sequence related to HLA knockouts in cell therapy
aagtcccagggccccaggc

SEQ ID NO: 18012 - DNA, 19 bp, Artificial Sequence
  Artificial sequence related to HLA knockouts in cell therapy
agtcccagggccccaggcg

SEQ ID NO: 18013 - DNA, 19 bp, Artificial Sequence
  Artificial sequence related to HLA knockouts in cell therapy
gtcccagggccccaggcgt

SEQ ID NO: 18014 - DNA, 19 bp, Artificial Sequence
  Artificial sequence related to HLA knockouts in cell therapy
tcccagggccccaggcgtg

SEQ ID NO: 18015 - DNA, 19 bp, Artificial Sequence
  Artificial sequence related to HLA knockouts in cell therapy
cccagggccccaggcgtgg

SEQ ID NO: 18016 - DNA, 19 bp, Artificial Sequence
  Artificial sequence related to HLA knockouts in cell therapy
ccagggccccaggcgtggc

SEQ ID NO: 18017 - DNA, 19 bp, Artificial Sequence
  Artificial sequence related to HLA knockouts in cell therapy
cagggccccaggcgtggct

SEQ ID NO: 18018 - DNA, 19 bp, Artificial Sequence
  Artificial sequence related to HLA knockouts in cell therapy
agggccccaggcgtggctc

SEQ ID NO: 18019 - DNA, 19 bp, Artificial Sequence
  Artificial sequence related to HLA knockouts in cell therapy
gggccccaggcgtggctct

SEQ ID NO: 18020 - DNA, 19 bp, Artificial Sequence
  Artificial sequence related to HLA knockouts in cell therapy
ggccccaggcgtggctctc

SEQ ID NO: 18021 - DNA, 19 bp, Artificial Sequence
  Artificial sequence related to HLA knockouts in cell therapy
gccccaggcgtggctctca

SEQ ID NO: 18022 - DNA, 19 bp, Artificial Sequence
  Artificial sequence related to HLA knockouts in cell therapy
ccccaggcgtggctctcag

SEQ ID NO: 18023 - DNA, 19 bp, Artificial Sequence
  Artificial sequence related to HLA knockouts in cell therapy
cccaggcgtggctctcagg

SEQ ID NO: 18024 - DNA, 19 bp, Artificial Sequence
  Artificial sequence related to HLA knockouts in cell therapy
ccaggcgtggctctcaggg

SEQ ID NO: 18025 - DNA, 19 bp, Artificial Sequence
  Artificial sequence related to HLA knockouts in cell therapy
caggcgtggctctcagggt

SEQ ID NO: 18026 - DNA, 19 bp, Artificial Sequence
  Artificial sequence related to HLA knockouts in cell therapy
aggcgtggctctcagggtc

SEQ ID NO: 18027 - DNA, 19 bp, Artificial Sequence
  Artificial sequence related to HLA knockouts in cell therapy
ggcgtggctctcagggtct

SEQ ID NO: 18028 - DNA, 19 bp, Artificial Sequence
  Artificial sequence related to HLA knockouts in cell therapy
gcgtggctctcagggtctc

SEQ ID NO: 18029 - DNA, 19 bp, Artificial Sequence
  Artificial sequence related to HLA knockouts in cell therapy
cgtggctctcagggtctca

SEQ ID NO: 18030 - DNA, 19 bp, Artificial Sequence
  Artificial sequence related to HLA knockouts in cell therapy
gtggctctcagggtctcag

SEQ ID NO: 18031 - DNA, 19 bp, Artificial Sequence
  Artificial sequence related to HLA knockouts in cell therapy
tggctctcagggtctcagg

SEQ ID NO: 18032 - DNA, 19 bp, Artificial Sequence
  Artificial sequence related to HLA knockouts in cell therapy
ggctctcagggtctcaggc

SEQ ID NO: 18033 - DNA, 19 bp, Artificial Sequence
  Artificial sequence related to HLA knockouts in cell therapy
gctctcagggtctcaggcc

SEQ ID NO: 18034 - DNA, 19 bp, Artificial Sequence
  Artificial sequence related to HLA knockouts in cell therapy
ctctcagggtctcaggccc

SEQ ID NO: 18035 - DNA, 19 bp, Artificial Sequence
  Artificial sequence related to HLA knockouts in cell therapy
tctcagggtctcaggcccc

SEQ ID NO: 18036 - DNA, 19 bp, Artificial Sequence
  Artificial sequence related to HLA knockouts in cell therapy
ctcagggtctcaggccccg

SEQ ID NO: 18037 - DNA, 19 bp, Artificial Sequence
  Artificial sequence related to HLA knockouts in cell therapy
tcagggtctcaggccccga

SEQ ID NO: 18038 - DNA, 19 bp, Artificial Sequence
  Artificial sequence related to HLA knockouts in cell therapy
cagggtctcaggccccgaa

SEQ ID NO: 18039 - DNA, 19 bp, Artificial Sequence
  Artificial sequence related to HLA knockouts in cell therapy
agggtctcaggccccgaag

SEQ ID NO: 18040 - DNA, 19 bp, Artificial Sequence
  Artificial sequence related to HLA knockouts in cell therapy
gggtctcaggccccgaagg

SEQ ID NO: 18041 - DNA, 19 bp, Artificial Sequence
  Artificial sequence related to HLA knockouts in cell therapy
ggtctcaggccccgaaggc

SEQ ID NO: 18042 - DNA, 19 bp, Artificial Sequence
  Artificial sequence related to HLA knockouts in cell therapy
gtctcaggccccgaaggcg

SEQ ID NO: 18043 - DNA, 19 bp, Artificial Sequence
  Artificial sequence related to HLA knockouts in cell therapy
tctcaggccccgaaggcgg

SEQ ID NO: 18044 - DNA, 19 bp, Artificial Sequence
  Artificial sequence related to HLA knockouts in cell therapy
ctcaggccccgaaggcggt

SEQ ID NO: 18045 - DNA, 19 bp, Artificial Sequence
  Artificial sequence related to HLA knockouts in cell therapy
tcaggccccgaaggcggtg

SEQ ID NO: 18046 - DNA, 19 bp, Artificial Sequence
  Artificial sequence related to HLA knockouts in cell therapy
caggccccgaaggcggtgt

SEQ ID NO: 18047 - DNA, 19 bp, Artificial Sequence
  Artificial sequence related to HLA knockouts in cell therapy
aggccccgaaggcggtgta

SEQ ID NO: 18048 - DNA, 19 bp, Artificial Sequence
  Artificial sequence related to HLA knockouts in cell therapy
ggccccgaaggcggtgtat

SEQ ID NO: 18049 - DNA, 19 bp, Artificial Sequence
  Artificial sequence related to HLA knockouts in cell therapy
gccccgaaggcggtgtatg

SEQ ID NO: 18050 - DNA, 19 bp, Artificial Sequence
  Artificial sequence related to HLA knockouts in cell therapy
ccccgaaggcggtgtatgg

SEQ ID NO: 18051 - DNA, 19 bp, Artificial Sequence
  Artificial sequence related to HLA knockouts in cell therapy
cccgaaggcggtgtatgga

SEQ ID NO: 18052 - DNA, 19 bp, Artificial Sequence
  Artificial sequence related to HLA knockouts in cell therapy
ggcggtgtatggattgggg

SEQ ID NO: 18053 - DNA, 19 bp, Artificial Sequence
  Artificial sequence related to HLA knockouts in cell therapy
tggattggggagtcccagc

SEQ ID NO: 18054 - DNA, 19 bp, Artificial Sequence
  Artificial sequence related to HLA knockouts in cell therapy
ggattggggagtcccagcc

SEQ ID NO: 18055 - DNA, 19 bp, Artificial Sequence
  Artificial sequence related to HLA knockouts in cell therapy
gattggggagtcccagcct

SEQ ID NO: 18056 - DNA, 19 bp, Artificial Sequence
  Artificial sequence related to HLA knockouts in cell therapy
ttggggagtcccagccttg

SEQ ID NO: 18057 - DNA, 19 bp, Artificial Sequence
  Artificial sequence related to HLA knockouts in cell therapy
tggggagtcccagccttgg

SEQ ID NO: 18058 - DNA, 19 bp, Artificial Sequence
  Artificial sequence related to HLA knockouts in cell therapy
ggggagtcccagccttggg

SEQ ID NO: 18059 - DNA, 19 bp, Artificial Sequence
  Artificial sequence related to HLA knockouts in cell therapy
gggagtcccagccttgggg

SEQ ID NO: 18060 - DNA, 19 bp, Artificial Sequence
  Artificial sequence related to HLA knockouts in cell therapy
ggagtcccagccttgggga

SEQ ID NO: 18061 - DNA, 19 bp, Artificial Sequence
  Artificial sequence related to HLA knockouts in cell therapy
gagtcccagccttggggat

SEQ ID NO: 18062 - DNA, 19 bp, Artificial Sequence
  Artificial sequence related to HLA knockouts in cell therapy
gtcccagccttggggattc

SEQ ID NO: 18063 - DNA, 19 bp, Artificial Sequence
  Artificial sequence related to HLA knockouts in cell therapy
tcccagccttggggattcc

SEQ ID NO: 18064 - DNA, 19 bp, Artificial Sequence
  Artificial sequence related to HLA knockouts in cell therapy
cccagccttggggattccc

SEQ ID NO: 18065 - DNA, 19 bp, Artificial Sequence
  Artificial sequence related to HLA knockouts in cell therapy
ccagccttggggattcccc

SEQ ID NO: 18066 - DNA, 19 bp, Artificial Sequence
  Artificial sequence related to HLA knockouts in cell therapy
cagccttggggattcccca

SEQ ID NO: 18067 - DNA, 19 bp, Artificial Sequence
  Artificial sequence related to HLA knockouts in cell therapy
gccttggggattccccaac

SEQ ID NO: 18068 - DNA, 19 bp, Artificial Sequence
  Artificial sequence related to HLA knockouts in cell therapy
tggggattccccaactccg

SEQ ID NO: 18069 - DNA, 19 bp, Artificial Sequence
  Artificial sequence related to HLA knockouts in cell therapy
ggggattccccaactccgc

SEQ ID NO: 18070 - DNA, 19 bp, Artificial Sequence
  Artificial sequence related to HLA knockouts in cell therapy
gggattccccaactccgca

SEQ ID NO: 18071 - DNA, 19 bp, Artificial Sequence
  Artificial sequence related to HLA knockouts in cell therapy
ggattccccaactccgcag

SEQ ID NO: 18072 - DNA, 19 bp, Artificial Sequence
  Artificial sequence related to HLA knockouts in cell therapy
cctggatactcacgacgcg

SEQ ID NO: 18073 - DNA, 19 bp, Artificial Sequence
  Artificial sequence related to HLA knockouts in cell therapy
ctggatactcacgacgcgg

SEQ ID NO: 18074 - DNA, 19 bp, Artificial Sequence
  Artificial sequence related to HLA knockouts in cell therapy
ggatactcacgacgcggac

SEQ ID NO: 18075 - DNA, 19 bp, Artificial Sequence
  Artificial sequence related to HLA knockouts in cell therapy
gatactcacgacgcggacc

SEQ ID NO: 18076 - DNA, 19 bp, Artificial Sequence
  Artificial sequence related to HLA knockouts in cell therapy
atactcacgacgcggaccc

SEQ ID NO: 18077 - DNA, 19 bp, Artificial Sequence
  Artificial sequence related to HLA knockouts in cell therapy
tactcacgacgcggaccca

SEQ ID NO: 18078 - DNA, 19 bp, Artificial Sequence
  Artificial sequence related to HLA knockouts in cell therapy
actcacgacgcggacccag

SEQ ID NO: 18079 - DNA, 19 bp, Artificial Sequence
  Artificial sequence related to HLA knockouts in cell therapy
ctcacgacgcggacccagt

SEQ ID NO: 18080 - DNA, 19 bp, Artificial Sequence
  Artificial sequence related to HLA knockouts in cell therapy
tcacgacgcggacccagtt

SEQ ID NO: 18081 - DNA, 19 bp, Artificial Sequence
  Artificial sequence related to HLA knockouts in cell therapy
cacgacgcggacccagttc

SEQ ID NO: 18082 - DNA, 19 bp, Artificial Sequence
  Artificial sequence related to HLA knockouts in cell therapy
acgacgcggacccagttct

SEQ ID NO: 18083 - DNA, 19 bp, Artificial Sequence
  Artificial sequence related to HLA knockouts in cell therapy
cgacgcggacccagttctc

SEQ ID NO: 18084 - DNA, 19 bp, Artificial Sequence
  Artificial sequence related to HLA knockouts in cell therapy
gacgcggacccagttctca

SEQ ID NO: 18085 - DNA, 19 bp, Artificial Sequence
  Artificial sequence related to HLA knockouts in cell therapy
acgcggacccagttctcac

SEQ ID NO: 18086 - DNA, 19 bp, Artificial Sequence
  Artificial sequence related to HLA knockouts in cell therapy
cgcggacccagttctcact

SEQ ID NO: 18087 - DNA, 19 bp, Artificial Sequence
  Artificial sequence related to HLA knockouts in cell therapy
gcggacccagttctcactc

SEQ ID NO: 18088 - DNA, 19 bp, Artificial Sequence
  Artificial sequence related to HLA knockouts in cell therapy
cggacccagttctcactcc

SEQ ID NO: 18089 - DNA, 19 bp, Artificial Sequence
  Artificial sequence related to HLA knockouts in cell therapy
ggacccagttctcactccc

SEQ ID NO: 18090 - DNA, 19 bp, Artificial Sequence
  Artificial sequence related to HLA knockouts in cell therapy
cactcccattgggtgtcgg

SEQ ID NO: 18091 - DNA, 19 bp, Artificial Sequence
  Artificial sequence related to HLA knockouts in cell therapy
actcccattgggtgtcggg

SEQ ID NO: 18092 - DNA, 19 bp, Artificial Sequence
  Artificial sequence related to HLA knockouts in cell therapy
ctcccattgggtgtcgggt

SEQ ID NO: 18093 - DNA, 19 bp, Artificial Sequence
  Artificial sequence related to HLA knockouts in cell therapy
gggtgtcgggtttccagag

SEQ ID NO: 18094 - DNA, 19 bp, Artificial Sequence
  Artificial sequence related to HLA knockouts in cell therapy
ccaatcagtgtcgtcgcgg

SEQ ID NO: 18095 - DNA, 19 bp, Artificial Sequence
  Artificial sequence related to HLA knockouts in cell therapy
atcagtgtcgtcgcggtcg

SEQ ID NO: 18096 - DNA, 19 bp, Artificial Sequence
  Artificial sequence related to HLA knockouts in cell therapy
tcagtgtcgtcgcggtcgc

SEQ ID NO: 18097 - DNA, 19 bp, Artificial Sequence
  Artificial sequence related to HLA knockouts in cell therapy
cagtgtcgtcgcggtcgcg

SEQ ID NO: 18098 - DNA, 19 bp, Artificial Sequence
  Artificial sequence related to HLA knockouts in cell therapy
agtgtcgtcgcggtcgcgg

SEQ ID NO: 18099 - DNA, 19 bp, Artificial Sequence
  Artificial sequence related to HLA knockouts in cell therapy
gtgtcgtcgcggtcgcggt

SEQ ID NO: 18100 - DNA, 19 bp, Artificial Sequence
  Artificial sequence related to HLA knockouts in cell therapy
tgtcgtcgcggtcgcggtt

SEQ ID NO: 18101 - DNA, 19 bp, Artificial Sequence
  Artificial sequence related to HLA knockouts in cell therapy
gtcgtcgcggtcgcggttc

SEQ ID NO: 18102 - DNA, 19 bp, Artificial Sequence
  Artificial sequence related to HLA knockouts in cell therapy
tcgtcgcggtcgcggttct

SEQ ID NO: 18103 - DNA, 19 bp, Artificial Sequence
  Artificial sequence related to HLA knockouts in cell therapy
cgtcgcggtcgcggttcta

SEQ ID NO: 18104 - DNA, 19 bp, Artificial Sequence
  Artificial sequence related to HLA knockouts in cell therapy
gtcgcggtcgcggttctaa

SEQ ID NO: 18105 - DNA, 19 bp, Artificial Sequence
  Artificial sequence related to HLA knockouts in cell therapy
cgcggtcgcggttctaaag

SEQ ID NO: 18106 - DNA, 19 bp, Artificial Sequence
  Artificial sequence related to HLA knockouts in cell therapy
ctaaagtccgcacgcaccc

SEQ ID NO: 18107 - DNA, 19 bp, Artificial Sequence
  Artificial sequence related to HLA knockouts in cell therapy
aaagtccgcacgcacccac

SEQ ID NO: 18108 - DNA, 19 bp, Artificial Sequence
  Artificial sequence related to HLA knockouts in cell therapy
aagtccgcacgcacccacc

SEQ ID NO: 18109 - DNA, 19 bp, Artificial Sequence
  Artificial sequence related to HLA knockouts in cell therapy
agtccgcacgcacccaccg

SEQ ID NO: 18110 - DNA, 19 bp, Artificial Sequence
  Artificial sequence related to HLA knockouts in cell therapy
gtccgcacgcacccaccgg

SEQ ID NO: 18111 - DNA, 19 bp, Artificial Sequence
  Artificial sequence related to HLA knockouts in cell therapy
tccgcacgcacccaccggg

SEQ ID NO: 18112 - DNA, 19 bp, Artificial Sequence
  Artificial sequence related to HLA knockouts in cell therapy
ccgcacgcacccaccggga

SEQ ID NO: 18113 - DNA, 19 bp, Artificial Sequence
  Artificial sequence related to HLA knockouts in cell therapy
cgcacgcacccaccgggac

SEQ ID NO: 18114 - DNA, 19 bp, Artificial Sequence
  Artificial sequence related to HLA knockouts in cell therapy
gcacgcacccaccgggact

SEQ ID NO: 18115 - DNA, 19 bp, Artificial Sequence
  Artificial sequence related to HLA knockouts in cell therapy
cacgcacccaccgggactc

SEQ ID NO: 18116 - DNA, 19 bp, Artificial Sequence
  Artificial sequence related to HLA knockouts in cell therapy
acgcacccaccgggactca

SEQ ID NO: 18117 - DNA, 19 bp, Artificial Sequence
  Artificial sequence related to HLA knockouts in cell therapy
cgcacccaccgggactcag

SEQ ID NO: 18118 - DNA, 19 bp, Artificial Sequence
  Artificial sequence related to HLA knockouts in cell therapy
gcacccaccgggactcaga

SEQ ID NO: 18119 - DNA, 19 bp, Artificial Sequence
  Artificial sequence related to HLA knockouts in cell therapy
cacccaccgggactcagat

SEQ ID NO: 18120 - DNA, 19 bp, Artificial Sequence
  Artificial sequence related to HLA knockouts in cell therapy
cccaccgggactcagattc

SEQ ID NO: 18121 - DNA, 19 bp, Artificial Sequence
  Artificial sequence related to HLA knockouts in cell therapy
ccgggactcagattctccc

SEQ ID NO: 18122 - DNA, 19 bp, Artificial Sequence
  Artificial sequence related to HLA knockouts in cell therapy
cgggactcagattctcccc

SEQ ID NO: 18123 - DNA, 19 bp, Artificial Sequence
  Artificial sequence related to HLA knockouts in cell therapy
cagattctccccagacgcc

SEQ ID NO: 18124 - DNA, 19 bp, Artificial Sequence
  Artificial sequence related to HLA knockouts in cell therapy
agattctccccagacgccg

SEQ ID NO: 18125 - DNA, 19 bp, Artificial Sequence
  Artificial sequence related to HLA knockouts in cell therapy
gattctccccagacgccga

SEQ ID NO: 18126 - DNA, 19 bp, Artificial Sequence
  Artificial sequence related to HLA knockouts in cell therapy
attctccccagacgccgag

SEQ ID NO: 18127 - DNA, 19 bp, Artificial Sequence
  Artificial sequence related to HLA knockouts in cell therapy
ttctccccagacgccgagg

SEQ ID NO: 18128 - DNA, 19 bp, Artificial Sequence
  Artificial sequence related to HLA knockouts in cell therapy
tctccccagacgccgagga

SEQ ID NO: 18129 - DNA, 19 bp, Artificial Sequence
  Artificial sequence related to HLA knockouts in cell therapy
ctccccagacgccgaggat

SEQ ID NO: 18130 - DNA, 19 bp, Artificial Sequence
  Artificial sequence related to HLA knockouts in cell therapy
tccccagacgccgaggatg

SEQ ID NO: 18131 - DNA, 19 bp, Artificial Sequence
  Artificial sequence related to HLA knockouts in cell therapy
ccccagacgccgaggatgg

SEQ ID NO: 18132 - DNA, 19 bp, Artificial Sequence
  Artificial sequence related to HLA knockouts in cell therapy
cccagacgccgaggatggc

SEQ ID NO: 18133 - DNA, 19 bp, Artificial Sequence
  Artificial sequence related to HLA knockouts in cell therapy
ccagacgccgaggatggcc

SEQ ID NO: 18134 - DNA, 19 bp, Artificial Sequence
  Artificial sequence related to HLA knockouts in cell therapy
cagacgccgaggatggccg

SEQ ID NO: 18135 - DNA, 19 bp, Artificial Sequence
  Artificial sequence related to HLA knockouts in cell therapy
agacgccgaggatggccgt

SEQ ID NO: 18136 - DNA, 19 bp, Artificial Sequence
  Artificial sequence related to HLA knockouts in cell therapy
gacgccgaggatggccgtc

SEQ ID NO: 18137 - DNA, 19 bp, Artificial Sequence
  Artificial sequence related to HLA knockouts in cell therapy
acgccgaggatggccgtca

SEQ ID NO: 18138 - DNA, 19 bp, Artificial Sequence
  Artificial sequence related to HLA knockouts in cell therapy
cgccgaggatggccgtcat

SEQ ID NO: 18139 - DNA, 19 bp, Artificial Sequence
  Artificial sequence related to HLA knockouts in cell therapy
gccgaggatggccgtcatg

SEQ ID NO: 18140 - DNA, 19 bp, Artificial Sequence
  Artificial sequence related to HLA knockouts in cell therapy
ccgaggatggccgtcatgg

SEQ ID NO: 18141 - DNA, 19 bp, Artificial Sequence
  Artificial sequence related to HLA knockouts in cell therapy
cgaggatggccgtcatggc

SEQ ID NO: 18142 - DNA, 19 bp, Artificial Sequence
  Artificial sequence related to HLA knockouts in cell therapy
gaggatggccgtcatggcg

SEQ ID NO: 18143 - DNA, 19 bp, Artificial Sequence
  Artificial sequence related to HLA knockouts in cell therapy
aggatggccgtcatggcgc

SEQ ID NO: 18144 - DNA, 19 bp, Artificial Sequence
  Artificial sequence related to HLA knockouts in cell therapy
ggatggccgtcatggcgcc

SEQ ID NO: 18145 - DNA, 19 bp, Artificial Sequence
  Artificial sequence related to HLA knockouts in cell therapy
gatggccgtcatggcgccc

SEQ ID NO: 18146 - DNA, 19 bp, Artificial Sequence
  Artificial sequence related to HLA knockouts in cell therapy
atggccgtcatggcgcccc

SEQ ID NO: 18147 - DNA, 19 bp, Artificial Sequence
  Artificial sequence related to HLA knockouts in cell therapy
tggccgtcatggcgccccg

SEQ ID NO: 18148 - DNA, 19 bp, Artificial Sequence
  Artificial sequence related to HLA knockouts in cell therapy
ggccgtcatggcgccccga

SEQ ID NO: 18149 - DNA, 19 bp, Artificial Sequence
  Artificial sequence related to HLA knockouts in cell therapy
gccgtcatggcgccccgaa

SEQ ID NO: 18150 - DNA, 19 bp, Artificial Sequence
  Artificial sequence related to HLA knockouts in cell therapy
ccgtcatggcgccccgaac

SEQ ID NO: 18151 - DNA, 19 bp, Artificial Sequence
  Artificial sequence related to HLA knockouts in cell therapy
cgtcatggcgccccgaacc

SEQ ID NO: 18152 - DNA, 19 bp, Artificial Sequence
  Artificial sequence related to HLA knockouts in cell therapy
gtcatggcgccccgaaccc

SEQ ID NO: 18153 - DNA, 19 bp, Artificial Sequence
  Artificial sequence related to HLA knockouts in cell therapy
tcatggcgccccgaaccct

SEQ ID NO: 18154 - DNA, 19 bp, Artificial Sequence
  Artificial sequence related to HLA knockouts in cell therapy
catggcgccccgaaccctc

SEQ ID NO: 18155 - DNA, 19 bp, Artificial Sequence
  Artificial sequence related to HLA knockouts in cell therapy
atggcgccccgaaccctcg

SEQ ID NO: 18156 - DNA, 19 bp, Artificial Sequence
  Artificial sequence related to HLA knockouts in cell therapy
tggcgccccgaaccctcgt

SEQ ID NO: 18157 - DNA, 19 bp, Artificial Sequence
  Artificial sequence related to HLA knockouts in cell therapy
ggcgccccgaaccctcgtc

SEQ ID NO: 18158 - DNA, 19 bp, Artificial Sequence
  Artificial sequence related to HLA knockouts in cell therapy
gcgccccgaaccctcgtcc

SEQ ID NO: 18159 - DNA, 19 bp, Artificial Sequence
  Artificial sequence related to HLA knockouts in cell therapy
cgccccgaaccctcgtcct

SEQ ID NO: 18160 - DNA, 19 bp, Artificial Sequence
  Artificial sequence related to HLA knockouts in cell therapy
gccccgaaccctcgtcctg

SEQ ID NO: 18161 - DNA, 19 bp, Artificial Sequence
  Artificial sequence related to HLA knockouts in cell therapy
ccccgaaccctcgtcctgc

SEQ ID NO: 18162 - DNA, 19 bp, Artificial Sequence
  Artificial sequence related to HLA knockouts in cell therapy
cccgaaccctcgtcctgct

SEQ ID NO: 18163 - DNA, 19 bp, Artificial Sequence
  Artificial sequence related to HLA knockouts in cell therapy
ccgaaccctcgtcctgcta

SEQ ID NO: 18164 - DNA, 19 bp, Artificial Sequence
  Artificial sequence related to HLA knockouts in cell therapy
cgaaccctcgtcctgctac

SEQ ID NO: 18165 - DNA, 19 bp, Artificial Sequence
  Artificial sequence related to HLA knockouts in cell therapy
ccctcgtcctgctactctc

SEQ ID NO: 18166 - DNA, 19 bp, Artificial Sequence
  Artificial sequence related to HLA knockouts in cell therapy
cctcgtcctgctactctcg

SEQ ID NO: 18167 - DNA, 19 bp, Artificial Sequence
  Artificial sequence related to HLA knockouts in cell therapy
ctcgtcctgctactctcgg

SEQ ID NO: 18168 - DNA, 19 bp, Artificial Sequence
  Artificial sequence related to HLA knockouts in cell therapy
tcgtcctgctactctcggg

SEQ ID NO: 18169 - DNA, 19 bp, Artificial Sequence
  Artificial sequence related to HLA knockouts in cell therapy
cgtcctgctactctcgggg

SEQ ID NO: 18170 - DNA, 19 bp, Artificial Sequence
  Artificial sequence related to HLA knockouts in cell therapy
gtcctgctactctcggggg

SEQ ID NO: 18171 - DNA, 19 bp, Artificial Sequence
  Artificial sequence related to HLA knockouts in cell therapy
tcctgctactctcgggggc

SEQ ID NO: 18172 - DNA, 19 bp, Artificial Sequence
  Artificial sequence related to HLA knockouts in cell therapy
cctgctactctcgggggct

SEQ ID NO: 18173 - DNA, 19 bp, Artificial Sequence
  Artificial sequence related to HLA knockouts in cell therapy
ctgctactctcgggggctc

SEQ ID NO: 18174 - DNA, 19 bp, Artificial Sequence
  Artificial sequence related to HLA knockouts in cell therapy
tgctactctcgggggctct

SEQ ID NO: 18175 - DNA, 19 bp, Artificial Sequence
  Artificial sequence related to HLA knockouts in cell therapy
gctactctcgggggctctg

SEQ ID NO: 18176 - DNA, 19 bp, Artificial Sequence
  Artificial sequence related to HLA knockouts in cell therapy
ctactctcgggggctctgg

SEQ ID NO: 18177 - DNA, 19 bp, Artificial Sequence
  Artificial sequence related to HLA knockouts in cell therapy
tactctcgggggctctggc

SEQ ID NO: 18178 - DNA, 19 bp, Artificial Sequence
  Artificial sequence related to HLA knockouts in cell therapy
actctcgggggctctggcc

SEQ ID NO: 18179 - DNA, 19 bp, Artificial Sequence
  Artificial sequence related to HLA knockouts in cell therapy
ctctcgggggctctggccc

SEQ ID NO: 18180 - DNA, 19 bp, Artificial Sequence
  Artificial sequence related to HLA knockouts in cell therapy
tctcgggggctctggccct

SEQ ID NO: 18181 - DNA, 19 bp, Artificial Sequence
  Artificial sequence related to HLA knockouts in cell therapy
ctcgggggctctggccctg

SEQ ID NO: 18182 - DNA, 19 bp, Artificial Sequence
  Artificial sequence related to HLA knockouts in cell therapy
tcgggggctctggccctga

SEQ ID NO: 18183 - DNA, 19 bp, Artificial Sequence
  Artificial sequence related to HLA knockouts in cell therapy
cgggggctctggccctgac

SEQ ID NO: 18184 - DNA, 19 bp, Artificial Sequence
  Artificial sequence related to HLA knockouts in cell therapy
gggggctctggccctgacc

SEQ ID NO: 18185 - DNA, 19 bp, Artificial Sequence
  Artificial sequence related to HLA knockouts in cell therapy
ggggctctggccctgaccc

SEQ ID NO: 18186 - DNA, 19 bp, Artificial Sequence
  Artificial sequence related to HLA knockouts in cell therapy
gggctctggccctgaccca

SEQ ID NO: 18187 - DNA, 19 bp, Artificial Sequence
  Artificial sequence related to HLA knockouts in cell therapy
ggctctggccctgacccag

SEQ ID NO: 18188 - DNA, 19 bp, Artificial Sequence
  Artificial sequence related to HLA knockouts in cell therapy
gctctggccctgacccaga

SEQ ID NO: 18189 - DNA, 19 bp, Artificial Sequence
  Artificial sequence related to HLA knockouts in cell therapy
ctctggccctgacccagac

SEQ ID NO: 18190 - DNA, 19 bp, Artificial Sequence
  Artificial sequence related to HLA knockouts in cell therapy
tctggccctgacccagacc

SEQ ID NO: 18191 - DNA, 19 bp, Artificial Sequence
  Artificial sequence related to HLA knockouts in cell therapy
ctggccctgacccagacct

SEQ ID NO: 18192 - DNA, 19 bp, Artificial Sequence
  Artificial sequence related to HLA knockouts in cell therapy
tggccctgacccagacctg

SEQ ID NO: 18193 - DNA, 19 bp, Artificial Sequence
  Artificial sequence related to HLA knockouts in cell therapy
ggccctgacccagacctgg

SEQ ID NO: 18194 - DNA, 19 bp, Artificial Sequence
  Artificial sequence related to HLA knockouts in cell therapy
gccctgacccagacctggg

SEQ ID NO: 18195 - DNA, 19 bp, Artificial Sequence
  Artificial sequence related to HLA knockouts in cell therapy
ccctgacccagacctgggc

SEQ ID NO: 18196 - DNA, 19 bp, Artificial Sequence
  Artificial sequence related to HLA knockouts in cell therapy
cctgacccagacctgggcg

SEQ ID NO: 18197 - DNA, 19 bp, Artificial Sequence
  Artificial sequence related to HLA knockouts in cell therapy
ctgacccagacctgggcgg

SEQ ID NO: 18198 - DNA, 19 bp, Artificial Sequence
  Artificial sequence related to HLA knockouts in cell therapy
tgacccagacctgggcggg

SEQ ID NO: 18199 - DNA, 19 bp, Artificial Sequence
  Artificial sequence related to HLA knockouts in cell therapy
gacccagacctgggcgggc

SEQ ID NO: 18200 - DNA, 19 bp, Artificial Sequence
  Artificial sequence related to HLA knockouts in cell therapy
acccagacctgggcgggct

SEQ ID NO: 18201 - DNA, 19 bp, Artificial Sequence
  Artificial sequence related to HLA knockouts in cell therapy
cccagacctgggcgggctc

SEQ ID NO: 18202 - DNA, 19 bp, Artificial Sequence
  Artificial sequence related to HLA knockouts in cell therapy
ccagacctgggcgggctct

SEQ ID NO: 18203 - DNA, 19 bp, Artificial Sequence
  Artificial sequence related to HLA knockouts in cell therapy
cagacctgggcgggctctc

SEQ ID NO: 18204 - DNA, 19 bp, Artificial Sequence
  Artificial sequence related to HLA knockouts in cell therapy
agacctgggcgggctctca

SEQ ID NO: 18205 - DNA, 19 bp, Artificial Sequence
  Artificial sequence related to HLA knockouts in cell therapy
gacctgggcgggctctcac

SEQ ID NO: 18206 - DNA, 19 bp, Artificial Sequence
  Artificial sequence related to HLA knockouts in cell therapy
acctgggcgggctctcact

SEQ ID NO: 18207 - DNA, 19 bp, Artificial Sequence
  Artificial sequence related to HLA knockouts in cell therapy
cctgggcgggctctcactc

SEQ ID NO: 18208 - DNA, 19 bp, Artificial Sequence
  Artificial sequence related to HLA knockouts in cell therapy
ctgggcgggctctcactcc

SEQ ID NO: 18209 - DNA, 19 bp, Artificial Sequence
  Artificial sequence related to HLA knockouts in cell therapy
tgggcgggctctcactcca

SEQ ID NO: 18210 - DNA, 19 bp, Artificial Sequence
  Artificial sequence related to HLA knockouts in cell therapy
gggcgggctctcactccat

SEQ ID NO: 18211 - DNA, 19 bp, Artificial Sequence
  Artificial sequence related to HLA knockouts in cell therapy
ggcgggctctcactccatg

SEQ ID NO: 18212 - DNA, 19 bp, Artificial Sequence
  Artificial sequence related to HLA knockouts in cell therapy
gcgggctctcactccatga

SEQ ID NO: 18213 - DNA, 19 bp, Artificial Sequence
  Artificial sequence related to HLA knockouts in cell therapy
cgggctctcactccatgag

SEQ ID NO: 18214 - DNA, 19 bp, Artificial Sequence
  Artificial sequence related to HLA knockouts in cell therapy
gggctctcactccatgagg

SEQ ID NO: 18215 - DNA, 19 bp, Artificial Sequence
  Artificial sequence related to HLA knockouts in cell therapy
cttcacatccgtgtcccgg

SEQ ID NO: 18216 - DNA, 19 bp, Artificial Sequence
  Artificial sequence related to HLA knockouts in cell therapy
ttcacatccgtgtcccggc

SEQ ID NO: 18217 - DNA, 19 bp, Artificial Sequence
  Artificial sequence related to HLA knockouts in cell therapy
tcacatccgtgtcccggcc

SEQ ID NO: 18218 - DNA, 19 bp, Artificial Sequence
  Artificial sequence related to HLA knockouts in cell therapy
cacatccgtgtcccggccc

SEQ ID NO: 18219 - DNA, 19 bp, Artificial Sequence
  Artificial sequence related to HLA knockouts in cell therapy
acatccgtgtcccggcccg

SEQ ID NO: 18220 - DNA, 19 bp, Artificial Sequence
  Artificial sequence related to HLA knockouts in cell therapy
catccgtgtcccggcccgg

SEQ ID NO: 18221 - DNA, 19 bp, Artificial Sequence
  Artificial sequence related to HLA knockouts in cell therapy
atccgtgtcccggcccggc

SEQ ID NO: 18222 - DNA, 19 bp, Artificial Sequence
  Artificial sequence related to HLA knockouts in cell therapy
tccgtgtcccggcccggcc

SEQ ID NO: 18223 - DNA, 19 bp, Artificial Sequence
  Artificial sequence related to HLA knockouts in cell therapy
ccgtgtcccggcccggccg

SEQ ID NO: 18224 - DNA, 19 bp, Artificial Sequence
  Artificial sequence related to HLA knockouts in cell therapy
cgtgtcccggcccggccgc

SEQ ID NO: 18225 - DNA, 19 bp, Artificial Sequence
  Artificial sequence related to HLA knockouts in cell therapy
gtgtcccggcccggccgcg

SEQ ID NO: 18226 - DNA, 19 bp, Artificial Sequence
  Artificial sequence related to HLA knockouts in cell therapy
tgtcccggcccggccgcgg

SEQ ID NO: 18227 - DNA, 19 bp, Artificial Sequence
  Artificial sequence related to HLA knockouts in cell therapy
gtcccggcccggccgcggg

SEQ ID NO: 18228 - DNA, 19 bp, Artificial Sequence
  Artificial sequence related to HLA knockouts in cell therapy
tcccggcccggccgcgggg

SEQ ID NO: 18229 - DNA, 19 bp, Artificial Sequence
  Artificial sequence related to HLA knockouts in cell therapy
cccggcccggccgcgggga

SEQ ID NO: 18230 - DNA, 19 bp, Artificial Sequence
  Artificial sequence related to HLA knockouts in cell therapy
ccggcccggccgcggggag

SEQ ID NO: 18231 - DNA, 19 bp, Artificial Sequence
  Artificial sequence related to HLA knockouts in cell therapy
cggcccggccgcggggagc

SEQ ID NO: 18232 - DNA, 19 bp, Artificial Sequence
  Artificial sequence related to HLA knockouts in cell therapy
ggcccggccgcggggagcc

SEQ ID NO: 18233 - DNA, 19 bp, Artificial Sequence
  Artificial sequence related to HLA knockouts in cell therapy
gcccggccgcggggagccc

SEQ ID NO: 18234 - DNA, 19 bp, Artificial Sequence
  Artificial sequence related to HLA knockouts in cell therapy
cccggccgcggggagcccc

SEQ ID NO: 18235 - DNA, 19 bp, Artificial Sequence
  Artificial sequence related to HLA knockouts in cell therapy
ccggccgcggggagccccg

SEQ ID NO: 18236 - DNA, 19 bp, Artificial Sequence
  Artificial sequence related to HLA knockouts in cell therapy
cggccgcggggagccccgc

SEQ ID NO: 18237 - DNA, 19 bp, Artificial Sequence
  Artificial sequence related to HLA knockouts in cell therapy
ggccgcggggagccccgct

SEQ ID NO: 18238 - DNA, 19 bp, Artificial Sequence
  Artificial sequence related to HLA knockouts in cell therapy
gccgcggggagccccgctt

SEQ ID NO: 18239 - DNA, 19 bp, Artificial Sequence
  Artificial sequence related to HLA knockouts in cell therapy
ccgcggggagccccgcttc

SEQ ID NO: 18240 - DNA, 19 bp, Artificial Sequence
  Artificial sequence related to HLA knockouts in cell therapy
cgcggggagccccgcttca

SEQ ID NO: 18241 - DNA, 19 bp, Artificial Sequence
  Artificial sequence related to HLA knockouts in cell therapy
gcggggagccccgcttcat

SEQ ID NO: 18242 - DNA, 19 bp, Artificial Sequence
  Artificial sequence related to HLA knockouts in cell therapy
cggggagccccgcttcatc

SEQ ID NO: 18243 - DNA, 19 bp, Artificial Sequence
  Artificial sequence related to HLA knockouts in cell therapy
ggggagccccgcttcatcg

SEQ ID NO: 18244 - DNA, 19 bp, Artificial Sequence
  Artificial sequence related to HLA knockouts in cell therapy
gggagccccgcttcatcgc

SEQ ID NO: 18245 - DNA, 19 bp, Artificial Sequence
  Artificial sequence related to HLA knockouts in cell therapy
ggagccccgcttcatcgca

SEQ ID NO: 18246 - DNA, 19 bp, Artificial Sequence
  Artificial sequence related to HLA knockouts in cell therapy
gagccccgcttcatcgcag

SEQ ID NO: 18247 - DNA, 19 bp, Artificial Sequence
  Artificial sequence related to HLA knockouts in cell therapy
agccccgcttcatcgcagt

SEQ ID NO: 18248 - DNA, 19 bp, Artificial Sequence
  Artificial sequence related to HLA knockouts in cell therapy
gccccgcttcatcgcagtg

SEQ ID NO: 18249 - DNA, 19 bp, Artificial Sequence
  Artificial sequence related to HLA knockouts in cell therapy
ccccgcttcatcgcagtgg

SEQ ID NO: 18250 - DNA, 19 bp, Artificial Sequence
  Artificial sequence related to HLA knockouts in cell therapy
cccgcttcatcgcagtggg

SEQ ID NO: 18251 - DNA, 19 bp, Artificial Sequence
  Artificial sequence related to HLA knockouts in cell therapy
ccgcttcatcgcagtgggc

SEQ ID NO: 18252 - DNA, 19 bp, Artificial Sequence
  Artificial sequence related to HLA knockouts in cell therapy
cgcttcatcgcagtgggct

SEQ ID NO: 18253 - DNA, 19 bp, Artificial Sequence
  Artificial sequence related to HLA knockouts in cell therapy
catcgcagtgggctacgtg

SEQ ID NO: 18254 - DNA, 19 bp, Artificial Sequence
  Artificial sequence related to HLA knockouts in cell therapy
atcgcagtgggctacgtgg

SEQ ID NO: 18255 - DNA, 19 bp, Artificial Sequence
  Artificial sequence related to HLA knockouts in cell therapy
tcgcagtgggctacgtgga

SEQ ID NO: 18256 - DNA, 19 bp, Artificial Sequence
  Artificial sequence related to HLA knockouts in cell therapy
cgcagtgggctacgtggac

SEQ ID NO: 18257 - DNA, 19 bp, Artificial Sequence
  Artificial sequence related to HLA knockouts in cell therapy
gcagtgggctacgtggacg

SEQ ID NO: 18258 - DNA, 19 bp, Artificial Sequence
  Artificial sequence related to HLA knockouts in cell therapy
cagtgggctacgtggacga

SEQ ID NO: 18259 - DNA, 19 bp, Artificial Sequence
  Artificial sequence related to HLA knockouts in cell therapy
agtgggctacgtggacgac

SEQ ID NO: 18260 - DNA, 19 bp, Artificial Sequence
  Artificial sequence related to HLA knockouts in cell therapy
gtgggctacgtggacgaca

SEQ ID NO: 18261 - DNA, 19 bp, Artificial Sequence
  Artificial sequence related to HLA knockouts in cell therapy
tgggctacgtggacgacac

SEQ ID NO: 18262 - DNA, 19 bp, Artificial Sequence
  Artificial sequence related to HLA knockouts in cell therapy
gggctacgtggacgacacg

SEQ ID NO: 18263 - DNA, 19 bp, Artificial Sequence
  Artificial sequence related to HLA knockouts in cell therapy
ggctacgtggacgacacgc

SEQ ID NO: 18264 - DNA, 19 bp, Artificial Sequence
  Artificial sequence related to HLA knockouts in cell therapy
gctacgtggacgacacgca

SEQ ID NO: 18265 - DNA, 19 bp, Artificial Sequence
  Artificial sequence related to HLA knockouts in cell therapy
ctacgtggacgacacgcag

SEQ ID NO: 18266 - DNA, 19 bp, Artificial Sequence
  Artificial sequence related to HLA knockouts in cell therapy
cgtggacgacacgcagttc

SEQ ID NO: 18267 - DNA, 19 bp, Artificial Sequence
  Artificial sequence related to HLA knockouts in cell therapy
gtggacgacacgcagttcg

SEQ ID NO: 18268 - DNA, 19 bp, Artificial Sequence
  Artificial sequence related to HLA knockouts in cell therapy
ggacgacacgcagttcgtg

SEQ ID NO: 18269 - DNA, 19 bp, Artificial Sequence
  Artificial sequence related to HLA knockouts in cell therapy
gacgacacgcagttcgtgc

SEQ ID NO: 18270 - DNA, 19 bp, Artificial Sequence
  Artificial sequence related to HLA knockouts in cell therapy
acgacacgcagttcgtgcg

SEQ ID NO: 18271 - DNA, 19 bp, Artificial Sequence
  Artificial sequence related to HLA knockouts in cell therapy
cgacacgcagttcgtgcgg

SEQ ID NO: 18272 - DNA, 19 bp, Artificial Sequence
  Artificial sequence related to HLA knockouts in cell therapy
gacacgcagttcgtgcggt

SEQ ID NO: 18273 - DNA, 19 bp, Artificial Sequence
  Artificial sequence related to HLA knockouts in cell therapy
cacgcagttcgtgcggttc

SEQ ID NO: 18274 - DNA, 19 bp, Artificial Sequence
  Artificial sequence related to HLA knockouts in cell therapy
acgcagttcgtgcggttcg

SEQ ID NO: 18275 - DNA, 19 bp, Artificial Sequence
  Artificial sequence related to HLA knockouts in cell therapy
cgcagttcgtgcggttcga

SEQ ID NO: 18276 - DNA, 19 bp, Artificial Sequence
  Artificial sequence related to HLA knockouts in cell therapy
gcagttcgtgcggttcgac

SEQ ID NO: 18277 - DNA, 19 bp, Artificial Sequence
  Artificial sequence related to HLA knockouts in cell therapy
gttcgtgcggttcgacagc

SEQ ID NO: 18278 - DNA, 19 bp, Artificial Sequence
  Artificial sequence related to HLA knockouts in cell therapy
ttcgtgcggttcgacagcg

SEQ ID NO: 18279 - DNA, 19 bp, Artificial Sequence
  Artificial sequence related to HLA knockouts in cell therapy
tcgtgcggttcgacagcga

SEQ ID NO: 18280 - DNA, 19 bp, Artificial Sequence
  Artificial sequence related to HLA knockouts in cell therapy
cgtgcggttcgacagcgac

SEQ ID NO: 18281 - DNA, 19 bp, Artificial Sequence
  Artificial sequence related to HLA knockouts in cell therapy
gtgcggttcgacagcgacg

SEQ ID NO: 18282 - DNA, 19 bp, Artificial Sequence
  Artificial sequence related to HLA knockouts in cell therapy
tgcggttcgacagcgacgc

SEQ ID NO: 18283 - DNA, 19 bp, Artificial Sequence
  Artificial sequence related to HLA knockouts in cell therapy
gcggttcgacagcgacgcc

SEQ ID NO: 18284 - DNA, 19 bp, Artificial Sequence
  Artificial sequence related to HLA knockouts in cell therapy
cggttcgacagcgacgccg

SEQ ID NO: 18285 - DNA, 19 bp, Artificial Sequence
  Artificial sequence related to HLA knockouts in cell therapy
ggttcgacagcgacgccgc

SEQ ID NO: 18286 - DNA, 19 bp, Artificial Sequence
  Artificial sequence related to HLA knockouts in cell therapy
gttcgacagcgacgccgcg

SEQ ID NO: 18287 - DNA, 19 bp, Artificial Sequence
  Artificial sequence related to HLA knockouts in cell therapy
ttcgacagcgacgccgcga

SEQ ID NO: 18288 - DNA, 19 bp, Artificial Sequence
  Artificial sequence related to HLA knockouts in cell therapy
tcgacagcgacgccgcgag

SEQ ID NO: 18289 - DNA, 19 bp, Artificial Sequence
  Artificial sequence related to HLA knockouts in cell therapy
cgacagcgacgccgcgagc

SEQ ID NO: 18290 - DNA, 19 bp, Artificial Sequence
  Artificial sequence related to HLA knockouts in cell therapy
gacagcgacgccgcgagcc

SEQ ID NO: 18291 - DNA, 19 bp, Artificial Sequence
  Artificial sequence related to HLA knockouts in cell therapy
acagcgacgccgcgagcca

SEQ ID NO: 18292 - DNA, 19 bp, Artificial Sequence
  Artificial sequence related to HLA knockouts in cell therapy
cagcgacgccgcgagccag

SEQ ID NO: 18293 - DNA, 19 bp, Artificial Sequence
  Artificial sequence related to HLA knockouts in cell therapy
agcgacgccgcgagccaga

SEQ ID NO: 18294 - DNA, 19 bp, Artificial Sequence
  Artificial sequence related to HLA knockouts in cell therapy
gcgacgccgcgagccagag

SEQ ID NO: 18295 - DNA, 19 bp, Artificial Sequence
  Artificial sequence related to HLA knockouts in cell therapy
cgacgccgcgagccagagg

SEQ ID NO: 18296 - DNA, 19 bp, Artificial Sequence
  Artificial sequence related to HLA knockouts in cell therapy
gacgccgcgagccagagga

SEQ ID NO: 18297 - DNA, 19 bp, Artificial Sequence
  Artificial sequence related to HLA knockouts in cell therapy
acgccgcgagccagaggat

SEQ ID NO: 18298 - DNA, 19 bp, Artificial Sequence
  Artificial sequence related to HLA knockouts in cell therapy
cgccgcgagccagaggatg

SEQ ID NO: 18299 - DNA, 19 bp, Artificial Sequence
  Artificial sequence related to HLA knockouts in cell therapy
gccgcgagccagaggatgg

SEQ ID NO: 18300 - DNA, 19 bp, Artificial Sequence
  Artificial sequence related to HLA knockouts in cell therapy
ccgcgagccagaggatgga

SEQ ID NO: 18301 - DNA, 19 bp, Artificial Sequence
  Artificial sequence related to HLA knockouts in cell therapy
cgcgagccagaggatggag

SEQ ID NO: 18302 - DNA, 19 bp, Artificial Sequence
  Artificial sequence related to HLA knockouts in cell therapy
gcgagccagaggatggagc

SEQ ID NO: 18303 - DNA, 19 bp, Artificial Sequence
  Artificial sequence related to HLA knockouts in cell therapy
cgagccagaggatggagcc

SEQ ID NO: 18304 - DNA, 19 bp, Artificial Sequence
  Artificial sequence related to HLA knockouts in cell therapy
gagccagaggatggagccg

SEQ ID NO: 18305 - DNA, 19 bp, Artificial Sequence
  Artificial sequence related to HLA knockouts in cell therapy
agccagaggatggagccgc

SEQ ID NO: 18306 - DNA, 19 bp, Artificial Sequence
  Artificial sequence related to HLA knockouts in cell therapy
gccagaggatggagccgcg

SEQ ID NO: 18307 - DNA, 19 bp, Artificial Sequence
  Artificial sequence related to HLA knockouts in cell therapy
ccagaggatggagccgcgg

SEQ ID NO: 18308 - DNA, 19 bp, Artificial Sequence
  Artificial sequence related to HLA knockouts in cell therapy
cagaggatggagccgcggg

SEQ ID NO: 18309 - DNA, 19 bp, Artificial Sequence
  Artificial sequence related to HLA knockouts in cell therapy
agaggatggagccgcgggc

SEQ ID NO: 18310 - DNA, 19 bp, Artificial Sequence
  Artificial sequence related to HLA knockouts in cell therapy
gaggatggagccgcgggcg

SEQ ID NO: 18311 - DNA, 19 bp, Artificial Sequence
  Artificial sequence related to HLA knockouts in cell therapy
aggatggagccgcgggcgc

SEQ ID NO: 18312 - DNA, 19 bp, Artificial Sequence
  Artificial sequence related to HLA knockouts in cell therapy
ggatggagccgcgggcgcc

SEQ ID NO: 18313 - DNA, 19 bp, Artificial Sequence
  Artificial sequence related to HLA knockouts in cell therapy
gatggagccgcgggcgccg

SEQ ID NO: 18314 - DNA, 19 bp, Artificial Sequence
  Artificial sequence related to HLA knockouts in cell therapy
atggagccgcgggcgccgt

SEQ ID NO: 18315 - DNA, 19 bp, Artificial Sequence
  Artificial sequence related to HLA knockouts in cell therapy
tggagccgcgggcgccgtg

SEQ ID NO: 18316 - DNA, 19 bp, Artificial Sequence
  Artificial sequence related to HLA knockouts in cell therapy
ggagccgcgggcgccgtgg

SEQ ID NO: 18317 - DNA, 19 bp, Artificial Sequence
  Artificial sequence related to HLA knockouts in cell therapy
gagccgcgggcgccgtgga

SEQ ID NO: 18318 - DNA, 19 bp, Artificial Sequence
  Artificial sequence related to HLA knockouts in cell therapy
agccgcgggcgccgtggat

SEQ ID NO: 18319 - DNA, 19 bp, Artificial Sequence
  Artificial sequence related to HLA knockouts in cell therapy
gccgcgggcgccgtggata

SEQ ID NO: 18320 - DNA, 19 bp, Artificial Sequence
  Artificial sequence related to HLA knockouts in cell therapy
ccgcgggcgccgtggatag

SEQ ID NO: 18321 - DNA, 19 bp, Artificial Sequence
  Artificial sequence related to HLA knockouts in cell therapy
cgcgggcgccgtggataga

SEQ ID NO: 18322 - DNA, 19 bp, Artificial Sequence
  Artificial sequence related to HLA knockouts in cell therapy
gcgggcgccgtggatagag

SEQ ID NO: 18323 - DNA, 19 bp, Artificial Sequence
  Artificial sequence related to HLA knockouts in cell therapy
cgggcgccgtggatagagc

SEQ ID NO: 18324 - DNA, 19 bp, Artificial Sequence
  Artificial sequence related to HLA knockouts in cell therapy
gggcgccgtggatagagca

SEQ ID NO: 18325 - DNA, 19 bp, Artificial Sequence
  Artificial sequence related to HLA knockouts in cell therapy
ggcgccgtggatagagcag

SEQ ID NO: 18326 - DNA, 19 bp, Artificial Sequence
  Artificial sequence related to HLA knockouts in cell therapy
gcgccgtggatagagcagg

SEQ ID NO: 18327 - DNA, 19 bp, Artificial Sequence
  Artificial sequence related to HLA knockouts in cell therapy
cgccgtggatagagcagga

SEQ ID NO: 18328 - DNA, 19 bp, Artificial Sequence
  Artificial sequence related to HLA knockouts in cell therapy
gccgtggatagagcaggag

SEQ ID NO: 18329 - DNA, 19 bp, Artificial Sequence
  Artificial sequence related to HLA knockouts in cell therapy
ccgtggatagagcaggagg

SEQ ID NO: 18330 - DNA, 19 bp, Artificial Sequence
  Artificial sequence related to HLA knockouts in cell therapy
cgtggatagagcaggaggg

SEQ ID NO: 18331 - DNA, 19 bp, Artificial Sequence
  Artificial sequence related to HLA knockouts in cell therapy
ggatagagcaggagggtcc

SEQ ID NO: 18332 - DNA, 19 bp, Artificial Sequence
  Artificial sequence related to HLA knockouts in cell therapy
gatagagcaggagggtccg

SEQ ID NO: 18333 - DNA, 19 bp, Artificial Sequence
  Artificial sequence related to HLA knockouts in cell therapy
atagagcaggagggtccgg

SEQ ID NO: 18334 - DNA, 19 bp, Artificial Sequence
  Artificial sequence related to HLA knockouts in cell therapy
tagagcaggagggtccgga

SEQ ID NO: 18335 - DNA, 19 bp, Artificial Sequence
  Artificial sequence related to HLA knockouts in cell therapy
agagcaggagggtccggag

SEQ ID NO: 18336 - DNA, 19 bp, Artificial Sequence
  Artificial sequence related to HLA knockouts in cell therapy
gagcaggagggtccggagt

SEQ ID NO: 18337 - DNA, 19 bp, Artificial Sequence
  Artificial sequence related to HLA knockouts in cell therapy
agcaggagggtccggagta

SEQ ID NO: 18338 - DNA, 19 bp, Artificial Sequence
  Artificial sequence related to HLA knockouts in cell therapy
gcaggagggtccggagtat

SEQ ID NO: 18339 - DNA, 19 bp, Artificial Sequence
  Artificial sequence related to HLA knockouts in cell therapy
ggagggtccggagtattgg

SEQ ID NO: 18340 - DNA, 19 bp, Artificial Sequence
  Artificial sequence related to HLA knockouts in cell therapy
gagggtccggagtattggg

SEQ ID NO: 18341 - DNA, 19 bp, Artificial Sequence
  Artificial sequence related to HLA knockouts in cell therapy
gggtccggagtattgggac

SEQ ID NO: 18342 - DNA, 19 bp, Artificial Sequence
  Artificial sequence related to HLA knockouts in cell therapy
ggtccggagtattgggacg

SEQ ID NO: 18343 - DNA, 19 bp, Artificial Sequence
  Artificial sequence related to HLA knockouts in cell therapy
gtccggagtattgggacgg

SEQ ID NO: 18344 - DNA, 19 bp, Artificial Sequence
  Artificial sequence related to HLA knockouts in cell therapy
tccggagtattgggacggg

SEQ ID NO: 18345 - DNA, 19 bp, Artificial Sequence
  Artificial sequence related to HLA knockouts in cell therapy
ccggagtattgggacgggg

SEQ ID NO: 18346 - DNA, 19 bp, Artificial Sequence
  Artificial sequence related to HLA knockouts in cell therapy
cggagtattgggacgggga

SEQ ID NO: 18347 - DNA, 19 bp, Artificial Sequence
  Artificial sequence related to HLA knockouts in cell therapy
ggagtattgggacggggag

SEQ ID NO: 18348 - DNA, 19 bp, Artificial Sequence
  Artificial sequence related to HLA knockouts in cell therapy
attgggacggggagacacg

SEQ ID NO: 18349 - DNA, 19 bp, Artificial Sequence
  Artificial sequence related to HLA knockouts in cell therapy
ttgggacggggagacacgg

SEQ ID NO: 18350 - DNA, 19 bp, Artificial Sequence
  Artificial sequence related to HLA knockouts in cell therapy
tgggacggggagacacgga

SEQ ID NO: 18351 - DNA, 19 bp, Artificial Sequence
  Artificial sequence related to HLA knockouts in cell therapy
gggacggggagacacggaa

SEQ ID NO: 18352 - DNA, 19 bp, Artificial Sequence
  Artificial sequence related to HLA knockouts in cell therapy
ggacggggagacacggaaa

SEQ ID NO: 18353 - DNA, 19 bp, Artificial Sequence
  Artificial sequence related to HLA knockouts in cell therapy
gacggggagacacggaaag

SEQ ID NO: 18354 - DNA, 19 bp, Artificial Sequence
  Artificial sequence related to HLA knockouts in cell therapy
cggggagacacggaaagtg

SEQ ID NO: 18355 - DNA, 19 bp, Artificial Sequence
  Artificial sequence related to HLA knockouts in cell therapy
ggcccactcacagactcac

SEQ ID NO: 18356 - DNA, 19 bp, Artificial Sequence
  Artificial sequence related to HLA knockouts in cell therapy
gcccactcacagactcacc

SEQ ID NO: 18357 - DNA, 19 bp, Artificial Sequence
  Artificial sequence related to HLA knockouts in cell therapy
cccactcacagactcaccg

SEQ ID NO: 18358 - DNA, 19 bp, Artificial Sequence
  Artificial sequence related to HLA knockouts in cell therapy
cagactcaccgagtggacc

SEQ ID NO: 18359 - DNA, 19 bp, Artificial Sequence
  Artificial sequence related to HLA knockouts in cell therapy
gactcaccgagtggacctg

SEQ ID NO: 18360 - DNA, 19 bp, Artificial Sequence
  Artificial sequence related to HLA knockouts in cell therapy
actcaccgagtggacctgg

SEQ ID NO: 18361 - DNA, 19 bp, Artificial Sequence
  Artificial sequence related to HLA knockouts in cell therapy
ctcaccgagtggacctggg

SEQ ID NO: 18362 - DNA, 19 bp, Artificial Sequence
  Artificial sequence related to HLA knockouts in cell therapy
tcaccgagtggacctgggg

SEQ ID NO: 18363 - DNA, 19 bp, Artificial Sequence
  Artificial sequence related to HLA knockouts in cell therapy
caccgagtggacctgggga

SEQ ID NO: 18364 - DNA, 19 bp, Artificial Sequence
  Artificial sequence related to HLA knockouts in cell therapy
accgagtggacctggggac

SEQ ID NO: 18365 - DNA, 19 bp, Artificial Sequence
  Artificial sequence related to HLA knockouts in cell therapy
ccgagtggacctggggacc

SEQ ID NO: 18366 - DNA, 19 bp, Artificial Sequence
  Artificial sequence related to HLA knockouts in cell therapy
cgagtggacctggggaccc

SEQ ID NO: 18367 - DNA, 19 bp, Artificial Sequence
  Artificial sequence related to HLA knockouts in cell therapy
gagtggacctggggaccct

SEQ ID NO: 18368 - DNA, 19 bp, Artificial Sequence
  Artificial sequence related to HLA knockouts in cell therapy
agtggacctggggaccctg

SEQ ID NO: 18369 - DNA, 19 bp, Artificial Sequence
  Artificial sequence related to HLA knockouts in cell therapy
gtggacctggggaccctgc

SEQ ID NO: 18370 - DNA, 19 bp, Artificial Sequence
  Artificial sequence related to HLA knockouts in cell therapy
tggacctggggaccctgcg

SEQ ID NO: 18371 - DNA, 19 bp, Artificial Sequence
  Artificial sequence related to HLA knockouts in cell therapy
ggacctggggaccctgcgc

SEQ ID NO: 18372 - DNA, 19 bp, Artificial Sequence
  Artificial sequence related to HLA knockouts in cell therapy
gacctggggaccctgcgcg

SEQ ID NO: 18373 - DNA, 19 bp, Artificial Sequence
  Artificial sequence related to HLA knockouts in cell therapy
acctggggaccctgcgcgg

SEQ ID NO: 18374 - DNA, 19 bp, Artificial Sequence
  Artificial sequence related to HLA knockouts in cell therapy
cctggggaccctgcgcggc

SEQ ID NO: 18375 - DNA, 19 bp, Artificial Sequence
  Artificial sequence related to HLA knockouts in cell therapy
ctggggaccctgcgcggct

SEQ ID NO: 18376 - DNA, 19 bp, Artificial Sequence
  Artificial sequence related to HLA knockouts in cell therapy
tggggaccctgcgcggcta

SEQ ID NO: 18377 - DNA, 19 bp, Artificial Sequence
  Artificial sequence related to HLA knockouts in cell therapy
ggggaccctgcgcggctac

SEQ ID NO: 18378 - DNA, 19 bp, Artificial Sequence
  Artificial sequence related to HLA knockouts in cell therapy
gggaccctgcgcggctact

SEQ ID NO: 18379 - DNA, 19 bp, Artificial Sequence
  Artificial sequence related to HLA knockouts in cell therapy
ggaccctgcgcggctacta

SEQ ID NO: 18380 - DNA, 19 bp, Artificial Sequence
  Artificial sequence related to HLA knockouts in cell therapy
gaccctgcgcggctactac

SEQ ID NO: 18381 - DNA, 19 bp, Artificial Sequence
  Artificial sequence related to HLA knockouts in cell therapy
accctgcgcggctactaca

SEQ ID NO: 18382 - DNA, 19 bp, Artificial Sequence
  Artificial sequence related to HLA knockouts in cell therapy
ccctgcgcggctactacaa

SEQ ID NO: 18383 - DNA, 19 bp, Artificial Sequence
  Artificial sequence related to HLA knockouts in cell therapy
cctgcgcggctactacaac

SEQ ID NO: 18384 - DNA, 19 bp, Artificial Sequence
  Artificial sequence related to HLA knockouts in cell therapy
ctgcgcggctactacaacc

SEQ ID NO: 18385 - DNA, 19 bp, Artificial Sequence
  Artificial sequence related to HLA knockouts in cell therapy
gcgcggctactacaaccag

SEQ ID NO: 18386 - DNA, 19 bp, Artificial Sequence
  Artificial sequence related to HLA knockouts in cell therapy
ctacaaccagagcgaggcc

SEQ ID NO: 18387 - DNA, 19 bp, Artificial Sequence
  Artificial sequence related to HLA knockouts in cell therapy
tacaaccagagcgaggccg

SEQ ID NO: 18388 - DNA, 19 bp, Artificial Sequence
  Artificial sequence related to HLA knockouts in cell therapy
acaaccagagcgaggccgg

SEQ ID NO: 18389 - DNA, 19 bp, Artificial Sequence
  Artificial sequence related to HLA knockouts in cell therapy
caaccagagcgaggccggt

SEQ ID NO: 18390 - DNA, 19 bp, Artificial Sequence
  Artificial sequence related to HLA knockouts in cell therapy
aaccagagcgaggccggtt

SEQ ID NO: 18391 - DNA, 19 bp, Artificial Sequence
  Artificial sequence related to HLA knockouts in cell therapy
accagagcgaggccggttc

SEQ ID NO: 18392 - DNA, 19 bp, Artificial Sequence
  Artificial sequence related to HLA knockouts in cell therapy
ccagagcgaggccggttct

SEQ ID NO: 18393 - DNA, 19 bp, Artificial Sequence
  Artificial sequence related to HLA knockouts in cell therapy
cagagcgaggccggttctc

SEQ ID NO: 18394 - DNA, 19 bp, Artificial Sequence
  Artificial sequence related to HLA knockouts in cell therapy
agagcgaggccggttctca

SEQ ID NO: 18395 - DNA, 19 bp, Artificial Sequence
  Artificial sequence related to HLA knockouts in cell therapy
gagcgaggccggttctcac

SEQ ID NO: 18396 - DNA, 19 bp, Artificial Sequence
  Artificial sequence related to HLA knockouts in cell therapy
agcgaggccggttctcaca

SEQ ID NO: 18397 - DNA, 19 bp, Artificial Sequence
  Artificial sequence related to HLA knockouts in cell therapy
gcgaggccggttctcacac

SEQ ID NO: 18398 - DNA, 19 bp, Artificial Sequence
  Artificial sequence related to HLA knockouts in cell therapy
cgaggccggttctcacacc

SEQ ID NO: 18399 - DNA, 19 bp, Artificial Sequence
  Artificial sequence related to HLA knockouts in cell therapy
gaggccggttctcacaccg

SEQ ID NO: 18400 - DNA, 19 bp, Artificial Sequence
  Artificial sequence related to HLA knockouts in cell therapy
aggccggttctcacaccgt

SEQ ID NO: 18401 - DNA, 19 bp, Artificial Sequence
  Artificial sequence related to HLA knockouts in cell therapy
ggccggttctcacaccgtc

SEQ ID NO: 18402 - DNA, 19 bp, Artificial Sequence
  Artificial sequence related to HLA knockouts in cell therapy
gccggttctcacaccgtcc

SEQ ID NO: 18403 - DNA, 19 bp, Artificial Sequence
  Artificial sequence related to HLA knockouts in cell therapy
ccggttctcacaccgtcca

SEQ ID NO: 18404 - DNA, 19 bp, Artificial Sequence
  Artificial sequence related to HLA knockouts in cell therapy
cggttctcacaccgtccag

SEQ ID NO: 18405 - DNA, 19 bp, Artificial Sequence
  Artificial sequence related to HLA knockouts in cell therapy
tgtatggctgcgacgtggg

SEQ ID NO: 18406 - DNA, 19 bp, Artificial Sequence
  Artificial sequence related to HLA knockouts in cell therapy
gtatggctgcgacgtgggg

SEQ ID NO: 18407 - DNA, 19 bp, Artificial Sequence
  Artificial sequence related to HLA knockouts in cell therapy
tatggctgcgacgtggggt

SEQ ID NO: 18408 - DNA, 19 bp, Artificial Sequence
  Artificial sequence related to HLA knockouts in cell therapy
atggctgcgacgtggggtc

SEQ ID NO: 18409 - DNA, 19 bp, Artificial Sequence
  Artificial sequence related to HLA knockouts in cell therapy
tggctgcgacgtggggtcg

SEQ ID NO: 18410 - DNA, 19 bp, Artificial Sequence
  Artificial sequence related to HLA knockouts in cell therapy
ggctgcgacgtggggtcgg

SEQ ID NO: 18411 - DNA, 19 bp, Artificial Sequence
  Artificial sequence related to HLA knockouts in cell therapy
gctgcgacgtggggtcgga

SEQ ID NO: 18412 - DNA, 19 bp, Artificial Sequence
  Artificial sequence related to HLA knockouts in cell therapy
ctgcgacgtggggtcggac

SEQ ID NO: 18413 - DNA, 19 bp, Artificial Sequence
  Artificial sequence related to HLA knockouts in cell therapy
tgcgacgtggggtcggact

SEQ ID NO: 18414 - DNA, 19 bp, Artificial Sequence
  Artificial sequence related to HLA knockouts in cell therapy
gcgacgtggggtcggactg

SEQ ID NO: 18415 - DNA, 19 bp, Artificial Sequence
  Artificial sequence related to HLA knockouts in cell therapy
cgacgtggggtcggactgg

SEQ ID NO: 18416 - DNA, 19 bp, Artificial Sequence
  Artificial sequence related to HLA knockouts in cell therapy
gacgtggggtcggactggc

SEQ ID NO: 18417 - DNA, 19 bp, Artificial Sequence
  Artificial sequence related to HLA knockouts in cell therapy
acgtggggtcggactggcg

SEQ ID NO: 18418 - DNA, 19 bp, Artificial Sequence
  Artificial sequence related to HLA knockouts in cell therapy
cgtggggtcggactggcgc

SEQ ID NO: 18419 - DNA, 19 bp, Artificial Sequence
  Artificial sequence related to HLA knockouts in cell therapy
gtggggtcggactggcgct

SEQ ID NO: 18420 - DNA, 19 bp, Artificial Sequence
  Artificial sequence related to HLA knockouts in cell therapy
tggggtcggactggcgctt

SEQ ID NO: 18421 - DNA, 19 bp, Artificial Sequence
  Artificial sequence related to HLA knockouts in cell therapy
ggggtcggactggcgcttc

SEQ ID NO: 18422 - DNA, 19 bp, Artificial Sequence
  Artificial sequence related to HLA knockouts in cell therapy
gggtcggactggcgcttcc

SEQ ID NO: 18423 - DNA, 19 bp, Artificial Sequence
  Artificial sequence related to HLA knockouts in cell therapy
ggtcggactggcgcttcct

SEQ ID NO: 18424 - DNA, 19 bp, Artificial Sequence
  Artificial sequence related to HLA knockouts in cell therapy
gtcggactggcgcttcctc

SEQ ID NO: 18425 - DNA, 19 bp, Artificial Sequence
  Artificial sequence related to HLA knockouts in cell therapy
tcggactggcgcttcctcc

SEQ ID NO: 18426 - DNA, 19 bp, Artificial Sequence
  Artificial sequence related to HLA knockouts in cell therapy
cggactggcgcttcctccg

SEQ ID NO: 18427 - DNA, 19 bp, Artificial Sequence
  Artificial sequence related to HLA knockouts in cell therapy
ggactggcgcttcctccgc

SEQ ID NO: 18428 - DNA, 19 bp, Artificial Sequence
  Artificial sequence related to HLA knockouts in cell therapy
gactggcgcttcctccgcg

SEQ ID NO: 18429 - DNA, 19 bp, Artificial Sequence
  Artificial sequence related to HLA knockouts in cell therapy
actggcgcttcctccgcgg

SEQ ID NO: 18430 - DNA, 19 bp, Artificial Sequence
  Artificial sequence related to HLA knockouts in cell therapy
ctggcgcttcctccgcggg

SEQ ID NO: 18431 - DNA, 19 bp, Artificial Sequence
  Artificial sequence related to HLA knockouts in cell therapy
tggcgcttcctccgcgggt

SEQ ID NO: 18432 - DNA, 19 bp, Artificial Sequence
  Artificial sequence related to HLA knockouts in cell therapy
ggcgcttcctccgcgggta

SEQ ID NO: 18433 - DNA, 19 bp, Artificial Sequence
  Artificial sequence related to HLA knockouts in cell therapy
gcgcttcctccgcgggtac

SEQ ID NO: 18434 - DNA, 19 bp, Artificial Sequence
  Artificial sequence related to HLA knockouts in cell therapy
cgcttcctccgcgggtacc

SEQ ID NO: 18435 - DNA, 19 bp, Artificial Sequence
  Artificial sequence related to HLA knockouts in cell therapy
gcttcctccgcgggtacca

SEQ ID NO: 18436 - DNA, 19 bp, Artificial Sequence
  Artificial sequence related to HLA knockouts in cell therapy
cttcctccgcgggtaccac

SEQ ID NO: 18437 - DNA, 19 bp, Artificial Sequence
  Artificial sequence related to HLA knockouts in cell therapy
ttcctccgcgggtaccacc

SEQ ID NO: 18438 - DNA, 19 bp, Artificial Sequence
  Artificial sequence related to HLA knockouts in cell therapy
tcctccgcgggtaccacca

SEQ ID NO: 18439 - DNA, 19 bp, Artificial Sequence
  Artificial sequence related to HLA knockouts in cell therapy
cctccgcgggtaccaccag

SEQ ID NO: 18440 - DNA, 19 bp, Artificial Sequence
  Artificial sequence related to HLA knockouts in cell therapy
ctccgcgggtaccaccagt

SEQ ID NO: 18441 - DNA, 19 bp, Artificial Sequence
  Artificial sequence related to HLA knockouts in cell therapy
tccgcgggtaccaccagta

SEQ ID NO: 18442 - DNA, 19 bp, Artificial Sequence
  Artificial sequence related to HLA knockouts in cell therapy
ccgcgggtaccaccagtac

SEQ ID NO: 18443 - DNA, 19 bp, Artificial Sequence
  Artificial sequence related to HLA knockouts in cell therapy
cgcgggtaccaccagtacg

SEQ ID NO: 18444 - DNA, 19 bp, Artificial Sequence
  Artificial sequence related to HLA knockouts in cell therapy
gcgggtaccaccagtacgc

SEQ ID NO: 18445 - DNA, 19 bp, Artificial Sequence
  Artificial sequence related to HLA knockouts in cell therapy
cgggtaccaccagtacgcc

SEQ ID NO: 18446 - DNA, 19 bp, Artificial Sequence
  Artificial sequence related to HLA knockouts in cell therapy
gggtaccaccagtacgcct

SEQ ID NO: 18447 - DNA, 19 bp, Artificial Sequence
  Artificial sequence related to HLA knockouts in cell therapy
ccaccagtacgcctacgac

SEQ ID NO: 18448 - DNA, 19 bp, Artificial Sequence
  Artificial sequence related to HLA knockouts in cell therapy
caccagtacgcctacgacg

SEQ ID NO: 18449 - DNA, 19 bp, Artificial Sequence
  Artificial sequence related to HLA knockouts in cell therapy
accagtacgcctacgacgg

SEQ ID NO: 18450 - DNA, 19 bp, Artificial Sequence
  Artificial sequence related to HLA knockouts in cell therapy
ccagtacgcctacgacggc

SEQ ID NO: 18451 - DNA, 19 bp, Artificial Sequence
  Artificial sequence related to HLA knockouts in cell therapy
cagtacgcctacgacggca

SEQ ID NO: 18452 - DNA, 19 bp, Artificial Sequence
  Artificial sequence related to HLA knockouts in cell therapy
gtacgcctacgacggcaag

SEQ ID NO: 18453 - DNA, 19 bp, Artificial Sequence
  Artificial sequence related to HLA knockouts in cell therapy
tacgcctacgacggcaagg

SEQ ID NO: 18454 - DNA, 19 bp, Artificial Sequence
  Artificial sequence related to HLA knockouts in cell therapy
acgcctacgacggcaagga

SEQ ID NO: 18455 - DNA, 19 bp, Artificial Sequence
  Artificial sequence related to HLA knockouts in cell therapy
cgcctacgacggcaaggat

SEQ ID NO: 18456 - DNA, 19 bp, Artificial Sequence
  Artificial sequence related to HLA knockouts in cell therapy
cgccctgaaagaggacctg

SEQ ID NO: 18457 - DNA, 19 bp, Artificial Sequence
  Artificial sequence related to HLA knockouts in cell therapy
gccctgaaagaggacctgc

SEQ ID NO: 18458 - DNA, 19 bp, Artificial Sequence
  Artificial sequence related to HLA knockouts in cell therapy
ccctgaaagaggacctgcg

SEQ ID NO: 18459 - DNA, 19 bp, Artificial Sequence
  Artificial sequence related to HLA knockouts in cell therapy
cctgaaagaggacctgcgc

SEQ ID NO: 18460 - DNA, 19 bp, Artificial Sequence
  Artificial sequence related to HLA knockouts in cell therapy
aggacctgcgctcttggac

SEQ ID NO: 18461 - DNA, 19 bp, Artificial Sequence
  Artificial sequence related to HLA knockouts in cell therapy
ggacctgcgctcttggacc

SEQ ID NO: 18462 - DNA, 19 bp, Artificial Sequence
  Artificial sequence related to HLA knockouts in cell therapy
gacctgcgctcttggaccg

SEQ ID NO: 18463 - DNA, 19 bp, Artificial Sequence
  Artificial sequence related to HLA knockouts in cell therapy
acctgcgctcttggaccgc

SEQ ID NO: 18464 - DNA, 19 bp, Artificial Sequence
  Artificial sequence related to HLA knockouts in cell therapy
cctgcgctcttggaccgcg

SEQ ID NO: 18465 - DNA, 19 bp, Artificial Sequence
  Artificial sequence related to HLA knockouts in cell therapy
ctgcgctcttggaccgcgg

SEQ ID NO: 18466 - DNA, 19 bp, Artificial Sequence
  Artificial sequence related to HLA knockouts in cell therapy
tgcgctcttggaccgcggc

SEQ ID NO: 18467 - DNA, 19 bp, Artificial Sequence
  Artificial sequence related to HLA knockouts in cell therapy
gcgctcttggaccgcggcg

SEQ ID NO: 18468 - DNA, 19 bp, Artificial Sequence
  Artificial sequence related to HLA knockouts in cell therapy
cgctcttggaccgcggcgg

SEQ ID NO: 18469 - DNA, 19 bp, Artificial Sequence
  Artificial sequence related to HLA knockouts in cell therapy
gctcttggaccgcggcgga

SEQ ID NO: 18470 - DNA, 19 bp, Artificial Sequence
  Artificial sequence related to HLA knockouts in cell therapy
ctcttggaccgcggcggac

SEQ ID NO: 18471 - DNA, 19 bp, Artificial Sequence
  Artificial sequence related to HLA knockouts in cell therapy
tcttggaccgcggcggaca

SEQ ID NO: 18472 - DNA, 19 bp, Artificial Sequence
  Artificial sequence related to HLA knockouts in cell therapy
cttggaccgcggcggacat

SEQ ID NO: 18473 - DNA, 19 bp, Artificial Sequence
  Artificial sequence related to HLA knockouts in cell therapy
ttggaccgcggcggacatg

SEQ ID NO: 18474 - DNA, 19 bp, Artificial Sequence
  Artificial sequence related to HLA knockouts in cell therapy
tggaccgcggcggacatgg

SEQ ID NO: 18475 - DNA, 19 bp, Artificial Sequence
  Artificial sequence related to HLA knockouts in cell therapy
ggaccgcggcggacatggc

SEQ ID NO: 18476 - DNA, 19 bp, Artificial Sequence
  Artificial sequence related to HLA knockouts in cell therapy
gaccgcggcggacatggca

SEQ ID NO: 18477 - DNA, 19 bp, Artificial Sequence
  Artificial sequence related to HLA knockouts in cell therapy
accgcggcggacatggcag

SEQ ID NO: 18478 - DNA, 19 bp, Artificial Sequence
  Artificial sequence related to HLA knockouts in cell therapy
ccgcggcggacatggcagc

SEQ ID NO: 18479 - DNA, 19 bp, Artificial Sequence
  Artificial sequence related to HLA knockouts in cell therapy
cgcggcggacatggcagct

SEQ ID NO: 18480 - DNA, 19 bp, Artificial Sequence
  Artificial sequence related to HLA knockouts in cell therapy
gcggcggacatggcagctc

SEQ ID NO: 18481 - DNA, 19 bp, Artificial Sequence
  Artificial sequence related to HLA knockouts in cell therapy
cggcggacatggcagctca

SEQ ID NO: 18482 - DNA, 19 bp, Artificial Sequence
  Artificial sequence related to HLA knockouts in cell therapy
ggcggacatggcagctcag

SEQ ID NO: 18483 - DNA, 19 bp, Artificial Sequence
  Artificial sequence related to HLA knockouts in cell therapy
gcggacatggcagctcaga

SEQ ID NO: 18484 - DNA, 19 bp, Artificial Sequence
  Artificial sequence related to HLA knockouts in cell therapy
cggacatggcagctcagac

SEQ ID NO: 18485 - DNA, 19 bp, Artificial Sequence
  Artificial sequence related to HLA knockouts in cell therapy
ggacatggcagctcagacc

SEQ ID NO: 18486 - DNA, 19 bp, Artificial Sequence
  Artificial sequence related to HLA knockouts in cell therapy
catggcagctcagaccacc

SEQ ID NO: 18487 - DNA, 19 bp, Artificial Sequence
  Artificial sequence related to HLA knockouts in cell therapy
ggcagctcagaccaccaag

SEQ ID NO: 18488 - DNA, 19 bp, Artificial Sequence
  Artificial sequence related to HLA knockouts in cell therapy
gcagctcagaccaccaagc

SEQ ID NO: 18489 - DNA, 19 bp, Artificial Sequence
  Artificial sequence related to HLA knockouts in cell therapy
ccaagcacaagtgggaggc

SEQ ID NO: 18490 - DNA, 19 bp, Artificial Sequence
  Artificial sequence related to HLA knockouts in cell therapy
caagcacaagtgggaggcg

SEQ ID NO: 18491 - DNA, 19 bp, Artificial Sequence
  Artificial sequence related to HLA knockouts in cell therapy
aagcacaagtgggaggcgg

SEQ ID NO: 18492 - DNA, 19 bp, Artificial Sequence
  Artificial sequence related to HLA knockouts in cell therapy
agcacaagtgggaggcggc

SEQ ID NO: 18493 - DNA, 19 bp, Artificial Sequence
  Artificial sequence related to HLA knockouts in cell therapy
gcacaagtgggaggcggcc

SEQ ID NO: 18494 - DNA, 19 bp, Artificial Sequence
  Artificial sequence related to HLA knockouts in cell therapy
cacaagtgggaggcggccc

SEQ ID NO: 18495 - DNA, 19 bp, Artificial Sequence
  Artificial sequence related to HLA knockouts in cell therapy
acaagtgggaggcggccca

SEQ ID NO: 18496 - DNA, 19 bp, Artificial Sequence
  Artificial sequence related to HLA knockouts in cell therapy
caagtgggaggcggcccat

SEQ ID NO: 18497 - DNA, 19 bp, Artificial Sequence
  Artificial sequence related to HLA knockouts in cell therapy
aagtgggaggcggcccatg

SEQ ID NO: 18498 - DNA, 19 bp, Artificial Sequence
  Artificial sequence related to HLA knockouts in cell therapy
agtgggaggcggcccatgt

SEQ ID NO: 18499 - DNA, 19 bp, Artificial Sequence
  Artificial sequence related to HLA knockouts in cell therapy
gtgggaggcggcccatgtg

SEQ ID NO: 18500 - DNA, 19 bp, Artificial Sequence
  Artificial sequence related to HLA knockouts in cell therapy
tgggaggcggcccatgtgg

SEQ ID NO: 18501 - DNA, 19 bp, Artificial Sequence
  Artificial sequence related to HLA knockouts in cell therapy
gggaggcggcccatgtggc

SEQ ID NO: 18502 - DNA, 19 bp, Artificial Sequence
  Artificial sequence related to HLA knockouts in cell therapy
ggaggcggcccatgtggcg

SEQ ID NO: 18503 - DNA, 19 bp, Artificial Sequence
  Artificial sequence related to HLA knockouts in cell therapy
gaggcggcccatgtggcgg

SEQ ID NO: 18504 - DNA, 19 bp, Artificial Sequence
  Artificial sequence related to HLA knockouts in cell therapy
aggcggcccatgtggcgga

SEQ ID NO: 18505 - DNA, 19 bp, Artificial Sequence
  Artificial sequence related to HLA knockouts in cell therapy
ggcggcccatgtggcggag

SEQ ID NO: 18506 - DNA, 19 bp, Artificial Sequence
  Artificial sequence related to HLA knockouts in cell therapy
gcggcccatgtggcggagc

SEQ ID NO: 18507 - DNA, 19 bp, Artificial Sequence
  Artificial sequence related to HLA knockouts in cell therapy
cggcccatgtggcggagca

SEQ ID NO: 18508 - DNA, 19 bp, Artificial Sequence
  Artificial sequence related to HLA knockouts in cell therapy
ggcccatgtggcggagcag

SEQ ID NO: 18509 - DNA, 19 bp, Artificial Sequence
  Artificial sequence related to HLA knockouts in cell therapy
gcccatgtggcggagcagt

SEQ ID NO: 18510 - DNA, 19 bp, Artificial Sequence
  Artificial sequence related to HLA knockouts in cell therapy
cccatgtggcggagcagtt

SEQ ID NO: 18511 - DNA, 19 bp, Artificial Sequence
  Artificial sequence related to HLA knockouts in cell therapy
ccatgtggcggagcagttg

SEQ ID NO: 18512 - DNA, 19 bp, Artificial Sequence
  Artificial sequence related to HLA knockouts in cell therapy
gtggcggagcagttgagag

SEQ ID NO: 18513 - DNA, 19 bp, Artificial Sequence
  Artificial sequence related to HLA knockouts in cell therapy
tggcggagcagttgagagc

SEQ ID NO: 18514 - DNA, 19 bp, Artificial Sequence
  Artificial sequence related to HLA knockouts in cell therapy
ggcggagcagttgagagcc

SEQ ID NO: 18515 - DNA, 19 bp, Artificial Sequence
  Artificial sequence related to HLA knockouts in cell therapy
gcggagcagttgagagcct

SEQ ID NO: 18516 - DNA, 19 bp, Artificial Sequence
  Artificial sequence related to HLA knockouts in cell therapy
tgagagcctacctggaggg

SEQ ID NO: 18517 - DNA, 19 bp, Artificial Sequence
  Artificial sequence related to HLA knockouts in cell therapy
gagagcctacctggagggc

SEQ ID NO: 18518 - DNA, 19 bp, Artificial Sequence
  Artificial sequence related to HLA knockouts in cell therapy
agagcctacctggagggca

SEQ ID NO: 18519 - DNA, 19 bp, Artificial Sequence
  Artificial sequence related to HLA knockouts in cell therapy
gagcctacctggagggcac

SEQ ID NO: 18520 - DNA, 19 bp, Artificial Sequence
  Artificial sequence related to HLA knockouts in cell therapy
agcctacctggagggcacg

SEQ ID NO: 18521 - DNA, 19 bp, Artificial Sequence
  Artificial sequence related to HLA knockouts in cell therapy
gcctacctggagggcacgt

SEQ ID NO: 18522 - DNA, 19 bp, Artificial Sequence
  Artificial sequence related to HLA knockouts in cell therapy
cctacctggagggcacgtg

SEQ ID NO: 18523 - DNA, 19 bp, Artificial Sequence
  Artificial sequence related to HLA knockouts in cell therapy
ctacctggagggcacgtgc

SEQ ID NO: 18524 - DNA, 19 bp, Artificial Sequence
  Artificial sequence related to HLA knockouts in cell therapy
tacctggagggcacgtgcg

SEQ ID NO: 18525 - DNA, 19 bp, Artificial Sequence
  Artificial sequence related to HLA knockouts in cell therapy
acctggagggcacgtgcgt

SEQ ID NO: 18526 - DNA, 19 bp, Artificial Sequence
  Artificial sequence related to HLA knockouts in cell therapy
cctggagggcacgtgcgtg

SEQ ID NO: 18527 - DNA, 19 bp, Artificial Sequence
  Artificial sequence related to HLA knockouts in cell therapy
ctggagggcacgtgcgtgg

SEQ ID NO: 18528 - DNA, 19 bp, Artificial Sequence
  Artificial sequence related to HLA knockouts in cell therapy
tggagggcacgtgcgtgga

SEQ ID NO: 18529 - DNA, 19 bp, Artificial Sequence
  Artificial sequence related to HLA knockouts in cell therapy
ggagggcacgtgcgtggag

SEQ ID NO: 18530 - DNA, 19 bp, Artificial Sequence
  Artificial sequence related to HLA knockouts in cell therapy
gagggcacgtgcgtggagt

SEQ ID NO: 18531 - DNA, 19 bp, Artificial Sequence
  Artificial sequence related to HLA knockouts in cell therapy
agggcacgtgcgtggagtg

SEQ ID NO: 18532 - DNA, 19 bp, Artificial Sequence
  Artificial sequence related to HLA knockouts in cell therapy
gggcacgtgcgtggagtgg

SEQ ID NO: 18533 - DNA, 19 bp, Artificial Sequence
  Artificial sequence related to HLA knockouts in cell therapy
ggcacgtgcgtggagtggc

SEQ ID NO: 18534 - DNA, 19 bp, Artificial Sequence
  Artificial sequence related to HLA knockouts in cell therapy
gcacgtgcgtggagtggct

SEQ ID NO: 18535 - DNA, 19 bp, Artificial Sequence
  Artificial sequence related to HLA knockouts in cell therapy
cacgtgcgtggagtggctc

SEQ ID NO: 18536 - DNA, 19 bp, Artificial Sequence
  Artificial sequence related to HLA knockouts in cell therapy
acgtgcgtggagtggctcc

SEQ ID NO: 18537 - DNA, 19 bp, Artificial Sequence
  Artificial sequence related to HLA knockouts in cell therapy
cgtgcgtggagtggctccg

SEQ ID NO: 18538 - DNA, 19 bp, Artificial Sequence
  Artificial sequence related to HLA knockouts in cell therapy
gtgcgtggagtggctccgc

SEQ ID NO: 18539 - DNA, 19 bp, Artificial Sequence
  Artificial sequence related to HLA knockouts in cell therapy
tgcgtggagtggctccgca

SEQ ID NO: 18540 - DNA, 19 bp, Artificial Sequence
  Artificial sequence related to HLA knockouts in cell therapy
gcgtggagtggctccgcag

SEQ ID NO: 18541 - DNA, 19 bp, Artificial Sequence
  Artificial sequence related to HLA knockouts in cell therapy
cgtggagtggctccgcaga

SEQ ID NO: 18542 - DNA, 19 bp, Artificial Sequence
  Artificial sequence related to HLA knockouts in cell therapy
gtggagtggctccgcagat

SEQ ID NO: 18543 - DNA, 19 bp, Artificial Sequence
  Artificial sequence related to HLA knockouts in cell therapy
ggagtggctccgcagatac

SEQ ID NO: 18544 - DNA, 19 bp, Artificial Sequence
  Artificial sequence related to HLA knockouts in cell therapy
gagtggctccgcagatacc

SEQ ID NO: 18545 - DNA, 19 bp, Artificial Sequence
  Artificial sequence related to HLA knockouts in cell therapy
tggctccgcagatacctgg

SEQ ID NO: 18546 - DNA, 19 bp, Artificial Sequence
  Artificial sequence related to HLA knockouts in cell therapy
ggctccgcagatacctgga

SEQ ID NO: 18547 - DNA, 19 bp, Artificial Sequence
  Artificial sequence related to HLA knockouts in cell therapy
gctccgcagatacctggag

SEQ ID NO: 18548 - DNA, 19 bp, Artificial Sequence
  Artificial sequence related to HLA knockouts in cell therapy
cctggagaacgggaaggag

SEQ ID NO: 18549 - DNA, 19 bp, Artificial Sequence
  Artificial sequence related to HLA knockouts in cell therapy
ggagaacgggaaggagacg

SEQ ID NO: 18550 - DNA, 19 bp, Artificial Sequence
  Artificial sequence related to HLA knockouts in cell therapy
gagaacgggaaggagacgc

SEQ ID NO: 18551 - DNA, 19 bp, Artificial Sequence
  Artificial sequence related to HLA knockouts in cell therapy
gaacgggaaggagacgctg

SEQ ID NO: 18552 - DNA, 19 bp, Artificial Sequence
  Artificial sequence related to HLA knockouts in cell therapy
aacgggaaggagacgctgc

SEQ ID NO: 18553 - DNA, 19 bp, Artificial Sequence
  Artificial sequence related to HLA knockouts in cell therapy
acgggaaggagacgctgca

SEQ ID NO: 18554 - DNA, 19 bp, Artificial Sequence
  Artificial sequence related to HLA knockouts in cell therapy
cgggaaggagacgctgcag

SEQ ID NO: 18555 - DNA, 19 bp, Artificial Sequence
  Artificial sequence related to HLA knockouts in cell therapy
gggaaggagacgctgcagc

SEQ ID NO: 18556 - DNA, 19 bp, Artificial Sequence
  Artificial sequence related to HLA knockouts in cell therapy
ggaaggagacgctgcagcg

SEQ ID NO: 18557 - DNA, 19 bp, Artificial Sequence
  Artificial sequence related to HLA knockouts in cell therapy
gaaggagacgctgcagcgc

SEQ ID NO: 18558 - DNA, 19 bp, Artificial Sequence
  Artificial sequence related to HLA knockouts in cell therapy
aaggagacgctgcagcgca

SEQ ID NO: 18559 - DNA, 19 bp, Artificial Sequence
  Artificial sequence related to HLA knockouts in cell therapy
aggagacgctgcagcgcac

SEQ ID NO: 18560 - DNA, 19 bp, Artificial Sequence
  Artificial sequence related to HLA knockouts in cell therapy
ggagacgctgcagcgcacg

SEQ ID NO: 18561 - DNA, 19 bp, Artificial Sequence
  Artificial sequence related to HLA knockouts in cell therapy
gagacgctgcagcgcacgg

SEQ ID NO: 18562 - DNA, 19 bp, Artificial Sequence
  Artificial sequence related to HLA knockouts in cell therapy
agacgctgcagcgcacgga

SEQ ID NO: 18563 - DNA, 19 bp, Artificial Sequence
  Artificial sequence related to HLA knockouts in cell therapy
gacgctgcagcgcacggac

SEQ ID NO: 18564 - DNA, 19 bp, Artificial Sequence
  Artificial sequence related to HLA knockouts in cell therapy
acgctgcagcgcacggacg

SEQ ID NO: 18565 - DNA, 19 bp, Artificial Sequence
  Artificial sequence related to HLA knockouts in cell therapy
cgctgcagcgcacggacgc

SEQ ID NO: 18566 - DNA, 19 bp, Artificial Sequence
  Artificial sequence related to HLA knockouts in cell therapy
gctgcagcgcacggacgcc

SEQ ID NO: 18567 - DNA, 19 bp, Artificial Sequence
  Artificial sequence related to HLA knockouts in cell therapy
ctgcagcgcacggacgccc

SEQ ID NO: 18568 - DNA, 19 bp, Artificial Sequence
  Artificial sequence related to HLA knockouts in cell therapy
tgcagcgcacggacgcccc

SEQ ID NO: 18569 - DNA, 19 bp, Artificial Sequence
  Artificial sequence related to HLA knockouts in cell therapy
gcagcgcacggacgccccc

SEQ ID NO: 18570 - DNA, 19 bp, Artificial Sequence
  Artificial sequence related to HLA knockouts in cell therapy
cagcgcacggacgccccca

SEQ ID NO: 18571 - DNA, 19 bp, Artificial Sequence
  Artificial sequence related to HLA knockouts in cell therapy
agcgcacggacgcccccaa

SEQ ID NO: 18572 - DNA, 19 bp, Artificial Sequence
  Artificial sequence related to HLA knockouts in cell therapy
gcgcacggacgcccccaaa

SEQ ID NO: 18573 - DNA, 19 bp, Artificial Sequence
  Artificial sequence related to HLA knockouts in cell therapy
cgcacggacgcccccaaaa

SEQ ID NO: 18574 - DNA, 19 bp, Artificial Sequence
  Artificial sequence related to HLA knockouts in cell therapy
gcacggacgcccccaaaac

SEQ ID NO: 18575 - DNA, 19 bp, Artificial Sequence
  Artificial sequence related to HLA knockouts in cell therapy
cacggacgcccccaaaacg

SEQ ID NO: 18576 - DNA, 19 bp, Artificial Sequence
  Artificial sequence related to HLA knockouts in cell therapy
acggacgcccccaaaacgc

SEQ ID NO: 18577 - DNA, 19 bp, Artificial Sequence
  Artificial sequence related to HLA knockouts in cell therapy
cggacgcccccaaaacgca

SEQ ID NO: 18578 - DNA, 19 bp, Artificial Sequence
  Artificial sequence related to HLA knockouts in cell therapy
ggacgcccccaaaacgcat

SEQ ID NO: 18579 - DNA, 19 bp, Artificial Sequence
  Artificial sequence related to HLA knockouts in cell therapy
caccacgctgtctctgacc

SEQ ID NO: 18580 - DNA, 19 bp, Artificial Sequence
  Artificial sequence related to HLA knockouts in cell therapy
ccatgaagccaccctgagg

SEQ ID NO: 18581 - DNA, 19 bp, Artificial Sequence
  Artificial sequence related to HLA knockouts in cell therapy
tgaagccaccctgaggtgc

SEQ ID NO: 18582 - DNA, 19 bp, Artificial Sequence
  Artificial sequence related to HLA knockouts in cell therapy
gaagccaccctgaggtgct

SEQ ID NO: 18583 - DNA, 19 bp, Artificial Sequence
  Artificial sequence related to HLA knockouts in cell therapy
aagccaccctgaggtgctg

SEQ ID NO: 18584 - DNA, 19 bp, Artificial Sequence
  Artificial sequence related to HLA knockouts in cell therapy
agccaccctgaggtgctgg

SEQ ID NO: 18585 - DNA, 19 bp, Artificial Sequence
  Artificial sequence related to HLA knockouts in cell therapy
gccaccctgaggtgctggg

SEQ ID NO: 18586 - DNA, 19 bp, Artificial Sequence
  Artificial sequence related to HLA knockouts in cell therapy
ccaccctgaggtgctgggc

SEQ ID NO: 18587 - DNA, 19 bp, Artificial Sequence
  Artificial sequence related to HLA knockouts in cell therapy
caccctgaggtgctgggcc

SEQ ID NO: 18588 - DNA, 19 bp, Artificial Sequence
  Artificial sequence related to HLA knockouts in cell therapy
accctgaggtgctgggccc

SEQ ID NO: 18589 - DNA, 19 bp, Artificial Sequence
  Artificial sequence related to HLA knockouts in cell therapy
ccctgaggtgctgggccct

SEQ ID NO: 18590 - DNA, 19 bp, Artificial Sequence
  Artificial sequence related to HLA knockouts in cell therapy
cctgaggtgctgggccctg

SEQ ID NO: 18591 - DNA, 19 bp, Artificial Sequence
  Artificial sequence related to HLA knockouts in cell therapy
ctgaggtgctgggccctga

SEQ ID NO: 18592 - DNA, 19 bp, Artificial Sequence
  Artificial sequence related to HLA knockouts in cell therapy
tgaggtgctgggccctgag

SEQ ID NO: 18593 - DNA, 19 bp, Artificial Sequence
  Artificial sequence related to HLA knockouts in cell therapy
gaggtgctgggccctgagc

SEQ ID NO: 18594 - DNA, 19 bp, Artificial Sequence
  Artificial sequence related to HLA knockouts in cell therapy
aggtgctgggccctgagct

SEQ ID NO: 18595 - DNA, 19 bp, Artificial Sequence
  Artificial sequence related to HLA knockouts in cell therapy
ggtgctgggccctgagctt

SEQ ID NO: 18596 - DNA, 19 bp, Artificial Sequence
  Artificial sequence related to HLA knockouts in cell therapy
gtgctgggccctgagcttc

SEQ ID NO: 18597 - DNA, 19 bp, Artificial Sequence
  Artificial sequence related to HLA knockouts in cell therapy
tgctgggccctgagcttct

SEQ ID NO: 18598 - DNA, 19 bp, Artificial Sequence
  Artificial sequence related to HLA knockouts in cell therapy
gctgggccctgagcttcta

SEQ ID NO: 18599 - DNA, 19 bp, Artificial Sequence
  Artificial sequence related to HLA knockouts in cell therapy
ctgggccctgagcttctac

SEQ ID NO: 18600 - DNA, 19 bp, Artificial Sequence
  Artificial sequence related to HLA knockouts in cell therapy
tgggccctgagcttctacc

SEQ ID NO: 18601 - DNA, 19 bp, Artificial Sequence
  Artificial sequence related to HLA knockouts in cell therapy
gggccctgagcttctaccc

SEQ ID NO: 18602 - DNA, 19 bp, Artificial Sequence
  Artificial sequence related to HLA knockouts in cell therapy
ggccctgagcttctaccct

SEQ ID NO: 18603 - DNA, 19 bp, Artificial Sequence
  Artificial sequence related to HLA knockouts in cell therapy
gccctgagcttctaccctg

SEQ ID NO: 18604 - DNA, 19 bp, Artificial Sequence
  Artificial sequence related to HLA knockouts in cell therapy
ccctgagcttctaccctgc

SEQ ID NO: 18605 - DNA, 19 bp, Artificial Sequence
  Artificial sequence related to HLA knockouts in cell therapy
cctgagcttctaccctgcg

SEQ ID NO: 18606 - DNA, 19 bp, Artificial Sequence
  Artificial sequence related to HLA knockouts in cell therapy
ctgagcttctaccctgcgg

SEQ ID NO: 18607 - DNA, 19 bp, Artificial Sequence
  Artificial sequence related to HLA knockouts in cell therapy
gagcttctaccctgcggag

SEQ ID NO: 18608 - DNA, 19 bp, Artificial Sequence
  Artificial sequence related to HLA knockouts in cell therapy
ccctgcggagatcacactg

SEQ ID NO: 18609 - DNA, 19 bp, Artificial Sequence
  Artificial sequence related to HLA knockouts in cell therapy
tcacactgacctggcagcg

SEQ ID NO: 18610 - DNA, 19 bp, Artificial Sequence
  Artificial sequence related to HLA knockouts in cell therapy
cacactgacctggcagcgg

SEQ ID NO: 18611 - DNA, 19 bp, Artificial Sequence
  Artificial sequence related to HLA knockouts in cell therapy
acactgacctggcagcggg

SEQ ID NO: 18612 - DNA, 19 bp, Artificial Sequence
  Artificial sequence related to HLA knockouts in cell therapy
cactgacctggcagcggga

SEQ ID NO: 18613 - DNA, 19 bp, Artificial Sequence
  Artificial sequence related to HLA knockouts in cell therapy
actgacctggcagcgggat

SEQ ID NO: 18614 - DNA, 19 bp, Artificial Sequence
  Artificial sequence related to HLA knockouts in cell therapy
ctgacctggcagcgggatg

SEQ ID NO: 18615 - DNA, 19 bp, Artificial Sequence
  Artificial sequence related to HLA knockouts in cell therapy
tgacctggcagcgggatgg

SEQ ID NO: 18616 - DNA, 19 bp, Artificial Sequence
  Artificial sequence related to HLA knockouts in cell therapy
gacctggcagcgggatggg

SEQ ID NO: 18617 - DNA, 19 bp, Artificial Sequence
  Artificial sequence related to HLA knockouts in cell therapy
acctggcagcgggatgggg

SEQ ID NO: 18618 - DNA, 19 bp, Artificial Sequence
  Artificial sequence related to HLA knockouts in cell therapy
cctggcagcgggatgggga

SEQ ID NO: 18619 - DNA, 19 bp, Artificial Sequence
  Artificial sequence related to HLA knockouts in cell therapy
ctggcagcgggatggggag

SEQ ID NO: 18620 - DNA, 19 bp, Artificial Sequence
  Artificial sequence related to HLA knockouts in cell therapy
tggcagcgggatggggagg

SEQ ID NO: 18621 - DNA, 19 bp, Artificial Sequence
  Artificial sequence related to HLA knockouts in cell therapy
ggcagcgggatggggagga

SEQ ID NO: 18622 - DNA, 19 bp, Artificial Sequence
  Artificial sequence related to HLA knockouts in cell therapy
gcagcgggatggggaggac

SEQ ID NO: 18623 - DNA, 19 bp, Artificial Sequence
  Artificial sequence related to HLA knockouts in cell therapy
cagcgggatggggaggacc

SEQ ID NO: 18624 - DNA, 19 bp, Artificial Sequence
  Artificial sequence related to HLA knockouts in cell therapy
agcgggatggggaggacca

SEQ ID NO: 18625 - DNA, 19 bp, Artificial Sequence
  Artificial sequence related to HLA knockouts in cell therapy
gcgggatggggaggaccag

SEQ ID NO: 18626 - DNA, 19 bp, Artificial Sequence
  Artificial sequence related to HLA knockouts in cell therapy
cgggatggggaggaccaga

SEQ ID NO: 18627 - DNA, 19 bp, Artificial Sequence
  Artificial sequence related to HLA knockouts in cell therapy
gggatggggaggaccagac

SEQ ID NO: 18628 - DNA, 19 bp, Artificial Sequence
  Artificial sequence related to HLA knockouts in cell therapy
ggatggggaggaccagacc

SEQ ID NO: 18629 - DNA, 19 bp, Artificial Sequence
  Artificial sequence related to HLA knockouts in cell therapy
gatggggaggaccagaccc

SEQ ID NO: 18630 - DNA, 19 bp, Artificial Sequence
  Artificial sequence related to HLA knockouts in cell therapy
atggggaggaccagaccca

SEQ ID NO: 18631 - DNA, 19 bp, Artificial Sequence
  Artificial sequence related to HLA knockouts in cell therapy
tggggaggaccagacccag

SEQ ID NO: 18632 - DNA, 19 bp, Artificial Sequence
  Artificial sequence related to HLA knockouts in cell therapy
ggggaggaccagacccagg

SEQ ID NO: 18633 - DNA, 19 bp, Artificial Sequence
  Artificial sequence related to HLA knockouts in cell therapy
gggaggaccagacccagga

SEQ ID NO: 18634 - DNA, 19 bp, Artificial Sequence
  Artificial sequence related to HLA knockouts in cell therapy
ggaggaccagacccaggac

SEQ ID NO: 18635 - DNA, 19 bp, Artificial Sequence
  Artificial sequence related to HLA knockouts in cell therapy
gaggaccagacccaggaca

SEQ ID NO: 18636 - DNA, 19 bp, Artificial Sequence
  Artificial sequence related to HLA knockouts in cell therapy
aggaccagacccaggacac

SEQ ID NO: 18637 - DNA, 19 bp, Artificial Sequence
  Artificial sequence related to HLA knockouts in cell therapy
ggaccagacccaggacacg

SEQ ID NO: 18638 - DNA, 19 bp, Artificial Sequence
  Artificial sequence related to HLA knockouts in cell therapy
gaccagacccaggacacgg

SEQ ID NO: 18639 - DNA, 19 bp, Artificial Sequence
  Artificial sequence related to HLA knockouts in cell therapy
accagacccaggacacgga

SEQ ID NO: 18640 - DNA, 19 bp, Artificial Sequence
  Artificial sequence related to HLA knockouts in cell therapy
ccagacccaggacacggag

SEQ ID NO: 18641 - DNA, 19 bp, Artificial Sequence
  Artificial sequence related to HLA knockouts in cell therapy
cagacccaggacacggagc

SEQ ID NO: 18642 - DNA, 19 bp, Artificial Sequence
  Artificial sequence related to HLA knockouts in cell therapy
agacccaggacacggagct

SEQ ID NO: 18643 - DNA, 19 bp, Artificial Sequence
  Artificial sequence related to HLA knockouts in cell therapy
gacccaggacacggagctc

SEQ ID NO: 18644 - DNA, 19 bp, Artificial Sequence
  Artificial sequence related to HLA knockouts in cell therapy
acccaggacacggagctcg

SEQ ID NO: 18645 - DNA, 19 bp, Artificial Sequence
  Artificial sequence related to HLA knockouts in cell therapy
cccaggacacggagctcgt

SEQ ID NO: 18646 - DNA, 19 bp, Artificial Sequence
  Artificial sequence related to HLA knockouts in cell therapy
ccaggacacggagctcgtg

SEQ ID NO: 18647 - DNA, 19 bp, Artificial Sequence
  Artificial sequence related to HLA knockouts in cell therapy
caggacacggagctcgtgg

SEQ ID NO: 18648 - DNA, 19 bp, Artificial Sequence
  Artificial sequence related to HLA knockouts in cell therapy
aggacacggagctcgtgga

SEQ ID NO: 18649 - DNA, 19 bp, Artificial Sequence
  Artificial sequence related to HLA knockouts in cell therapy
ggacacggagctcgtggag

SEQ ID NO: 18650 - DNA, 19 bp, Artificial Sequence
  Artificial sequence related to HLA knockouts in cell therapy
gacacggagctcgtggaga

SEQ ID NO: 18651 - DNA, 19 bp, Artificial Sequence
  Artificial sequence related to HLA knockouts in cell therapy
acacggagctcgtggagac

SEQ ID NO: 18652 - DNA, 19 bp, Artificial Sequence
  Artificial sequence related to HLA knockouts in cell therapy
cacggagctcgtggagacc

SEQ ID NO: 18653 - DNA, 19 bp, Artificial Sequence
  Artificial sequence related to HLA knockouts in cell therapy
acggagctcgtggagacca

SEQ ID NO: 18654 - DNA, 19 bp, Artificial Sequence
  Artificial sequence related to HLA knockouts in cell therapy
cggagctcgtggagaccag

SEQ ID NO: 18655 - DNA, 19 bp, Artificial Sequence
  Artificial sequence related to HLA knockouts in cell therapy
ggagctcgtggagaccagg

SEQ ID NO: 18656 - DNA, 19 bp, Artificial Sequence
  Artificial sequence related to HLA knockouts in cell therapy
gagctcgtggagaccaggc

SEQ ID NO: 18657 - DNA, 19 bp, Artificial Sequence
  Artificial sequence related to HLA knockouts in cell therapy
agctcgtggagaccaggcc

SEQ ID NO: 18658 - DNA, 19 bp, Artificial Sequence
  Artificial sequence related to HLA knockouts in cell therapy
gctcgtggagaccaggcct

SEQ ID NO: 18659 - DNA, 19 bp, Artificial Sequence
  Artificial sequence related to HLA knockouts in cell therapy
ctcgtggagaccaggcctg

SEQ ID NO: 18660 - DNA, 19 bp, Artificial Sequence
  Artificial sequence related to HLA knockouts in cell therapy
tcgtggagaccaggcctgc

SEQ ID NO: 18661 - DNA, 19 bp, Artificial Sequence
  Artificial sequence related to HLA knockouts in cell therapy
cgtggagaccaggcctgca

SEQ ID NO: 18662 - DNA, 19 bp, Artificial Sequence
  Artificial sequence related to HLA knockouts in cell therapy
gtggagaccaggcctgcag

SEQ ID NO: 18663 - DNA, 19 bp, Artificial Sequence
  Artificial sequence related to HLA knockouts in cell therapy
tggagaccaggcctgcagg

SEQ ID NO: 18664 - DNA, 19 bp, Artificial Sequence
  Artificial sequence related to HLA knockouts in cell therapy
ggagaccaggcctgcaggg

SEQ ID NO: 18665 - DNA, 19 bp, Artificial Sequence
  Artificial sequence related to HLA knockouts in cell therapy
gagaccaggcctgcagggg

SEQ ID NO: 18666 - DNA, 19 bp, Artificial Sequence
  Artificial sequence related to HLA knockouts in cell therapy
agaccaggcctgcagggga

SEQ ID NO: 18667 - DNA, 19 bp, Artificial Sequence
  Artificial sequence related to HLA knockouts in cell therapy
gaccaggcctgcaggggat

SEQ ID NO: 18668 - DNA, 19 bp, Artificial Sequence
  Artificial sequence related to HLA knockouts in cell therapy
accaggcctgcaggggatg

SEQ ID NO: 18669 - DNA, 19 bp, Artificial Sequence
  Artificial sequence related to HLA knockouts in cell therapy
ccaggcctgcaggggatgg

SEQ ID NO: 18670 - DNA, 19 bp, Artificial Sequence
  Artificial sequence related to HLA knockouts in cell therapy
caggcctgcaggggatgga

SEQ ID NO: 18671 - DNA, 19 bp, Artificial Sequence
  Artificial sequence related to HLA knockouts in cell therapy
aggcctgcaggggatggaa

SEQ ID NO: 18672 - DNA, 19 bp, Artificial Sequence
  Artificial sequence related to HLA knockouts in cell therapy
ggcctgcaggggatggaac

SEQ ID NO: 18673 - DNA, 19 bp, Artificial Sequence
  Artificial sequence related to HLA knockouts in cell therapy
gcctgcaggggatggaacc

SEQ ID NO: 18674 - DNA, 19 bp, Artificial Sequence
  Artificial sequence related to HLA knockouts in cell therapy
cctgcaggggatggaacct

SEQ ID NO: 18675 - DNA, 19 bp, Artificial Sequence
  Artificial sequence related to HLA knockouts in cell therapy
gcaggggatggaaccttcc

SEQ ID NO: 18676 - DNA, 19 bp, Artificial Sequence
  Artificial sequence related to HLA knockouts in cell therapy
accttccagaagtgggcgg

SEQ ID NO: 18677 - DNA, 19 bp, Artificial Sequence
  Artificial sequence related to HLA knockouts in cell therapy
ccttccagaagtgggcggc

SEQ ID NO: 18678 - DNA, 19 bp, Artificial Sequence
  Artificial sequence related to HLA knockouts in cell therapy
cttccagaagtgggcggct

SEQ ID NO: 18679 - DNA, 19 bp, Artificial Sequence
  Artificial sequence related to HLA knockouts in cell therapy
ttccagaagtgggcggctg

SEQ ID NO: 18680 - DNA, 19 bp, Artificial Sequence
  Artificial sequence related to HLA knockouts in cell therapy
tccagaagtgggcggctgt

SEQ ID NO: 18681 - DNA, 19 bp, Artificial Sequence
  Artificial sequence related to HLA knockouts in cell therapy
ccagaagtgggcggctgtg

SEQ ID NO: 18682 - DNA, 19 bp, Artificial Sequence
  Artificial sequence related to HLA knockouts in cell therapy
cagaagtgggcggctgtgg

SEQ ID NO: 18683 - DNA, 19 bp, Artificial Sequence
  Artificial sequence related to HLA knockouts in cell therapy
agaagtgggcggctgtggt

SEQ ID NO: 18684 - DNA, 19 bp, Artificial Sequence
  Artificial sequence related to HLA knockouts in cell therapy
gaagtgggcggctgtggtg

SEQ ID NO: 18685 - DNA, 19 bp, Artificial Sequence
  Artificial sequence related to HLA knockouts in cell therapy
aagtgggcggctgtggtgg

SEQ ID NO: 18686 - DNA, 19 bp, Artificial Sequence
  Artificial sequence related to HLA knockouts in cell therapy
agtgggcggctgtggtggt

SEQ ID NO: 18687 - DNA, 19 bp, Artificial Sequence
  Artificial sequence related to HLA knockouts in cell therapy
gtgggcggctgtggtggtg

SEQ ID NO: 18688 - DNA, 19 bp, Artificial Sequence
  Artificial sequence related to HLA knockouts in cell therapy
tgggcggctgtggtggtgc

SEQ ID NO: 18689 - DNA, 19 bp, Artificial Sequence
  Artificial sequence related to HLA knockouts in cell therapy
gggcggctgtggtggtgcc

SEQ ID NO: 18690 - DNA, 19 bp, Artificial Sequence
  Artificial sequence related to HLA knockouts in cell therapy
ggcggctgtggtggtgcct

SEQ ID NO: 18691 - DNA, 19 bp, Artificial Sequence
  Artificial sequence related to HLA knockouts in cell therapy
gcggctgtggtggtgcctt

SEQ ID NO: 18692 - DNA, 19 bp, Artificial Sequence
  Artificial sequence related to HLA knockouts in cell therapy
cggctgtggtggtgccttc

SEQ ID NO: 18693 - DNA, 19 bp, Artificial Sequence
  Artificial sequence related to HLA knockouts in cell therapy
ggctgtggtggtgccttct

SEQ ID NO: 18694 - DNA, 19 bp, Artificial Sequence
  Artificial sequence related to HLA knockouts in cell therapy
gctgtggtggtgccttctg

SEQ ID NO: 18695 - DNA, 19 bp, Artificial Sequence
  Artificial sequence related to HLA knockouts in cell therapy
ctgtggtggtgccttctgg

SEQ ID NO: 18696 - DNA, 19 bp, Artificial Sequence
  Artificial sequence related to HLA knockouts in cell therapy
gtggtggtgccttctggac

SEQ ID NO: 18697 - DNA, 19 bp, Artificial Sequence
  Artificial sequence related to HLA knockouts in cell therapy
ggtggtgccttctggacag

SEQ ID NO: 18698 - DNA, 19 bp, Artificial Sequence
  Artificial sequence related to HLA knockouts in cell therapy
gtggtgccttctggacagg

SEQ ID NO: 18699 - DNA, 19 bp, Artificial Sequence
  Artificial sequence related to HLA knockouts in cell therapy
ggtgccttctggacaggag

SEQ ID NO: 18700 - DNA, 19 bp, Artificial Sequence
  Artificial sequence related to HLA knockouts in cell therapy
gtgccttctggacaggagc

SEQ ID NO: 18701 - DNA, 19 bp, Artificial Sequence
  Artificial sequence related to HLA knockouts in cell therapy
gccttctggacaggagcag

SEQ ID NO: 18702 - DNA, 19 bp, Artificial Sequence
  Artificial sequence related to HLA knockouts in cell therapy
gccatgtgcagcatgaggg

SEQ ID NO: 18703 - DNA, 19 bp, Artificial Sequence
  Artificial sequence related to HLA knockouts in cell therapy
gcagcatgagggtttgccc

SEQ ID NO: 18704 - DNA, 19 bp, Artificial Sequence
  Artificial sequence related to HLA knockouts in cell therapy
tgagggtttgcccaagccc

SEQ ID NO: 18705 - DNA, 19 bp, Artificial Sequence
  Artificial sequence related to HLA knockouts in cell therapy
gagggtttgcccaagcccc

SEQ ID NO: 18706 - DNA, 19 bp, Artificial Sequence
  Artificial sequence related to HLA knockouts in cell therapy
agggtttgcccaagcccct

SEQ ID NO: 18707 - DNA, 19 bp, Artificial Sequence
  Artificial sequence related to HLA knockouts in cell therapy
gggtttgcccaagcccctc

SEQ ID NO: 18708 - DNA, 19 bp, Artificial Sequence
  Artificial sequence related to HLA knockouts in cell therapy
ggtttgcccaagcccctca

SEQ ID NO: 18709 - DNA, 19 bp, Artificial Sequence
  Artificial sequence related to HLA knockouts in cell therapy
gtttgcccaagcccctcac

SEQ ID NO: 18710 - DNA, 19 bp, Artificial Sequence
  Artificial sequence related to HLA knockouts in cell therapy
tttgcccaagcccctcacc

SEQ ID NO: 18711 - DNA, 19 bp, Artificial Sequence
  Artificial sequence related to HLA knockouts in cell therapy
ttgcccaagcccctcaccc

SEQ ID NO: 18712 - DNA, 19 bp, Artificial Sequence
  Artificial sequence related to HLA knockouts in cell therapy
tgcccaagcccctcaccct

SEQ ID NO: 18713 - DNA, 19 bp, Artificial Sequence
  Artificial sequence related to HLA knockouts in cell therapy
gcccaagcccctcaccctg

SEQ ID NO: 18714 - DNA, 19 bp, Artificial Sequence
  Artificial sequence related to HLA knockouts in cell therapy
cccaagcccctcaccctga

SEQ ID NO: 18715 - DNA, 19 bp, Artificial Sequence
  Artificial sequence related to HLA knockouts in cell therapy
ccaagcccctcaccctgag

SEQ ID NO: 18716 - DNA, 19 bp, Artificial Sequence
  Artificial sequence related to HLA knockouts in cell therapy
caagcccctcaccctgaga

SEQ ID NO: 18717 - DNA, 19 bp, Artificial Sequence
  Artificial sequence related to HLA knockouts in cell therapy
agcccctcaccctgagatg

SEQ ID NO: 18718 - DNA, 19 bp, Artificial Sequence
  Artificial sequence related to HLA knockouts in cell therapy
gcccctcaccctgagatgg

SEQ ID NO: 18719 - DNA, 19 bp, Artificial Sequence
  Artificial sequence related to HLA knockouts in cell therapy
cccctcaccctgagatggg

SEQ ID NO: 18720 - DNA, 19 bp, Artificial Sequence
  Artificial sequence related to HLA knockouts in cell therapy
ccctcaccctgagatggga

SEQ ID NO: 18721 - DNA, 19 bp, Artificial Sequence
  Artificial sequence related to HLA knockouts in cell therapy
cctcaccctgagatgggag

SEQ ID NO: 18722 - DNA, 19 bp, Artificial Sequence
  Artificial sequence related to HLA knockouts in cell therapy
ctcaccctgagatgggagc

SEQ ID NO: 18723 - DNA, 19 bp, Artificial Sequence
  Artificial sequence related to HLA knockouts in cell therapy
tcaccctgagatgggagcc

SEQ ID NO: 18724 - DNA, 19 bp, Artificial Sequence
  Artificial sequence related to HLA knockouts in cell therapy
caccctgagatgggagccg

SEQ ID NO: 18725 - DNA, 19 bp, Artificial Sequence
  Artificial sequence related to HLA knockouts in cell therapy
accctgagatgggagccgt

SEQ ID NO: 18726 - DNA, 19 bp, Artificial Sequence
  Artificial sequence related to HLA knockouts in cell therapy
ccctgagatgggagccgtc

SEQ ID NO: 18727 - DNA, 19 bp, Artificial Sequence
  Artificial sequence related to HLA knockouts in cell therapy
cctgagatgggagccgtct

SEQ ID NO: 18728 - DNA, 19 bp, Artificial Sequence
  Artificial sequence related to HLA knockouts in cell therapy
gagatgggagccgtcttcc

SEQ ID NO: 18729 - DNA, 19 bp, Artificial Sequence
  Artificial sequence related to HLA knockouts in cell therapy
agatgggagccgtcttccc

SEQ ID NO: 18730 - DNA, 19 bp, Artificial Sequence
  Artificial sequence related to HLA knockouts in cell therapy
gatgggagccgtcttccca

SEQ ID NO: 18731 - DNA, 19 bp, Artificial Sequence
  Artificial sequence related to HLA knockouts in cell therapy
atgggagccgtcttcccag

SEQ ID NO: 18732 - DNA, 19 bp, Artificial Sequence
  Artificial sequence related to HLA knockouts in cell therapy
tgggagccgtcttcccagc

SEQ ID NO: 18733 - DNA, 19 bp, Artificial Sequence
  Artificial sequence related to HLA knockouts in cell therapy
gggagccgtcttcccagcc

SEQ ID NO: 18734 - DNA, 19 bp, Artificial Sequence
  Artificial sequence related to HLA knockouts in cell therapy
ggagccgtcttcccagccc

SEQ ID NO: 18735 - DNA, 19 bp, Artificial Sequence
  Artificial sequence related to HLA knockouts in cell therapy
gagccgtcttcccagccca

SEQ ID NO: 18736 - DNA, 19 bp, Artificial Sequence
  Artificial sequence related to HLA knockouts in cell therapy
agccgtcttcccagcccac

SEQ ID NO: 18737 - DNA, 19 bp, Artificial Sequence
  Artificial sequence related to HLA knockouts in cell therapy
gccgtcttcccagcccacc

SEQ ID NO: 18738 - DNA, 19 bp, Artificial Sequence
  Artificial sequence related to HLA knockouts in cell therapy
ccgtcttcccagcccacca

SEQ ID NO: 18739 - DNA, 19 bp, Artificial Sequence
  Artificial sequence related to HLA knockouts in cell therapy
cgtcttcccagcccaccat

SEQ ID NO: 18740 - DNA, 19 bp, Artificial Sequence
  Artificial sequence related to HLA knockouts in cell therapy
gtcttcccagcccaccatc

SEQ ID NO: 18741 - DNA, 19 bp, Artificial Sequence
  Artificial sequence related to HLA knockouts in cell therapy
tcttcccagcccaccatcc

SEQ ID NO: 18742 - DNA, 19 bp, Artificial Sequence
  Artificial sequence related to HLA knockouts in cell therapy
cttcccagcccaccatccc

SEQ ID NO: 18743 - DNA, 19 bp, Artificial Sequence
  Artificial sequence related to HLA knockouts in cell therapy
ttcccagcccaccatcccc

SEQ ID NO: 18744 - DNA, 19 bp, Artificial Sequence
  Artificial sequence related to HLA knockouts in cell therapy
tcccagcccaccatcccca

SEQ ID NO: 18745 - DNA, 19 bp, Artificial Sequence
  Artificial sequence related to HLA knockouts in cell therapy
cccagcccaccatccccat

SEQ ID NO: 18746 - DNA, 19 bp, Artificial Sequence
  Artificial sequence related to HLA knockouts in cell therapy
ccagcccaccatccccatc

SEQ ID NO: 18747 - DNA, 19 bp, Artificial Sequence
  Artificial sequence related to HLA knockouts in cell therapy
cagcccaccatccccatcg

SEQ ID NO: 18748 - DNA, 19 bp, Artificial Sequence
  Artificial sequence related to HLA knockouts in cell therapy
agcccaccatccccatcgt

SEQ ID NO: 18749 - DNA, 19 bp, Artificial Sequence
  Artificial sequence related to HLA knockouts in cell therapy
gcccaccatccccatcgtg

SEQ ID NO: 18750 - DNA, 19 bp, Artificial Sequence
  Artificial sequence related to HLA knockouts in cell therapy
cccaccatccccatcgtgg

SEQ ID NO: 18751 - DNA, 19 bp, Artificial Sequence
  Artificial sequence related to HLA knockouts in cell therapy
ccaccatccccatcgtggg

SEQ ID NO: 18752 - DNA, 19 bp, Artificial Sequence
  Artificial sequence related to HLA knockouts in cell therapy
caccatccccatcgtgggc

SEQ ID NO: 18753 - DNA, 19 bp, Artificial Sequence
  Artificial sequence related to HLA knockouts in cell therapy
accatccccatcgtgggca

SEQ ID NO: 18754 - DNA, 19 bp, Artificial Sequence
  Artificial sequence related to HLA knockouts in cell therapy
ccatccccatcgtgggcat

SEQ ID NO: 18755 - DNA, 19 bp, Artificial Sequence
  Artificial sequence related to HLA knockouts in cell therapy
catccccatcgtgggcatc

SEQ ID NO: 18756 - DNA, 19 bp, Artificial Sequence
  Artificial sequence related to HLA knockouts in cell therapy
cgtgggcatcattgctggc

SEQ ID NO: 18757 - DNA, 19 bp, Artificial Sequence
  Artificial sequence related to HLA knockouts in cell therapy
gtgggcatcattgctggcc

SEQ ID NO: 18758 - DNA, 19 bp, Artificial Sequence
  Artificial sequence related to HLA knockouts in cell therapy
gggcatcattgctggcctg

SEQ ID NO: 18759 - DNA, 19 bp, Artificial Sequence
  Artificial sequence related to HLA knockouts in cell therapy
ggcatcattgctggcctgg

SEQ ID NO: 18760 - DNA, 19 bp, Artificial Sequence
  Artificial sequence related to HLA knockouts in cell therapy
tcactggagctgtggtcgc

SEQ ID NO: 18761 - DNA, 19 bp, Artificial Sequence
  Artificial sequence related to HLA knockouts in cell therapy
cactggagctgtggtcgct

SEQ ID NO: 18762 - DNA, 19 bp, Artificial Sequence
  Artificial sequence related to HLA knockouts in cell therapy
actggagctgtggtcgctg

SEQ ID NO: 18763 - DNA, 19 bp, Artificial Sequence
  Artificial sequence related to HLA knockouts in cell therapy
ctggagctgtggtcgctgc

SEQ ID NO: 18764 - DNA, 19 bp, Artificial Sequence
  Artificial sequence related to HLA knockouts in cell therapy
tggagctgtggtcgctgct

SEQ ID NO: 18765 - DNA, 19 bp, Artificial Sequence
  Artificial sequence related to HLA knockouts in cell therapy
ggagctgtggtcgctgctg

SEQ ID NO: 18766 - DNA, 19 bp, Artificial Sequence
  Artificial sequence related to HLA knockouts in cell therapy
gagctgtggtcgctgctgt

SEQ ID NO: 18767 - DNA, 19 bp, Artificial Sequence
  Artificial sequence related to HLA knockouts in cell therapy
agctgtggtcgctgctgtg

SEQ ID NO: 18768 - DNA, 19 bp, Artificial Sequence
  Artificial sequence related to HLA knockouts in cell therapy
gctgtggtcgctgctgtga

SEQ ID NO: 18769 - DNA, 19 bp, Artificial Sequence
  Artificial sequence related to HLA knockouts in cell therapy
ggtcgctgctgtgatgtgg

SEQ ID NO: 18770 - DNA, 19 bp, Artificial Sequence
  Artificial sequence related to HLA knockouts in cell therapy
cgctgctgtgatgtggagg

SEQ ID NO: 18771 - DNA, 19 bp, Artificial Sequence
  Artificial sequence related to HLA knockouts in cell therapy
ggagggagctactctcagg

SEQ ID NO: 18772 - DNA, 19 bp, Artificial Sequence
  Artificial sequence related to HLA knockouts in cell therapy
gagggagctactctcaggc

SEQ ID NO: 18773 - DNA, 19 bp, Artificial Sequence
  Artificial sequence related to HLA knockouts in cell therapy
gggagctactctcaggctg

SEQ ID NO: 18774 - DNA, 19 bp, Artificial Sequence
  Artificial sequence related to HLA knockouts in cell therapy
ggagctactctcaggctgc

SEQ ID NO: 18775 - DNA, 19 bp, Artificial Sequence
  Artificial sequence related to HLA knockouts in cell therapy
gcaagcagtgacagtgccc

SEQ ID NO: 18776 - DNA, 19 bp, Artificial Sequence
  Artificial sequence related to HLA knockouts in cell therapy
agcagtgacagtgcccagg

SEQ ID NO: 18777 - DNA, 19 bp, Artificial Sequence
  Artificial sequence related to HLA knockouts in cell therapy
gcagtgacagtgcccaggg

SEQ ID NO: 18778 - DNA, 19 bp, Artificial Sequence
  Artificial sequence related to HLA knockouts in cell therapy
cagtgacagtgcccagggc

SEQ ID NO: 18779 - DNA, 19 bp, Artificial Sequence
  Artificial sequence related to HLA knockouts in cell therapy
agtgacagtgcccagggct

SEQ ID NO: 18780 - DNA, 19 bp, Artificial Sequence
  Artificial sequence related to HLA knockouts in cell therapy
gtgacagtgcccagggctc

SEQ ID NO: 18781 - DNA, 19 bp, Artificial Sequence
  Artificial sequence related to HLA knockouts in cell therapy
tgacagtgcccagggctct

SEQ ID NO: 18782 - DNA, 19 bp, Artificial Sequence
  Artificial sequence related to HLA knockouts in cell therapy
gacagtgcccagggctctg

SEQ ID NO: 18783 - DNA, 19 bp, Artificial Sequence
  Artificial sequence related to HLA knockouts in cell therapy
acagtgcccagggctctga

SEQ ID NO: 18784 - DNA, 19 bp, Artificial Sequence
  Artificial sequence related to HLA knockouts in cell therapy
cagtgcccagggctctgat

SEQ ID NO: 18785 - DNA, 19 bp, Artificial Sequence
  Artificial sequence related to HLA knockouts in cell therapy
agtgcccagggctctgatg

SEQ ID NO: 18786 - DNA, 19 bp, Artificial Sequence
  Artificial sequence related to HLA knockouts in cell therapy
gtgcccagggctctgatgt

SEQ ID NO: 18787 - DNA, 19 bp, Artificial Sequence
  Artificial sequence related to HLA knockouts in cell therapy
tgcccagggctctgatgtg

SEQ ID NO: 18788 - DNA, 19 bp, Artificial Sequence
  Artificial sequence related to HLA knockouts in cell therapy
gcccagggctctgatgtgt

SEQ ID NO: 18789 - DNA, 19 bp, Artificial Sequence
  Artificial sequence related to HLA knockouts in cell therapy
cccagggctctgatgtgtc

SEQ ID NO: 18790 - DNA, 19 bp, Artificial Sequence
  Artificial sequence related to HLA knockouts in cell therapy
gacagctgccttgtgtggg

SEQ ID NO: 18791 - DNA, 19 bp, Artificial Sequence
  Artificial sequence related to HLA knockouts in cell therapy
cagctgccttgtgtgggac

SEQ ID NO: 18792 - DNA, 19 bp, Artificial Sequence
  Artificial sequence related to HLA knockouts in cell therapy
gctgccttgtgtgggactg

SEQ ID NO: 18793 - DNA, 19 bp, Artificial Sequence
  Artificial sequence related to HLA knockouts in cell therapy
tgtgaggaggtggggagac

SEQ ID NO: 18794 - DNA, 19 bp, Artificial Sequence
  Artificial sequence related to HLA knockouts in cell therapy
gtgaggaggtggggagacc

SEQ ID NO: 18795 - DNA, 19 bp, Artificial Sequence
  Artificial sequence related to HLA knockouts in cell therapy
tgaggaggtggggagacca

SEQ ID NO: 18796 - DNA, 19 bp, Artificial Sequence
  Artificial sequence related to HLA knockouts in cell therapy
gaggaggtggggagaccac

SEQ ID NO: 18797 - DNA, 19 bp, Artificial Sequence
  Artificial sequence related to HLA knockouts in cell therapy
aggaggtggggagaccacc

SEQ ID NO: 18798 - DNA, 19 bp, Artificial Sequence
  Artificial sequence related to HLA knockouts in cell therapy
ggaggtggggagaccaccc

SEQ ID NO: 18799 - DNA, 19 bp, Artificial Sequence
  Artificial sequence related to HLA knockouts in cell therapy
gaggtggggagaccacccc

SEQ ID NO: 18800 - DNA, 19 bp, Artificial Sequence
  Artificial sequence related to HLA knockouts in cell therapy
aggtggggagaccacccca

SEQ ID NO: 18801 - DNA, 19 bp, Artificial Sequence
  Artificial sequence related to HLA knockouts in cell therapy
ggtggggagaccaccccac

SEQ ID NO: 18802 - DNA, 19 bp, Artificial Sequence
  Artificial sequence related to HLA knockouts in cell therapy
gtggggagaccaccccacc

SEQ ID NO: 18803 - DNA, 19 bp, Artificial Sequence
  Artificial sequence related to HLA knockouts in cell therapy
tggggagaccaccccaccc

SEQ ID NO: 18804 - DNA, 19 bp, Artificial Sequence
  Artificial sequence related to HLA knockouts in cell therapy
ggggagaccaccccacccc

SEQ ID NO: 18805 - DNA, 19 bp, Artificial Sequence
  Artificial sequence related to HLA knockouts in cell therapy
gggagaccaccccaccccc

SEQ ID NO: 18806 - DNA, 19 bp, Artificial Sequence
  Artificial sequence related to HLA knockouts in cell therapy
ggagaccaccccaccccca

SEQ ID NO: 18807 - DNA, 19 bp, Artificial Sequence
  Artificial sequence related to HLA knockouts in cell therapy
gagaccaccccacccccat

SEQ ID NO: 18808 - DNA, 19 bp, Artificial Sequence
  Artificial sequence related to HLA knockouts in cell therapy
agaccaccccacccccatg

SEQ ID NO: 18809 - DNA, 19 bp, Artificial Sequence
  Artificial sequence related to HLA knockouts in cell therapy
gaccaccccacccccatgt

SEQ ID NO: 18810 - DNA, 19 bp, Artificial Sequence
  Artificial sequence related to HLA knockouts in cell therapy
accaccccacccccatgtc

SEQ ID NO: 18811 - DNA, 19 bp, Artificial Sequence
  Artificial sequence related to HLA knockouts in cell therapy
ccaccccacccccatgtcc

SEQ ID NO: 18812 - DNA, 19 bp, Artificial Sequence
  Artificial sequence related to HLA knockouts in cell therapy
caccccacccccatgtcca

SEQ ID NO: 18813 - DNA, 19 bp, Artificial Sequence
  Artificial sequence related to HLA knockouts in cell therapy
accccacccccatgtccac

SEQ ID NO: 18814 - DNA, 19 bp, Artificial Sequence
  Artificial sequence related to HLA knockouts in cell therapy
ccccacccccatgtccacc

SEQ ID NO: 18815 - DNA, 19 bp, Artificial Sequence
  Artificial sequence related to HLA knockouts in cell therapy
cccacccccatgtccacca

SEQ ID NO: 18816 - DNA, 19 bp, Artificial Sequence
  Artificial sequence related to HLA knockouts in cell therapy
ccacccccatgtccaccat

SEQ ID NO: 18817 - DNA, 19 bp, Artificial Sequence
  Artificial sequence related to HLA knockouts in cell therapy
cacccccatgtccaccatg

SEQ ID NO: 18818 - DNA, 19 bp, Artificial Sequence
  Artificial sequence related to HLA knockouts in cell therapy
cccccatgtccaccatgac

SEQ ID NO: 18819 - DNA, 19 bp, Artificial Sequence
  Artificial sequence related to HLA knockouts in cell therapy
ccccatgtccaccatgacc

SEQ ID NO: 18820 - DNA, 19 bp, Artificial Sequence
  Artificial sequence related to HLA knockouts in cell therapy
cccatgtccaccatgaccc

SEQ ID NO: 18821 - DNA, 19 bp, Artificial Sequence
  Artificial sequence related to HLA knockouts in cell therapy
ccaccatgaccctcttccc

SEQ ID NO: 18822 - DNA, 19 bp, Artificial Sequence
  Artificial sequence related to HLA knockouts in cell therapy
ccatgaccctcttcccacg

SEQ ID NO: 18823 - DNA, 19 bp, Artificial Sequence
  Artificial sequence related to HLA knockouts in cell therapy
catgaccctcttcccacgc

SEQ ID NO: 18824 - DNA, 19 bp, Artificial Sequence
  Artificial sequence related to HLA knockouts in cell therapy
tgaccctcttcccacgctg

SEQ ID NO: 18825 - DNA, 19 bp, Artificial Sequence
  Artificial sequence related to HLA knockouts in cell therapy
gaccctcttcccacgctga

SEQ ID NO: 18826 - DNA, 19 bp, Artificial Sequence
  Artificial sequence related to HLA knockouts in cell therapy
accctcttcccacgctgac

SEQ ID NO: 18827 - DNA, 19 bp, Artificial Sequence
  Artificial sequence related to HLA knockouts in cell therapy
ccctcttcccacgctgacc

SEQ ID NO: 18828 - DNA, 19 bp, Artificial Sequence
  Artificial sequence related to HLA knockouts in cell therapy
cctcttcccacgctgacct

SEQ ID NO: 18829 - DNA, 19 bp, Artificial Sequence
  Artificial sequence related to HLA knockouts in cell therapy
ctcttcccacgctgacctg

SEQ ID NO: 18830 - DNA, 19 bp, Artificial Sequence
  Artificial sequence related to HLA knockouts in cell therapy
cttcccacgctgacctgtg

SEQ ID NO: 18831 - DNA, 19 bp, Artificial Sequence
  Artificial sequence related to HLA knockouts in cell therapy
ttcccacgctgacctgtgc

SEQ ID NO: 18832 - DNA, 19 bp, Artificial Sequence
  Artificial sequence related to HLA knockouts in cell therapy
tcccacgctgacctgtgct

SEQ ID NO: 18833 - DNA, 19 bp, Artificial Sequence
  Artificial sequence related to HLA knockouts in cell therapy
cccacgctgacctgtgctc

SEQ ID NO: 18834 - DNA, 19 bp, Artificial Sequence
  Artificial sequence related to HLA knockouts in cell therapy
ccacgctgacctgtgctcc

SEQ ID NO: 18835 - DNA, 19 bp, Artificial Sequence
  Artificial sequence related to HLA knockouts in cell therapy
cacgctgacctgtgctccc

SEQ ID NO: 18836 - DNA, 19 bp, Artificial Sequence
  Artificial sequence related to HLA knockouts in cell therapy
acgctgacctgtgctccct

SEQ ID NO: 18837 - DNA, 19 bp, Artificial Sequence
  Artificial sequence related to HLA knockouts in cell therapy
cgctgacctgtgctccctc

SEQ ID NO: 18838 - DNA, 19 bp, Artificial Sequence
  Artificial sequence related to HLA knockouts in cell therapy
gctgacctgtgctccctcc

SEQ ID NO: 18839 - DNA, 19 bp, Artificial Sequence
  Artificial sequence related to HLA knockouts in cell therapy
ctgacctgtgctccctccc

SEQ ID NO: 18840 - DNA, 19 bp, Artificial Sequence
  Artificial sequence related to HLA knockouts in cell therapy
tgacctgtgctccctcccc

SEQ ID NO: 18841 - DNA, 19 bp, Artificial Sequence
  Artificial sequence related to HLA knockouts in cell therapy
gacctgtgctccctcccca

SEQ ID NO: 18842 - DNA, 19 bp, Artificial Sequence
  Artificial sequence related to HLA knockouts in cell therapy
acctgtgctccctccccaa

SEQ ID NO: 18843 - DNA, 19 bp, Artificial Sequence
  Artificial sequence related to HLA knockouts in cell therapy
cctgtgctccctccccaat

SEQ ID NO: 18844 - DNA, 19 bp, Artificial Sequence
  Artificial sequence related to HLA knockouts in cell therapy
ctgtgctccctccccaatc

SEQ ID NO: 18845 - DNA, 19 bp, Artificial Sequence
  Artificial sequence related to HLA knockouts in cell therapy
cctgttccagagaggtggg

SEQ ID NO: 18846 - DNA, 19 bp, Artificial Sequence
  Artificial sequence related to HLA knockouts in cell therapy
ctgttccagagaggtgggg

SEQ ID NO: 18847 - DNA, 19 bp, Artificial Sequence
  Artificial sequence related to HLA knockouts in cell therapy
tgttccagagaggtggggc

SEQ ID NO: 18848 - DNA, 19 bp, Artificial Sequence
  Artificial sequence related to HLA knockouts in cell therapy
gttccagagaggtggggct

SEQ ID NO: 18849 - DNA, 19 bp, Artificial Sequence
  Artificial sequence related to HLA knockouts in cell therapy
ttccagagaggtggggctg

SEQ ID NO: 18850 - DNA, 19 bp, Artificial Sequence
  Artificial sequence related to HLA knockouts in cell therapy
tccagagaggtggggctga

SEQ ID NO: 18851 - DNA, 19 bp, Artificial Sequence
  Artificial sequence related to HLA knockouts in cell therapy
ccagagaggtggggctgag

SEQ ID NO: 18852 - DNA, 19 bp, Artificial Sequence
  Artificial sequence related to HLA knockouts in cell therapy
cagagaggtggggctgagg

SEQ ID NO: 18853 - DNA, 19 bp, Artificial Sequence
  Artificial sequence related to HLA knockouts in cell therapy
agagaggtggggctgaggt

SEQ ID NO: 18854 - DNA, 19 bp, Artificial Sequence
  Artificial sequence related to HLA knockouts in cell therapy
gagaggtggggctgaggtg

SEQ ID NO: 18855 - DNA, 19 bp, Artificial Sequence
  Artificial sequence related to HLA knockouts in cell therapy
agaggtggggctgaggtgt

SEQ ID NO: 18856 - DNA, 19 bp, Artificial Sequence
  Artificial sequence related to HLA knockouts in cell therapy
gaggtggggctgaggtgtc

SEQ ID NO: 18857 - DNA, 19 bp, Artificial Sequence
  Artificial sequence related to HLA knockouts in cell therapy
aggtggggctgaggtgtct

SEQ ID NO: 18858 - DNA, 19 bp, Artificial Sequence
  Artificial sequence related to HLA knockouts in cell therapy
ggtggggctgaggtgtctc

SEQ ID NO: 18859 - DNA, 19 bp, Artificial Sequence
  Artificial sequence related to HLA knockouts in cell therapy
gtggggctgaggtgtctcc

SEQ ID NO: 18860 - DNA, 19 bp, Artificial Sequence
  Artificial sequence related to HLA knockouts in cell therapy
tggggctgaggtgtctcca

SEQ ID NO: 18861 - DNA, 19 bp, Artificial Sequence
  Artificial sequence related to HLA knockouts in cell therapy
ggggctgaggtgtctccat

SEQ ID NO: 18862 - DNA, 19 bp, Artificial Sequence
  Artificial sequence related to HLA knockouts in cell therapy
gggctgaggtgtctccatc

SEQ ID NO: 18863 - DNA, 20 bp, Artificial Sequence
  Artificial sequence related to HLA knockouts in cell therapy
cagaagcagaggggtcaggg

SEQ ID NO: 18864 - DNA, 20 bp, Artificial Sequence
  Artificial sequence related to HLA knockouts in cell therapy
agaagcagaggggtcagggc

SEQ ID NO: 18865 - DNA, 20 bp, Artificial Sequence
  Artificial sequence related to HLA knockouts in cell therapy
gaagcagaggggtcagggcg

SEQ ID NO: 18866 - DNA, 20 bp, Artificial Sequence
  Artificial sequence related to HLA knockouts in cell therapy
aagcagaggggtcagggcga

SEQ ID NO: 18867 - DNA, 20 bp, Artificial Sequence
  Artificial sequence related to HLA knockouts in cell therapy
agcagaggggtcagggcgaa

SEQ ID NO: 18868 - DNA, 20 bp, Artificial Sequence
  Artificial sequence related to HLA knockouts in cell therapy
gcagaggggtcagggcgaag

SEQ ID NO: 18869 - DNA, 20 bp, Artificial Sequence
  Artificial sequence related to HLA knockouts in cell therapy
cagaggggtcagggcgaagt

SEQ ID NO: 18870 - DNA, 20 bp, Artificial Sequence
  Artificial sequence related to HLA knockouts in cell therapy
agaggggtcagggcgaagtc

SEQ ID NO: 18871 - DNA, 20 bp, Artificial Sequence
  Artificial sequence related to HLA knockouts in cell therapy
gaggggtcagggcgaagtcc

SEQ ID NO: 18872 - DNA, 20 bp, Artificial Sequence
  Artificial sequence related to HLA knockouts in cell therapy
aggggtcagggcgaagtccc

SEQ ID NO: 18873 - DNA, 20 bp, Artificial Sequence
  Artificial sequence related to HLA knockouts in cell therapy
ggggtcagggcgaagtccca

SEQ ID NO: 18874 - DNA, 20 bp, Artificial Sequence
  Artificial sequence related to HLA knockouts in cell therapy
gggtcagggcgaagtcccag

SEQ ID NO: 18875 - DNA, 20 bp, Artificial Sequence
  Artificial sequence related to HLA knockouts in cell therapy
ggtcagggcgaagtcccagg

SEQ ID NO: 18876 - DNA, 20 bp, Artificial Sequence
  Artificial sequence related to HLA knockouts in cell therapy
gtcagggcgaagtcccaggg

SEQ ID NO: 18877 - DNA, 20 bp, Artificial Sequence
  Artificial sequence related to HLA knockouts in cell therapy
tcagggcgaagtcccagggc

SEQ ID NO: 18878 - DNA, 20 bp, Artificial Sequence
  Artificial sequence related to HLA knockouts in cell therapy
cagggcgaagtcccagggcc

SEQ ID NO: 18879 - DNA, 20 bp, Artificial Sequence
  Artificial sequence related to HLA knockouts in cell therapy
agggcgaagtcccagggccc

SEQ ID NO: 18880 - DNA, 20 bp, Artificial Sequence
  Artificial sequence related to HLA knockouts in cell therapy
gggcgaagtcccagggcccc

SEQ ID NO: 18881 - DNA, 20 bp, Artificial Sequence
  Artificial sequence related to HLA knockouts in cell therapy
ggcgaagtcccagggcccca

SEQ ID NO: 18882 - DNA, 20 bp, Artificial Sequence
  Artificial sequence related to HLA knockouts in cell therapy
gcgaagtcccagggccccag

SEQ ID NO: 18883 - DNA, 20 bp, Artificial Sequence
  Artificial sequence related to HLA knockouts in cell therapy
cgaagtcccagggccccagg

SEQ ID NO: 18884 - DNA, 20 bp, Artificial Sequence
  Artificial sequence related to HLA knockouts in cell therapy
gaagtcccagggccccaggc

SEQ ID NO: 18885 - DNA, 20 bp, Artificial Sequence
  Artificial sequence related to HLA knockouts in cell therapy
aagtcccagggccccaggcg

SEQ ID NO: 18886 - DNA, 20 bp, Artificial Sequence
  Artificial sequence related to HLA knockouts in cell therapy
agtcccagggccccaggcgt

SEQ ID NO: 18887 - DNA, 20 bp, Artificial Sequence
  Artificial sequence related to HLA knockouts in cell therapy
gtcccagggccccaggcgtg

SEQ ID NO: 18888 - DNA, 20 bp, Artificial Sequence
  Artificial sequence related to HLA knockouts in cell therapy
tcccagggccccaggcgtgg

SEQ ID NO: 18889 - DNA, 20 bp, Artificial Sequence
  Artificial sequence related to HLA knockouts in cell therapy
cccagggccccaggcgtggc

SEQ ID NO: 18890 - DNA, 20 bp, Artificial Sequence
  Artificial sequence related to HLA knockouts in cell therapy
ccagggccccaggcgtggct

SEQ ID NO: 18891 - DNA, 20 bp, Artificial Sequence
  Artificial sequence related to HLA knockouts in cell therapy
cagggccccaggcgtggctc

SEQ ID NO: 18892 - DNA, 20 bp, Artificial Sequence
  Artificial sequence related to HLA knockouts in cell therapy
agggccccaggcgtggctct

SEQ ID NO: 18893 - DNA, 20 bp, Artificial Sequence
  Artificial sequence related to HLA knockouts in cell therapy
gggccccaggcgtggctctc

SEQ ID NO: 18894 - DNA, 20 bp, Artificial Sequence
  Artificial sequence related to HLA knockouts in cell therapy
ggccccaggcgtggctctca

SEQ ID NO: 18895 - DNA, 20 bp, Artificial Sequence
  Artificial sequence related to HLA knockouts in cell therapy
gccccaggcgtggctctcag

SEQ ID NO: 18896 - DNA, 20 bp, Artificial Sequence
  Artificial sequence related to HLA knockouts in cell therapy
ccccaggcgtggctctcagg

SEQ ID NO: 18897 - DNA, 20 bp, Artificial Sequence
  Artificial sequence related to HLA knockouts in cell therapy
cccaggcgtggctctcaggg

SEQ ID NO: 18898 - DNA, 20 bp, Artificial Sequence
  Artificial sequence related to HLA knockouts in cell therapy
ccaggcgtggctctcagggt

SEQ ID NO: 18899 - DNA, 20 bp, Artificial Sequence
  Artificial sequence related to HLA knockouts in cell therapy
caggcgtggctctcagggtc

SEQ ID NO: 18900 - DNA, 20 bp, Artificial Sequence
  Artificial sequence related to HLA knockouts in cell therapy
aggcgtggctctcagggtct

SEQ ID NO: 18901 - DNA, 20 bp, Artificial Sequence
  Artificial sequence related to HLA knockouts in cell therapy
ggcgtggctctcagggtctc

SEQ ID NO: 18902 - DNA, 20 bp, Artificial Sequence
  Artificial sequence related to HLA knockouts in cell therapy
gcgtggctctcagggtctca

SEQ ID NO: 18903 - DNA, 20 bp, Artificial Sequence
  Artificial sequence related to HLA knockouts in cell therapy
cgtggctctcagggtctcag

SEQ ID NO: 18904 - DNA, 20 bp, Artificial Sequence
  Artificial sequence related to HLA knockouts in cell therapy
gtggctctcagggtctcagg

SEQ ID NO: 18905 - DNA, 20 bp, Artificial Sequence
  Artificial sequence related to HLA knockouts in cell therapy
tggctctcagggtctcaggc

SEQ ID NO: 18906 - DNA, 20 bp, Artificial Sequence
  Artificial sequence related to HLA knockouts in cell therapy
ggctctcagggtctcaggcc

SEQ ID NO: 18907 - DNA, 20 bp, Artificial Sequence
  Artificial sequence related to HLA knockouts in cell therapy
gctctcagggtctcaggccc

SEQ ID NO: 18908 - DNA, 20 bp, Artificial Sequence
  Artificial sequence related to HLA knockouts in cell therapy
ctctcagggtctcaggcccc

SEQ ID NO: 18909 - DNA, 20 bp, Artificial Sequence
  Artificial sequence related to HLA knockouts in cell therapy
tctcagggtctcaggccccg

SEQ ID NO: 18910 - DNA, 20 bp, Artificial Sequence
  Artificial sequence related to HLA knockouts in cell therapy
ctcagggtctcaggccccga

SEQ ID NO: 18911 - DNA, 20 bp, Artificial Sequence
  Artificial sequence related to HLA knockouts in cell therapy
tcagggtctcaggccccgaa

SEQ ID NO: 18912 - DNA, 20 bp, Artificial Sequence
  Artificial sequence related to HLA knockouts in cell therapy
cagggtctcaggccccgaag

SEQ ID NO: 18913 - DNA, 20 bp, Artificial Sequence
  Artificial sequence related to HLA knockouts in cell therapy
agggtctcaggccccgaagg

SEQ ID NO: 18914 - DNA, 20 bp, Artificial Sequence
  Artificial sequence related to HLA knockouts in cell therapy
gggtctcaggccccgaaggc

SEQ ID NO: 18915 - DNA, 20 bp, Artificial Sequence
  Artificial sequence related to HLA knockouts in cell therapy
ggtctcaggccccgaaggcg

SEQ ID NO: 18916 - DNA, 20 bp, Artificial Sequence
  Artificial sequence related to HLA knockouts in cell therapy
gtctcaggccccgaaggcgg

SEQ ID NO: 18917 - DNA, 20 bp, Artificial Sequence
  Artificial sequence related to HLA knockouts in cell therapy
tctcaggccccgaaggcggt

SEQ ID NO: 18918 - DNA, 20 bp, Artificial Sequence
  Artificial sequence related to HLA knockouts in cell therapy
ctcaggccccgaaggcggtg

SEQ ID NO: 18919 - DNA, 20 bp, Artificial Sequence
  Artificial sequence related to HLA knockouts in cell therapy
tcaggccccgaaggcggtgt

SEQ ID NO: 18920 - DNA, 20 bp, Artificial Sequence
  Artificial sequence related to HLA knockouts in cell therapy
caggccccgaaggcggtgta

SEQ ID NO: 18921 - DNA, 20 bp, Artificial Sequence
  Artificial sequence related to HLA knockouts in cell therapy
aggccccgaaggcggtgtat

SEQ ID NO: 18922 - DNA, 20 bp, Artificial Sequence
  Artificial sequence related to HLA knockouts in cell therapy
ggccccgaaggcggtgtatg

SEQ ID NO: 18923 - DNA, 20 bp, Artificial Sequence
  Artificial sequence related to HLA knockouts in cell therapy
gccccgaaggcggtgtatgg

SEQ ID NO: 18924 - DNA, 20 bp, Artificial Sequence
  Artificial sequence related to HLA knockouts in cell therapy
ccccgaaggcggtgtatgga

SEQ ID NO: 18925 - DNA, 20 bp, Artificial Sequence
  Artificial sequence related to HLA knockouts in cell therapy
cccgaaggcggtgtatggat

SEQ ID NO: 18926 - DNA, 20 bp, Artificial Sequence
  Artificial sequence related to HLA knockouts in cell therapy
aggcggtgtatggattgggg

SEQ ID NO: 18927 - DNA, 20 bp, Artificial Sequence
  Artificial sequence related to HLA knockouts in cell therapy
ggcggtgtatggattgggga

SEQ ID NO: 18928 - DNA, 20 bp, Artificial Sequence
  Artificial sequence related to HLA knockouts in cell therapy
gcggtgtatggattggggag

SEQ ID NO: 18929 - DNA, 20 bp, Artificial Sequence
  Artificial sequence related to HLA knockouts in cell therapy
atggattggggagtcccagc

SEQ ID NO: 18930 - DNA, 20 bp, Artificial Sequence
  Artificial sequence related to HLA knockouts in cell therapy
tggattggggagtcccagcc

SEQ ID NO: 18931 - DNA, 20 bp, Artificial Sequence
  Artificial sequence related to HLA knockouts in cell therapy
ggattggggagtcccagcct

SEQ ID NO: 18932 - DNA, 20 bp, Artificial Sequence
  Artificial sequence related to HLA knockouts in cell therapy
gattggggagtcccagcctt

SEQ ID NO: 18933 - DNA, 20 bp, Artificial Sequence
  Artificial sequence related to HLA knockouts in cell therapy
attggggagtcccagccttg

SEQ ID NO: 18934 - DNA, 20 bp, Artificial Sequence
  Artificial sequence related to HLA knockouts in cell therapy
ttggggagtcccagccttgg

SEQ ID NO: 18935 - DNA, 20 bp, Artificial Sequence
  Artificial sequence related to HLA knockouts in cell therapy
tggggagtcccagccttggg

SEQ ID NO: 18936 - DNA, 20 bp, Artificial Sequence
  Artificial sequence related to HLA knockouts in cell therapy
ggggagtcccagccttgggg

SEQ ID NO: 18937 - DNA, 20 bp, Artificial Sequence
  Artificial sequence related to HLA knockouts in cell therapy
gggagtcccagccttgggga

SEQ ID NO: 18938 - DNA, 20 bp, Artificial Sequence
  Artificial sequence related to HLA knockouts in cell therapy
ggagtcccagccttggggat

SEQ ID NO: 18939 - DNA, 20 bp, Artificial Sequence
  Artificial sequence related to HLA knockouts in cell therapy
gagtcccagccttggggatt

SEQ ID NO: 18940 - DNA, 20 bp, Artificial Sequence
  Artificial sequence related to HLA knockouts in cell therapy
agtcccagccttggggattc

SEQ ID NO: 18941 - DNA, 20 bp, Artificial Sequence
  Artificial sequence related to HLA knockouts in cell therapy
gtcccagccttggggattcc

SEQ ID NO: 18942 - DNA, 20 bp, Artificial Sequence
  Artificial sequence related to HLA knockouts in cell therapy
tcccagccttggggattccc

SEQ ID NO: 18943 - DNA, 20 bp, Artificial Sequence
  Artificial sequence related to HLA knockouts in cell therapy
cccagccttggggattcccc

SEQ ID NO: 18944 - DNA, 20 bp, Artificial Sequence
  Artificial sequence related to HLA knockouts in cell therapy
ccagccttggggattcccca

SEQ ID NO: 18945 - DNA, 20 bp, Artificial Sequence
  Artificial sequence related to HLA knockouts in cell therapy
cagccttggggattccccaa

SEQ ID NO: 18946 - DNA, 20 bp, Artificial Sequence
  Artificial sequence related to HLA knockouts in cell therapy
agccttggggattccccaac

SEQ ID NO: 18947 - DNA, 20 bp, Artificial Sequence
  Artificial sequence related to HLA knockouts in cell therapy
gccttggggattccccaact

SEQ ID NO: 18948 - DNA, 20 bp, Artificial Sequence
  Artificial sequence related to HLA knockouts in cell therapy
ccttggggattccccaactc

SEQ ID NO: 18949 - DNA, 20 bp, Artificial Sequence
  Artificial sequence related to HLA knockouts in cell therapy
cttggggattccccaactcc

SEQ ID NO: 18950 - DNA, 20 bp, Artificial Sequence
  Artificial sequence related to HLA knockouts in cell therapy
ttggggattccccaactccg

SEQ ID NO: 18951 - DNA, 20 bp, Artificial Sequence
  Artificial sequence related to HLA knockouts in cell therapy
tggggattccccaactccgc

SEQ ID NO: 18952 - DNA, 20 bp, Artificial Sequence
  Artificial sequence related to HLA knockouts in cell therapy
ggggattccccaactccgca

SEQ ID NO: 18953 - DNA, 20 bp, Artificial Sequence
  Artificial sequence related to HLA knockouts in cell therapy
gggattccccaactccgcag

SEQ ID NO: 18954 - DNA, 20 bp, Artificial Sequence
  Artificial sequence related to HLA knockouts in cell therapy
ggattccccaactccgcagt

SEQ ID NO: 18955 - DNA, 20 bp, Artificial Sequence
  Artificial sequence related to HLA knockouts in cell therapy
tcctggatactcacgacgcg

SEQ ID NO: 18956 - DNA, 20 bp, Artificial Sequence
  Artificial sequence related to HLA knockouts in cell therapy
cctggatactcacgacgcgg

SEQ ID NO: 18957 - DNA, 20 bp, Artificial Sequence
  Artificial sequence related to HLA knockouts in cell therapy
ctggatactcacgacgcgga

SEQ ID NO: 18958 - DNA, 20 bp, Artificial Sequence
  Artificial sequence related to HLA knockouts in cell therapy
tggatactcacgacgcggac

SEQ ID NO: 18959 - DNA, 20 bp, Artificial Sequence
  Artificial sequence related to HLA knockouts in cell therapy
ggatactcacgacgcggacc

SEQ ID NO: 18960 - DNA, 20 bp, Artificial Sequence
  Artificial sequence related to HLA knockouts in cell therapy
gatactcacgacgcggaccc

SEQ ID NO: 18961 - DNA, 20 bp, Artificial Sequence
  Artificial sequence related to HLA knockouts in cell therapy
atactcacgacgcggaccca

SEQ ID NO: 18962 - DNA, 20 bp, Artificial Sequence
  Artificial sequence related to HLA knockouts in cell therapy
tactcacgacgcggacccag

SEQ ID NO: 18963 - DNA, 20 bp, Artificial Sequence
  Artificial sequence related to HLA knockouts in cell therapy
actcacgacgcggacccagt

SEQ ID NO: 18964 - DNA, 20 bp, Artificial Sequence
  Artificial sequence related to HLA knockouts in cell therapy
ctcacgacgcggacccagtt

SEQ ID NO: 18965 - DNA, 20 bp, Artificial Sequence
  Artificial sequence related to HLA knockouts in cell therapy
tcacgacgcggacccagttc

SEQ ID NO: 18966 - DNA, 20 bp, Artificial Sequence
  Artificial sequence related to HLA knockouts in cell therapy
cacgacgcggacccagttct

SEQ ID NO: 18967 - DNA, 20 bp, Artificial Sequence
  Artificial sequence related to HLA knockouts in cell therapy
acgacgcggacccagttctc

SEQ ID NO: 18968 - DNA, 20 bp, Artificial Sequence
  Artificial sequence related to HLA knockouts in cell therapy
cgacgcggacccagttctca

SEQ ID NO: 18969 - DNA, 20 bp, Artificial Sequence
  Artificial sequence related to HLA knockouts in cell therapy
gacgcggacccagttctcac

SEQ ID NO: 18970 - DNA, 20 bp, Artificial Sequence
  Artificial sequence related to HLA knockouts in cell therapy
acgcggacccagttctcact

SEQ ID NO: 18971 - DNA, 20 bp, Artificial Sequence
  Artificial sequence related to HLA knockouts in cell therapy
cgcggacccagttctcactc

SEQ ID NO: 18972 - DNA, 20 bp, Artificial Sequence
  Artificial sequence related to HLA knockouts in cell therapy
gcggacccagttctcactcc

SEQ ID NO: 18973 - DNA, 20 bp, Artificial Sequence
  Artificial sequence related to HLA knockouts in cell therapy
cggacccagttctcactccc

SEQ ID NO: 18974 - DNA, 20 bp, Artificial Sequence
  Artificial sequence related to HLA knockouts in cell therapy
ggacccagttctcactccca

SEQ ID NO: 18975 - DNA, 20 bp, Artificial Sequence
  Artificial sequence related to HLA knockouts in cell therapy
ctcactcccattgggtgtcg

SEQ ID NO: 18976 - DNA, 20 bp, Artificial Sequence
  Artificial sequence related to HLA knockouts in cell therapy
tcactcccattgggtgtcgg

SEQ ID NO: 18977 - DNA, 20 bp, Artificial Sequence
  Artificial sequence related to HLA knockouts in cell therapy
cactcccattgggtgtcggg

SEQ ID NO: 18978 - DNA, 20 bp, Artificial Sequence
  Artificial sequence related to HLA knockouts in cell therapy
actcccattgggtgtcgggt

SEQ ID NO: 18979 - DNA, 20 bp, Artificial Sequence
  Artificial sequence related to HLA knockouts in cell therapy
ctcccattgggtgtcgggtt

SEQ ID NO: 18980 - DNA, 20 bp, Artificial Sequence
  Artificial sequence related to HLA knockouts in cell therapy
cccattgggtgtcgggtttc

SEQ ID NO: 18981 - DNA, 20 bp, Artificial Sequence
  Artificial sequence related to HLA knockouts in cell therapy
ccattgggtgtcgggtttcc

SEQ ID NO: 18982 - DNA, 20 bp, Artificial Sequence
  Artificial sequence related to HLA knockouts in cell therapy
tgggtgtcgggtttccagag

SEQ ID NO: 18983 - DNA, 20 bp, Artificial Sequence
  Artificial sequence related to HLA knockouts in cell therapy
gggtgtcgggtttccagaga

SEQ ID NO: 18984 - DNA, 20 bp, Artificial Sequence
  Artificial sequence related to HLA knockouts in cell therapy
gtcgggtttccagagaagcc

SEQ ID NO: 18985 - DNA, 20 bp, Artificial Sequence
  Artificial sequence related to HLA knockouts in cell therapy
agccaatcagtgtcgtcgcg

SEQ ID NO: 18986 - DNA, 20 bp, Artificial Sequence
  Artificial sequence related to HLA knockouts in cell therapy
gccaatcagtgtcgtcgcgg

SEQ ID NO: 18987 - DNA, 20 bp, Artificial Sequence
  Artificial sequence related to HLA knockouts in cell therapy
ccaatcagtgtcgtcgcggt

SEQ ID NO: 18988 - DNA, 20 bp, Artificial Sequence
  Artificial sequence related to HLA knockouts in cell therapy
caatcagtgtcgtcgcggtc

SEQ ID NO: 18989 - DNA, 20 bp, Artificial Sequence
  Artificial sequence related to HLA knockouts in cell therapy
aatcagtgtcgtcgcggtcg

SEQ ID NO: 18990 - DNA, 20 bp, Artificial Sequence
  Artificial sequence related to HLA knockouts in cell therapy
atcagtgtcgtcgcggtcgc

SEQ ID NO: 18991 - DNA, 20 bp, Artificial Sequence
  Artificial sequence related to HLA knockouts in cell therapy
tcagtgtcgtcgcggtcgcg

SEQ ID NO: 18992 - DNA, 20 bp, Artificial Sequence
  Artificial sequence related to HLA knockouts in cell therapy
cagtgtcgtcgcggtcgcgg

SEQ ID NO: 18993 - DNA, 20 bp, Artificial Sequence
  Artificial sequence related to HLA knockouts in cell therapy
agtgtcgtcgcggtcgcggt

SEQ ID NO: 18994 - DNA, 20 bp, Artificial Sequence
  Artificial sequence related to HLA knockouts in cell therapy
gtgtcgtcgcggtcgcggtt

SEQ ID NO: 18995 - DNA, 20 bp, Artificial Sequence
  Artificial sequence related to HLA knockouts in cell therapy
tgtcgtcgcggtcgcggttc

SEQ ID NO: 18996 - DNA, 20 bp, Artificial Sequence
  Artificial sequence related to HLA knockouts in cell therapy
gtcgtcgcggtcgcggttct

SEQ ID NO: 18997 - DNA, 20 bp, Artificial Sequence
  Artificial sequence related to HLA knockouts in cell therapy
tcgtcgcggtcgcggttcta

SEQ ID NO: 18998 - DNA, 20 bp, Artificial Sequence
  Artificial sequence related to HLA knockouts in cell therapy
cgtcgcggtcgcggttctaa

SEQ ID NO: 18999 - DNA, 20 bp, Artificial Sequence
  Artificial sequence related to HLA knockouts in cell therapy
gtcgcggtcgcggttctaaa

SEQ ID NO: 19000 - DNA, 20 bp, Artificial Sequence
  Artificial sequence related to HLA knockouts in cell therapy
tcgcggtcgcggttctaaag

SEQ ID NO: 19001 - DNA, 20 bp, Artificial Sequence
  Artificial sequence related to HLA knockouts in cell therapy
cgcggtcgcggttctaaagt

SEQ ID NO: 19002 - DNA, 20 bp, Artificial Sequence
  Artificial sequence related to HLA knockouts in cell therapy
gcggtcgcggttctaaagtc

SEQ ID NO: 19003 - DNA, 20 bp, Artificial Sequence
  Artificial sequence related to HLA knockouts in cell therapy
cggtcgcggttctaaagtcc

SEQ ID NO: 19004 - DNA, 20 bp, Artificial Sequence
  Artificial sequence related to HLA knockouts in cell therapy
ggtcgcggttctaaagtccg

SEQ ID NO: 19005 - DNA, 20 bp, Artificial Sequence
  Artificial sequence related to HLA knockouts in cell therapy
gtcgcggttctaaagtccgc

SEQ ID NO: 19006 - DNA, 20 bp, Artificial Sequence
  Artificial sequence related to HLA knockouts in cell therapy
cgcggttctaaagtccgcac

SEQ ID NO: 19007 - DNA, 20 bp, Artificial Sequence
  Artificial sequence related to HLA knockouts in cell therapy
gcggttctaaagtccgcacg

SEQ ID NO: 19008 - DNA, 20 bp, Artificial Sequence
  Artificial sequence related to HLA knockouts in cell therapy
cggttctaaagtccgcacgc

SEQ ID NO: 19009 - DNA, 20 bp, Artificial Sequence
  Artificial sequence related to HLA knockouts in cell therapy
tctaaagtccgcacgcaccc

SEQ ID NO: 19010 - DNA, 20 bp, Artificial Sequence
  Artificial sequence related to HLA knockouts in cell therapy
ctaaagtccgcacgcaccca

SEQ ID NO: 19011 - DNA, 20 bp, Artificial Sequence
  Artificial sequence related to HLA knockouts in cell therapy
taaagtccgcacgcacccac

SEQ ID NO: 19012 - DNA, 20 bp, Artificial Sequence
  Artificial sequence related to HLA knockouts in cell therapy
aaagtccgcacgcacccacc

SEQ ID NO: 19013 - DNA, 20 bp, Artificial Sequence
  Artificial sequence related to HLA knockouts in cell therapy
aagtccgcacgcacccaccg

SEQ ID NO: 19014 - DNA, 20 bp, Artificial Sequence
  Artificial sequence related to HLA knockouts in cell therapy
agtccgcacgcacccaccgg

SEQ ID NO: 19015 - DNA, 20 bp, Artificial Sequence
  Artificial sequence related to HLA knockouts in cell therapy
gtccgcacgcacccaccggg

SEQ ID NO: 19016 - DNA, 20 bp, Artificial Sequence
  Artificial sequence related to HLA knockouts in cell therapy
tccgcacgcacccaccggga

SEQ ID NO: 19017 - DNA, 20 bp, Artificial Sequence
  Artificial sequence related to HLA knockouts in cell therapy
ccgcacgcacccaccgggac

SEQ ID NO: 19018 - DNA, 20 bp, Artificial Sequence
  Artificial sequence related to HLA knockouts in cell therapy
cgcacgcacccaccgggact

SEQ ID NO: 19019 - DNA, 20 bp, Artificial Sequence
  Artificial sequence related to HLA knockouts in cell therapy
gcacgcacccaccgggactc

SEQ ID NO: 19020 - DNA, 20 bp, Artificial Sequence
  Artificial sequence related to HLA knockouts in cell therapy
cacgcacccaccgggactca

SEQ ID NO: 19021 - DNA, 20 bp, Artificial Sequence
  Artificial sequence related to HLA knockouts in cell therapy
acgcacccaccgggactcag

SEQ ID NO: 19022 - DNA, 20 bp, Artificial Sequence
  Artificial sequence related to HLA knockouts in cell therapy
cgcacccaccgggactcaga

SEQ ID NO: 19023 - DNA, 20 bp, Artificial Sequence
  Artificial sequence related to HLA knockouts in cell therapy
gcacccaccgggactcagat

SEQ ID NO: 19024 - DNA, 20 bp, Artificial Sequence
  Artificial sequence related to HLA knockouts in cell therapy
cacccaccgggactcagatt

SEQ ID NO: 19025 - DNA, 20 bp, Artificial Sequence
  Artificial sequence related to HLA knockouts in cell therapy
acccaccgggactcagattc

SEQ ID NO: 19026 - DNA, 20 bp, Artificial Sequence
  Artificial sequence related to HLA knockouts in cell therapy
cccaccgggactcagattct

SEQ ID NO: 19027 - DNA, 20 bp, Artificial Sequence
  Artificial sequence related to HLA knockouts in cell therapy
ccaccgggactcagattctc

SEQ ID NO: 19028 - DNA, 20 bp, Artificial Sequence
  Artificial sequence related to HLA knockouts in cell therapy
caccgggactcagattctcc

SEQ ID NO: 19029 - DNA, 20 bp, Artificial Sequence
  Artificial sequence related to HLA knockouts in cell therapy
accgggactcagattctccc

SEQ ID NO: 19030 - DNA, 20 bp, Artificial Sequence
  Artificial sequence related to HLA knockouts in cell therapy
ccgggactcagattctcccc

SEQ ID NO: 19031 - DNA, 20 bp, Artificial Sequence
  Artificial sequence related to HLA knockouts in cell therapy
cgggactcagattctcccca

SEQ ID NO: 19032 - DNA, 20 bp, Artificial Sequence
  Artificial sequence related to HLA knockouts in cell therapy
gggactcagattctccccag

SEQ ID NO: 19033 - DNA, 20 bp, Artificial Sequence
  Artificial sequence related to HLA knockouts in cell therapy
ctcagattctccccagacgc

SEQ ID NO: 19034 - DNA, 20 bp, Artificial Sequence
  Artificial sequence related to HLA knockouts in cell therapy
tcagattctccccagacgcc

SEQ ID NO: 19035 - DNA, 20 bp, Artificial Sequence
  Artificial sequence related to HLA knockouts in cell therapy
cagattctccccagacgccg

SEQ ID NO: 19036 - DNA, 20 bp, Artificial Sequence
  Artificial sequence related to HLA knockouts in cell therapy
agattctccccagacgccga

SEQ ID NO: 19037 - DNA, 20 bp, Artificial Sequence
  Artificial sequence related to HLA knockouts in cell therapy
gattctccccagacgccgag

SEQ ID NO: 19038 - DNA, 20 bp, Artificial Sequence
  Artificial sequence related to HLA knockouts in cell therapy
attctccccagacgccgagg

SEQ ID NO: 19039 - DNA, 20 bp, Artificial Sequence
  Artificial sequence related to HLA knockouts in cell therapy
ttctccccagacgccgagga

SEQ ID NO: 19040 - DNA, 20 bp, Artificial Sequence
  Artificial sequence related to HLA knockouts in cell therapy
tctccccagacgccgaggat

SEQ ID NO: 19041 - DNA, 20 bp, Artificial Sequence
  Artificial sequence related to HLA knockouts in cell therapy
ctccccagacgccgaggatg

SEQ ID NO: 19042 - DNA, 20 bp, Artificial Sequence
  Artificial sequence related to HLA knockouts in cell therapy
tccccagacgccgaggatgg

SEQ ID NO: 19043 - DNA, 20 bp, Artificial Sequence
  Artificial sequence related to HLA knockouts in cell therapy
ccccagacgccgaggatggc

SEQ ID NO: 19044 - DNA, 20 bp, Artificial Sequence
  Artificial sequence related to HLA knockouts in cell therapy
cccagacgccgaggatggcc

SEQ ID NO: 19045 - DNA, 20 bp, Artificial Sequence
  Artificial sequence related to HLA knockouts in cell therapy
ccagacgccgaggatggccg

SEQ ID NO: 19046 - DNA, 20 bp, Artificial Sequence
  Artificial sequence related to HLA knockouts in cell therapy
cagacgccgaggatggccgt

SEQ ID NO: 19047 - DNA, 20 bp, Artificial Sequence
  Artificial sequence related to HLA knockouts in cell therapy
agacgccgaggatggccgtc

SEQ ID NO: 19048 - DNA, 20 bp, Artificial Sequence
  Artificial sequence related to HLA knockouts in cell therapy
gacgccgaggatggccgtca

SEQ ID NO: 19049 - DNA, 20 bp, Artificial Sequence
  Artificial sequence related to HLA knockouts in cell therapy
acgccgaggatggccgtcat

SEQ ID NO: 19050 - DNA, 20 bp, Artificial Sequence
  Artificial sequence related to HLA knockouts in cell therapy
cgccgaggatggccgtcatg

SEQ ID NO: 19051 - DNA, 20 bp, Artificial Sequence
  Artificial sequence related to HLA knockouts in cell therapy
gccgaggatggccgtcatgg

SEQ ID NO: 19052 - DNA, 20 bp, Artificial Sequence
  Artificial sequence related to HLA knockouts in cell therapy
ccgaggatggccgtcatggc

SEQ ID NO: 19053 - DNA, 20 bp, Artificial Sequence
  Artificial sequence related to HLA knockouts in cell therapy
cgaggatggccgtcatggcg

SEQ ID NO: 19054 - DNA, 20 bp, Artificial Sequence
  Artificial sequence related to HLA knockouts in cell therapy
gaggatggccgtcatggcgc

SEQ ID NO: 19055 - DNA, 20 bp, Artificial Sequence
  Artificial sequence related to HLA knockouts in cell therapy
aggatggccgtcatggcgcc

SEQ ID NO: 19056 - DNA, 20 bp, Artificial Sequence
  Artificial sequence related to HLA knockouts in cell therapy
ggatggccgtcatggcgccc

SEQ ID NO: 19057 - DNA, 20 bp, Artificial Sequence
  Artificial sequence related to HLA knockouts in cell therapy
gatggccgtcatggcgcccc

SEQ ID NO: 19058 - DNA, 20 bp, Artificial Sequence
  Artificial sequence related to HLA knockouts in cell therapy
atggccgtcatggcgccccg

SEQ ID NO: 19059 - DNA, 20 bp, Artificial Sequence
  Artificial sequence related to HLA knockouts in cell therapy
tggccgtcatggcgccccga

SEQ ID NO: 19060 - DNA, 20 bp, Artificial Sequence
  Artificial sequence related to HLA knockouts in cell therapy
ggccgtcatggcgccccgaa

SEQ ID NO: 19061 - DNA, 20 bp, Artificial Sequence
  Artificial sequence related to HLA knockouts in cell therapy
gccgtcatggcgccccgaac

SEQ ID NO: 19062 - DNA, 20 bp, Artificial Sequence
  Artificial sequence related to HLA knockouts in cell therapy
ccgtcatggcgccccgaacc

SEQ ID NO: 19063 - DNA, 20 bp, Artificial Sequence
  Artificial sequence related to HLA knockouts in cell therapy
cgtcatggcgccccgaaccc

SEQ ID NO: 19064 - DNA, 20 bp, Artificial Sequence
  Artificial sequence related to HLA knockouts in cell therapy
gtcatggcgccccgaaccct

SEQ ID NO: 19065 - DNA, 20 bp, Artificial Sequence
  Artificial sequence related to HLA knockouts in cell therapy
tcatggcgccccgaaccctc

SEQ ID NO: 19066 - DNA, 20 bp, Artificial Sequence
  Artificial sequence related to HLA knockouts in cell therapy
catggcgccccgaaccctcg

SEQ ID NO: 19067 - DNA, 20 bp, Artificial Sequence
  Artificial sequence related to HLA knockouts in cell therapy
atggcgccccgaaccctcgt

SEQ ID NO: 19068 - DNA, 20 bp, Artificial Sequence
  Artificial sequence related to HLA knockouts in cell therapy
tggcgccccgaaccctcgtc

SEQ ID NO: 19069 - DNA, 20 bp, Artificial Sequence
  Artificial sequence related to HLA knockouts in cell therapy
ggcgccccgaaccctcgtcc

SEQ ID NO: 19070 - DNA, 20 bp, Artificial Sequence
  Artificial sequence related to HLA knockouts in cell therapy
gcgccccgaaccctcgtcct

SEQ ID NO: 19071 - DNA, 20 bp, Artificial Sequence
  Artificial sequence related to HLA knockouts in cell therapy
cgccccgaaccctcgtcctg

SEQ ID NO: 19072 - DNA, 20 bp, Artificial Sequence
  Artificial sequence related to HLA knockouts in cell therapy
gccccgaaccctcgtcctgc

SEQ ID NO: 19073 - DNA, 20 bp, Artificial Sequence
  Artificial sequence related to HLA knockouts in cell therapy
ccccgaaccctcgtcctgct

SEQ ID NO: 19074 - DNA, 20 bp, Artificial Sequence
  Artificial sequence related to HLA knockouts in cell therapy
cccgaaccctcgtcctgcta

SEQ ID NO: 19075 - DNA, 20 bp, Artificial Sequence
  Artificial sequence related to HLA knockouts in cell therapy
ccgaaccctcgtcctgctac

SEQ ID NO: 19076 - DNA, 20 bp, Artificial Sequence
  Artificial sequence related to HLA knockouts in cell therapy
cgaaccctcgtcctgctact

SEQ ID NO: 19077 - DNA, 20 bp, Artificial Sequence
  Artificial sequence related to HLA knockouts in cell therapy
gaaccctcgtcctgctactc

SEQ ID NO: 19078 - DNA, 20 bp, Artificial Sequence
  Artificial sequence related to HLA knockouts in cell therapy
accctcgtcctgctactctc

SEQ ID NO: 19079 - DNA, 20 bp, Artificial Sequence
  Artificial sequence related to HLA knockouts in cell therapy
ccctcgtcctgctactctcg

SEQ ID NO: 19080 - DNA, 20 bp, Artificial Sequence
  Artificial sequence related to HLA knockouts in cell therapy
cctcgtcctgctactctcgg

SEQ ID NO: 19081 - DNA, 20 bp, Artificial Sequence
  Artificial sequence related to HLA knockouts in cell therapy
ctcgtcctgctactctcggg

SEQ ID NO: 19082 - DNA, 20 bp, Artificial Sequence
  Artificial sequence related to HLA knockouts in cell therapy
tcgtcctgctactctcgggg

SEQ ID NO: 19083 - DNA, 20 bp, Artificial Sequence
  Artificial sequence related to HLA knockouts in cell therapy
cgtcctgctactctcggggg

SEQ ID NO: 19084 - DNA, 20 bp, Artificial Sequence
  Artificial sequence related to HLA knockouts in cell therapy
gtcctgctactctcgggggc

SEQ ID NO: 19085 - DNA, 20 bp, Artificial Sequence
  Artificial sequence related to HLA knockouts in cell therapy
tcctgctactctcgggggct

SEQ ID NO: 19086 - DNA, 20 bp, Artificial Sequence
  Artificial sequence related to HLA knockouts in cell therapy
cctgctactctcgggggctc

SEQ ID NO: 19087 - DNA, 20 bp, Artificial Sequence
  Artificial sequence related to HLA knockouts in cell therapy
ctgctactctcgggggctct

SEQ ID NO: 19088 - DNA, 20 bp, Artificial Sequence
  Artificial sequence related to HLA knockouts in cell therapy
tgctactctcgggggctctg

SEQ ID NO: 19089 - DNA, 20 bp, Artificial Sequence
  Artificial sequence related to HLA knockouts in cell therapy
gctactctcgggggctctgg

SEQ ID NO: 19090 - DNA, 20 bp, Artificial Sequence
  Artificial sequence related to HLA knockouts in cell therapy
ctactctcgggggctctggc

SEQ ID NO: 19091 - DNA, 20 bp, Artificial Sequence
  Artificial sequence related to HLA knockouts in cell therapy
tactctcgggggctctggcc

SEQ ID NO: 19092 - DNA, 20 bp, Artificial Sequence
  Artificial sequence related to HLA knockouts in cell therapy
actctcgggggctctggccc

SEQ ID NO: 19093 - DNA, 20 bp, Artificial Sequence
  Artificial sequence related to HLA knockouts in cell therapy
ctctcgggggctctggccct

SEQ ID NO: 19094 - DNA, 20 bp, Artificial Sequence
  Artificial sequence related to HLA knockouts in cell therapy
tctcgggggctctggccctg

SEQ ID NO: 19095 - DNA, 20 bp, Artificial Sequence
  Artificial sequence related to HLA knockouts in cell therapy
ctcgggggctctggccctga

SEQ ID NO: 19096 - DNA, 20 bp, Artificial Sequence
  Artificial sequence related to HLA knockouts in cell therapy
tcgggggctctggccctgac

SEQ ID NO: 19097 - DNA, 20 bp, Artificial Sequence
  Artificial sequence related to HLA knockouts in cell therapy
cgggggctctggccctgacc

SEQ ID NO: 19098 - DNA, 20 bp, Artificial Sequence
  Artificial sequence related to HLA knockouts in cell therapy
gggggctctggccctgaccc

SEQ ID NO: 19099 - DNA, 20 bp, Artificial Sequence
  Artificial sequence related to HLA knockouts in cell therapy
ggggctctggccctgaccca

SEQ ID NO: 19100 - DNA, 20 bp, Artificial Sequence
  Artificial sequence related to HLA knockouts in cell therapy
gggctctggccctgacccag

SEQ ID NO: 19101 - DNA, 20 bp, Artificial Sequence
  Artificial sequence related to HLA knockouts in cell therapy
ggctctggccctgacccaga

SEQ ID NO: 19102 - DNA, 20 bp, Artificial Sequence
  Artificial sequence related to HLA knockouts in cell therapy
gctctggccctgacccagac

SEQ ID NO: 19103 - DNA, 20 bp, Artificial Sequence
  Artificial sequence related to HLA knockouts in cell therapy
ctctggccctgacccagacc

SEQ ID NO: 19104 - DNA, 20 bp, Artificial Sequence
  Artificial sequence related to HLA knockouts in cell therapy
tctggccctgacccagacct

SEQ ID NO: 19105 - DNA, 20 bp, Artificial Sequence
  Artificial sequence related to HLA knockouts in cell therapy
ctggccctgacccagacctg

SEQ ID NO: 19106 - DNA, 20 bp, Artificial Sequence
  Artificial sequence related to HLA knockouts in cell therapy
tggccctgacccagacctgg

SEQ ID NO: 19107 - DNA, 20 bp, Artificial Sequence
  Artificial sequence related to HLA knockouts in cell therapy
ggccctgacccagacctggg

SEQ ID NO: 19108 - DNA, 20 bp, Artificial Sequence
  Artificial sequence related to HLA knockouts in cell therapy
gccctgacccagacctgggc

SEQ ID NO: 19109 - DNA, 20 bp, Artificial Sequence
  Artificial sequence related to HLA knockouts in cell therapy
ccctgacccagacctgggcg

SEQ ID NO: 19110 - DNA, 20 bp, Artificial Sequence
  Artificial sequence related to HLA knockouts in cell therapy
cctgacccagacctgggcgg

SEQ ID NO: 19111 - DNA, 20 bp, Artificial Sequence
  Artificial sequence related to HLA knockouts in cell therapy
ctgacccagacctgggcggg

SEQ ID NO: 19112 - DNA, 20 bp, Artificial Sequence
  Artificial sequence related to HLA knockouts in cell therapy
tgacccagacctgggcgggc

SEQ ID NO: 19113 - DNA, 20 bp, Artificial Sequence
  Artificial sequence related to HLA knockouts in cell therapy
gacccagacctgggcgggct

SEQ ID NO: 19114 - DNA, 20 bp, Artificial Sequence
  Artificial sequence related to HLA knockouts in cell therapy
acccagacctgggcgggctc

SEQ ID NO: 19115 - DNA, 20 bp, Artificial Sequence
  Artificial sequence related to HLA knockouts in cell therapy
cccagacctgggcgggctct

SEQ ID NO: 19116 - DNA, 20 bp, Artificial Sequence
  Artificial sequence related to HLA knockouts in cell therapy
ccagacctgggcgggctctc

SEQ ID NO: 19117 - DNA, 20 bp, Artificial Sequence
  Artificial sequence related to HLA knockouts in cell therapy
cagacctgggcgggctctca

SEQ ID NO: 19118 - DNA, 20 bp, Artificial Sequence
  Artificial sequence related to HLA knockouts in cell therapy
agacctgggcgggctctcac

SEQ ID NO: 19119 - DNA, 20 bp, Artificial Sequence
  Artificial sequence related to HLA knockouts in cell therapy
gacctgggcgggctctcact

SEQ ID NO: 19120 - DNA, 20 bp, Artificial Sequence
  Artificial sequence related to HLA knockouts in cell therapy
acctgggcgggctctcactc

SEQ ID NO: 19121 - DNA, 20 bp, Artificial Sequence
  Artificial sequence related to HLA knockouts in cell therapy
cctgggcgggctctcactcc

SEQ ID NO: 19122 - DNA, 20 bp, Artificial Sequence
  Artificial sequence related to HLA knockouts in cell therapy
ctgggcgggctctcactcca

SEQ ID NO: 19123 - DNA, 20 bp, Artificial Sequence
  Artificial sequence related to HLA knockouts in cell therapy
tgggcgggctctcactccat

SEQ ID NO: 19124 - DNA, 20 bp, Artificial Sequence
  Artificial sequence related to HLA knockouts in cell therapy
gggcgggctctcactccatg

SEQ ID NO: 19125 - DNA, 20 bp, Artificial Sequence
  Artificial sequence related to HLA knockouts in cell therapy
ggcgggctctcactccatga

SEQ ID NO: 19126 - DNA, 20 bp, Artificial Sequence
  Artificial sequence related to HLA knockouts in cell therapy
gcgggctctcactccatgag

SEQ ID NO: 19127 - DNA, 20 bp, Artificial Sequence
  Artificial sequence related to HLA knockouts in cell therapy
cgggctctcactccatgagg

SEQ ID NO: 19128 - DNA, 20 bp, Artificial Sequence
  Artificial sequence related to HLA knockouts in cell therapy
gggctctcactccatgaggt

SEQ ID NO: 19129 - DNA, 20 bp, Artificial Sequence
  Artificial sequence related to HLA knockouts in cell therapy
tcttcacatccgtgtcccgg

SEQ ID NO: 19130 - DNA, 20 bp, Artificial Sequence
  Artificial sequence related to HLA knockouts in cell therapy
cttcacatccgtgtcccggc

SEQ ID NO: 19131 - DNA, 20 bp, Artificial Sequence
  Artificial sequence related to HLA knockouts in cell therapy
ttcacatccgtgtcccggcc

SEQ ID NO: 19132 - DNA, 20 bp, Artificial Sequence
  Artificial sequence related to HLA knockouts in cell therapy
tcacatccgtgtcccggccc

SEQ ID NO: 19133 - DNA, 20 bp, Artificial Sequence
  Artificial sequence related to HLA knockouts in cell therapy
cacatccgtgtcccggcccg

SEQ ID NO: 19134 - DNA, 20 bp, Artificial Sequence
  Artificial sequence related to HLA knockouts in cell therapy
acatccgtgtcccggcccgg

SEQ ID NO: 19135 - DNA, 20 bp, Artificial Sequence
  Artificial sequence related to HLA knockouts in cell therapy
catccgtgtcccggcccggc

SEQ ID NO: 19136 - DNA, 20 bp, Artificial Sequence
  Artificial sequence related to HLA knockouts in cell therapy
atccgtgtcccggcccggcc

SEQ ID NO: 19137 - DNA, 20 bp, Artificial Sequence
  Artificial sequence related to HLA knockouts in cell therapy
tccgtgtcccggcccggccg

SEQ ID NO: 19138 - DNA, 20 bp, Artificial Sequence
  Artificial sequence related to HLA knockouts in cell therapy
ccgtgtcccggcccggccgc

SEQ ID NO: 19139 - DNA, 20 bp, Artificial Sequence
  Artificial sequence related to HLA knockouts in cell therapy
cgtgtcccggcccggccgcg

SEQ ID NO: 19140 - DNA, 20 bp, Artificial Sequence
  Artificial sequence related to HLA knockouts in cell therapy
gtgtcccggcccggccgcgg

SEQ ID NO: 19141 - DNA, 20 bp, Artificial Sequence
  Artificial sequence related to HLA knockouts in cell therapy
tgtcccggcccggccgcggg

SEQ ID NO: 19142 - DNA, 20 bp, Artificial Sequence
  Artificial sequence related to HLA knockouts in cell therapy
gtcccggcccggccgcgggg

SEQ ID NO: 19143 - DNA, 20 bp, Artificial Sequence
  Artificial sequence related to HLA knockouts in cell therapy
tcccggcccggccgcgggga

SEQ ID NO: 19144 - DNA, 20 bp, Artificial Sequence
  Artificial sequence related to HLA knockouts in cell therapy
cccggcccggccgcggggag

SEQ ID NO: 19145 - DNA, 20 bp, Artificial Sequence
  Artificial sequence related to HLA knockouts in cell therapy
ccggcccggccgcggggagc

SEQ ID NO: 19146 - DNA, 20 bp, Artificial Sequence
  Artificial sequence related to HLA knockouts in cell therapy
cggcccggccgcggggagcc

SEQ ID NO: 19147 - DNA, 20 bp, Artificial Sequence
  Artificial sequence related to HLA knockouts in cell therapy
ggcccggccgcggggagccc

SEQ ID NO: 19148 - DNA, 20 bp, Artificial Sequence
  Artificial sequence related to HLA knockouts in cell therapy
gcccggccgcggggagcccc

SEQ ID NO: 19149 - DNA, 20 bp, Artificial Sequence
  Artificial sequence related to HLA knockouts in cell therapy
cccggccgcggggagccccg

SEQ ID NO: 19150 - DNA, 20 bp, Artificial Sequence
  Artificial sequence related to HLA knockouts in cell therapy
ccggccgcggggagccccgc

SEQ ID NO: 19151 - DNA, 20 bp, Artificial Sequence
  Artificial sequence related to HLA knockouts in cell therapy
cggccgcggggagccccgct

SEQ ID NO: 19152 - DNA, 20 bp, Artificial Sequence
  Artificial sequence related to HLA knockouts in cell therapy
ggccgcggggagccccgctt

SEQ ID NO: 19153 - DNA, 20 bp, Artificial Sequence
  Artificial sequence related to HLA knockouts in cell therapy
gccgcggggagccccgcttc

SEQ ID NO: 19154 - DNA, 20 bp, Artificial Sequence
  Artificial sequence related to HLA knockouts in cell therapy
ccgcggggagccccgcttca

SEQ ID NO: 19155 - DNA, 20 bp, Artificial Sequence
  Artificial sequence related to HLA knockouts in cell therapy
cgcggggagccccgcttcat

SEQ ID NO: 19156 - DNA, 20 bp, Artificial Sequence
  Artificial sequence related to HLA knockouts in cell therapy
gcggggagccccgcttcatc

SEQ ID NO: 19157 - DNA, 20 bp, Artificial Sequence
  Artificial sequence related to HLA knockouts in cell therapy
cggggagccccgcttcatcg

SEQ ID NO: 19158 - DNA, 20 bp, Artificial Sequence
  Artificial sequence related to HLA knockouts in cell therapy
ggggagccccgcttcatcgc

SEQ ID NO: 19159 - DNA, 20 bp, Artificial Sequence
  Artificial sequence related to HLA knockouts in cell therapy
gggagccccgcttcatcgca

SEQ ID NO: 19160 - DNA, 20 bp, Artificial Sequence
  Artificial sequence related to HLA knockouts in cell therapy
ggagccccgcttcatcgcag

SEQ ID NO: 19161 - DNA, 20 bp, Artificial Sequence
  Artificial sequence related to HLA knockouts in cell therapy
gagccccgcttcatcgcagt

SEQ ID NO: 19162 - DNA, 20 bp, Artificial Sequence
  Artificial sequence related to HLA knockouts in cell therapy
agccccgcttcatcgcagtg

SEQ ID NO: 19163 - DNA, 20 bp, Artificial Sequence
  Artificial sequence related to HLA knockouts in cell therapy
gccccgcttcatcgcagtgg

SEQ ID NO: 19164 - DNA, 20 bp, Artificial Sequence
  Artificial sequence related to HLA knockouts in cell therapy
ccccgcttcatcgcagtggg

SEQ ID NO: 19165 - DNA, 20 bp, Artificial Sequence
  Artificial sequence related to HLA knockouts in cell therapy
cccgcttcatcgcagtgggc

SEQ ID NO: 19166 - DNA, 20 bp, Artificial Sequence
  Artificial sequence related to HLA knockouts in cell therapy
ccgcttcatcgcagtgggct

SEQ ID NO: 19167 - DNA, 20 bp, Artificial Sequence
  Artificial sequence related to HLA knockouts in cell therapy
cgcttcatcgcagtgggcta

SEQ ID NO: 19168 - DNA, 20 bp, Artificial Sequence
  Artificial sequence related to HLA knockouts in cell therapy
gcttcatcgcagtgggctac

SEQ ID NO: 19169 - DNA, 20 bp, Artificial Sequence
  Artificial sequence related to HLA knockouts in cell therapy
cttcatcgcagtgggctacg

SEQ ID NO: 19170 - DNA, 20 bp, Artificial Sequence
  Artificial sequence related to HLA knockouts in cell therapy
tcatcgcagtgggctacgtg

SEQ ID NO: 19171 - DNA, 20 bp, Artificial Sequence
  Artificial sequence related to HLA knockouts in cell therapy
catcgcagtgggctacgtgg

SEQ ID NO: 19172 - DNA, 20 bp, Artificial Sequence
  Artificial sequence related to HLA knockouts in cell therapy
atcgcagtgggctacgtgga

SEQ ID NO: 19173 - DNA, 20 bp, Artificial Sequence
  Artificial sequence related to HLA knockouts in cell therapy
tcgcagtgggctacgtggac

SEQ ID NO: 19174 - DNA, 20 bp, Artificial Sequence
  Artificial sequence related to HLA knockouts in cell therapy
cgcagtgggctacgtggacg

SEQ ID NO: 19175 - DNA, 20 bp, Artificial Sequence
  Artificial sequence related to HLA knockouts in cell therapy
gcagtgggctacgtggacga

SEQ ID NO: 19176 - DNA, 20 bp, Artificial Sequence
  Artificial sequence related to HLA knockouts in cell therapy
cagtgggctacgtggacgac

SEQ ID NO: 19177 - DNA, 20 bp, Artificial Sequence
  Artificial sequence related to HLA knockouts in cell therapy
agtgggctacgtggacgaca

SEQ ID NO: 19178 - DNA, 20 bp, Artificial Sequence
  Artificial sequence related to HLA knockouts in cell therapy
gtgggctacgtggacgacac

SEQ ID NO: 19179 - DNA, 20 bp, Artificial Sequence
  Artificial sequence related to HLA knockouts in cell therapy
tgggctacgtggacgacacg

SEQ ID NO: 19180 - DNA, 20 bp, Artificial Sequence
  Artificial sequence related to HLA knockouts in cell therapy
gggctacgtggacgacacgc

SEQ ID NO: 19181 - DNA, 20 bp, Artificial Sequence
  Artificial sequence related to HLA knockouts in cell therapy
ggctacgtggacgacacgca

SEQ ID NO: 19182 - DNA, 20 bp, Artificial Sequence
  Artificial sequence related to HLA knockouts in cell therapy
gctacgtggacgacacgcag

SEQ ID NO: 19183 - DNA, 20 bp, Artificial Sequence
  Artificial sequence related to HLA knockouts in cell therapy
ctacgtggacgacacgcagt

SEQ ID NO: 19184 - DNA, 20 bp, Artificial Sequence
  Artificial sequence related to HLA knockouts in cell therapy
acgtggacgacacgcagttc

SEQ ID NO: 19185 - DNA, 20 bp, Artificial Sequence
  Artificial sequence related to HLA knockouts in cell therapy
cgtggacgacacgcagttcg

SEQ ID NO: 19186 - DNA, 20 bp, Artificial Sequence
  Artificial sequence related to HLA knockouts in cell therapy
gtggacgacacgcagttcgt

SEQ ID NO: 19187 - DNA, 20 bp, Artificial Sequence
  Artificial sequence related to HLA knockouts in cell therapy
tggacgacacgcagttcgtg

SEQ ID NO: 19188 - DNA, 20 bp, Artificial Sequence
  Artificial sequence related to HLA knockouts in cell therapy
ggacgacacgcagttcgtgc

SEQ ID NO: 19189 - DNA, 20 bp, Artificial Sequence
  Artificial sequence related to HLA knockouts in cell therapy
gacgacacgcagttcgtgcg

SEQ ID NO: 19190 - DNA, 20 bp, Artificial Sequence
  Artificial sequence related to HLA knockouts in cell therapy
acgacacgcagttcgtgcgg

SEQ ID NO: 19191 - DNA, 20 bp, Artificial Sequence
  Artificial sequence related to HLA knockouts in cell therapy
cgacacgcagttcgtgcggt

SEQ ID NO: 19192 - DNA, 20 bp, Artificial Sequence
  Artificial sequence related to HLA knockouts in cell therapy
gacacgcagttcgtgcggtt

SEQ ID NO: 19193 - DNA, 20 bp, Artificial Sequence
  Artificial sequence related to HLA knockouts in cell therapy
acacgcagttcgtgcggttc

SEQ ID NO: 19194 - DNA, 20 bp, Artificial Sequence
  Artificial sequence related to HLA knockouts in cell therapy
cacgcagttcgtgcggttcg

SEQ ID NO: 19195 - DNA, 20 bp, Artificial Sequence
  Artificial sequence related to HLA knockouts in cell therapy
acgcagttcgtgcggttcga

SEQ ID NO: 19196 - DNA, 20 bp, Artificial Sequence
  Artificial sequence related to HLA knockouts in cell therapy
cgcagttcgtgcggttcgac

SEQ ID NO: 19197 - DNA, 20 bp, Artificial Sequence
  Artificial sequence related to HLA knockouts in cell therapy
gcagttcgtgcggttcgaca

SEQ ID NO: 19198 - DNA, 20 bp, Artificial Sequence
  Artificial sequence related to HLA knockouts in cell therapy
cagttcgtgcggttcgacag

SEQ ID NO: 19199 - DNA, 20 bp, Artificial Sequence
  Artificial sequence related to HLA knockouts in cell therapy
agttcgtgcggttcgacagc

SEQ ID NO: 19200 - DNA, 20 bp, Artificial Sequence
  Artificial sequence related to HLA knockouts in cell therapy
gttcgtgcggttcgacagcg

SEQ ID NO: 19201 - DNA, 20 bp, Artificial Sequence
  Artificial sequence related to HLA knockouts in cell therapy
ttcgtgcggttcgacagcga

SEQ ID NO: 19202 - DNA, 20 bp, Artificial Sequence
  Artificial sequence related to HLA knockouts in cell therapy
tcgtgcggttcgacagcgac

SEQ ID NO: 19203 - DNA, 20 bp, Artificial Sequence
  Artificial sequence related to HLA knockouts in cell therapy
cgtgcggttcgacagcgacg

SEQ ID NO: 19204 - DNA, 20 bp, Artificial Sequence
  Artificial sequence related to HLA knockouts in cell therapy
gtgcggttcgacagcgacgc

SEQ ID NO: 19205 - DNA, 20 bp, Artificial Sequence
  Artificial sequence related to HLA knockouts in cell therapy
tgcggttcgacagcgacgcc

SEQ ID NO: 19206 - DNA, 20 bp, Artificial Sequence
  Artificial sequence related to HLA knockouts in cell therapy
gcggttcgacagcgacgccg

SEQ ID NO: 19207 - DNA, 20 bp, Artificial Sequence
  Artificial sequence related to HLA knockouts in cell therapy
cggttcgacagcgacgccgc

SEQ ID NO: 19208 - DNA, 20 bp, Artificial Sequence
  Artificial sequence related to HLA knockouts in cell therapy
ggttcgacagcgacgccgcg

SEQ ID NO: 19209 - DNA, 20 bp, Artificial Sequence
  Artificial sequence related to HLA knockouts in cell therapy
gttcgacagcgacgccgcga

SEQ ID NO: 19210 - DNA, 20 bp, Artificial Sequence
  Artificial sequence related to HLA knockouts in cell therapy
ttcgacagcgacgccgcgag

SEQ ID NO: 19211 - DNA, 20 bp, Artificial Sequence
  Artificial sequence related to HLA knockouts in cell therapy
tcgacagcgacgccgcgagc

SEQ ID NO: 19212 - DNA, 20 bp, Artificial Sequence
  Artificial sequence related to HLA knockouts in cell therapy
cgacagcgacgccgcgagcc

SEQ ID NO: 19213 - DNA, 20 bp, Artificial Sequence
  Artificial sequence related to HLA knockouts in cell therapy
gacagcgacgccgcgagcca

SEQ ID NO: 19214 - DNA, 20 bp, Artificial Sequence
  Artificial sequence related to HLA knockouts in cell therapy
acagcgacgccgcgagccag

SEQ ID NO: 19215 - DNA, 20 bp, Artificial Sequence
  Artificial sequence related to HLA knockouts in cell therapy
cagcgacgccgcgagccaga

SEQ ID NO: 19216 - DNA, 20 bp, Artificial Sequence
  Artificial sequence related to HLA knockouts in cell therapy
agcgacgccgcgagccagag

SEQ ID NO: 19217 - DNA, 20 bp, Artificial Sequence
  Artificial sequence related to HLA knockouts in cell therapy
gcgacgccgcgagccagagg

SEQ ID NO: 19218 - DNA, 20 bp, Artificial Sequence
  Artificial sequence related to HLA knockouts in cell therapy
cgacgccgcgagccagagga

SEQ ID NO: 19219 - DNA, 20 bp, Artificial Sequence
  Artificial sequence related to HLA knockouts in cell therapy
gacgccgcgagccagaggat

SEQ ID NO: 19220 - DNA, 20 bp, Artificial Sequence
  Artificial sequence related to HLA knockouts in cell therapy
acgccgcgagccagaggatg

SEQ ID NO: 19221 - DNA, 20 bp, Artificial Sequence
  Artificial sequence related to HLA knockouts in cell therapy
cgccgcgagccagaggatgg

SEQ ID NO: 19222 - DNA, 20 bp, Artificial Sequence
  Artificial sequence related to HLA knockouts in cell therapy
gccgcgagccagaggatgga

SEQ ID NO: 19223 - DNA, 20 bp, Artificial Sequence
  Artificial sequence related to HLA knockouts in cell therapy
ccgcgagccagaggatggag

SEQ ID NO: 19224 - DNA, 20 bp, Artificial Sequence
  Artificial sequence related to HLA knockouts in cell therapy
cgcgagccagaggatggagc

SEQ ID NO: 19225 - DNA, 20 bp, Artificial Sequence
  Artificial sequence related to HLA knockouts in cell therapy
gcgagccagaggatggagcc

SEQ ID NO: 19226 - DNA, 20 bp, Artificial Sequence
  Artificial sequence related to HLA knockouts in cell therapy
cgagccagaggatggagccg

SEQ ID NO: 19227 - DNA, 20 bp, Artificial Sequence
  Artificial sequence related to HLA knockouts in cell therapy
gagccagaggatggagccgc

SEQ ID NO: 19228 - DNA, 20 bp, Artificial Sequence
  Artificial sequence related to HLA knockouts in cell therapy
agccagaggatggagccgcg

SEQ ID NO: 19229 - DNA, 20 bp, Artificial Sequence
  Artificial sequence related to HLA knockouts in cell therapy
gccagaggatggagccgcgg

SEQ ID NO: 19230 - DNA, 20 bp, Artificial Sequence
  Artificial sequence related to HLA knockouts in cell therapy
ccagaggatggagccgcggg

SEQ ID NO: 19231 - DNA, 20 bp, Artificial Sequence
  Artificial sequence related to HLA knockouts in cell therapy
cagaggatggagccgcgggc

SEQ ID NO: 19232 - DNA, 20 bp, Artificial Sequence
  Artificial sequence related to HLA knockouts in cell therapy
agaggatggagccgcgggcg

SEQ ID NO: 19233 - DNA, 20 bp, Artificial Sequence
  Artificial sequence related to HLA knockouts in cell therapy
gaggatggagccgcgggcgc

SEQ ID NO: 19234 - DNA, 20 bp, Artificial Sequence
  Artificial sequence related to HLA knockouts in cell therapy
aggatggagccgcgggcgcc

SEQ ID NO: 19235 - DNA, 20 bp, Artificial Sequence
  Artificial sequence related to HLA knockouts in cell therapy
ggatggagccgcgggcgccg

SEQ ID NO: 19236 - DNA, 20 bp, Artificial Sequence
  Artificial sequence related to HLA knockouts in cell therapy
gatggagccgcgggcgccgt

SEQ ID NO: 19237 - DNA, 20 bp, Artificial Sequence
  Artificial sequence related to HLA knockouts in cell therapy
atggagccgcgggcgccgtg

SEQ ID NO: 19238 - DNA, 20 bp, Artificial Sequence
  Artificial sequence related to HLA knockouts in cell therapy
tggagccgcgggcgccgtgg

SEQ ID NO: 19239 - DNA, 20 bp, Artificial Sequence
  Artificial sequence related to HLA knockouts in cell therapy
ggagccgcgggcgccgtgga

SEQ ID NO: 19240 - DNA, 20 bp, Artificial Sequence
  Artificial sequence related to HLA knockouts in cell therapy
gagccgcgggcgccgtggat

SEQ ID NO: 19241 - DNA, 20 bp, Artificial Sequence
  Artificial sequence related to HLA knockouts in cell therapy
agccgcgggcgccgtggata

SEQ ID NO: 19242 - DNA, 20 bp, Artificial Sequence
  Artificial sequence related to HLA knockouts in cell therapy
gccgcgggcgccgtggatag

SEQ ID NO: 19243 - DNA, 20 bp, Artificial Sequence
  Artificial sequence related to HLA knockouts in cell therapy
ccgcgggcgccgtggataga

SEQ ID NO: 19244 - DNA, 20 bp, Artificial Sequence
  Artificial sequence related to HLA knockouts in cell therapy
cgcgggcgccgtggatagag

SEQ ID NO: 19245 - DNA, 20 bp, Artificial Sequence
  Artificial sequence related to HLA knockouts in cell therapy
gcgggcgccgtggatagagc

SEQ ID NO: 19246 - DNA, 20 bp, Artificial Sequence
  Artificial sequence related to HLA knockouts in cell therapy
cgggcgccgtggatagagca

SEQ ID NO: 19247 - DNA, 20 bp, Artificial Sequence
  Artificial sequence related to HLA knockouts in cell therapy
gggcgccgtggatagagcag

SEQ ID NO: 19248 - DNA, 20 bp, Artificial Sequence
  Artificial sequence related to HLA knockouts in cell therapy
ggcgccgtggatagagcagg

SEQ ID NO: 19249 - DNA, 20 bp, Artificial Sequence
  Artificial sequence related to HLA knockouts in cell therapy
gcgccgtggatagagcagga

SEQ ID NO: 19250 - DNA, 20 bp, Artificial Sequence
  Artificial sequence related to HLA knockouts in cell therapy
cgccgtggatagagcaggag

SEQ ID NO: 19251 - DNA, 20 bp, Artificial Sequence
  Artificial sequence related to HLA knockouts in cell therapy
gccgtggatagagcaggagg

SEQ ID NO: 19252 - DNA, 20 bp, Artificial Sequence
  Artificial sequence related to HLA knockouts in cell therapy
ccgtggatagagcaggaggg

SEQ ID NO: 19253 - DNA, 20 bp, Artificial Sequence
  Artificial sequence related to HLA knockouts in cell therapy
cgtggatagagcaggagggt

SEQ ID NO: 19254 - DNA, 20 bp, Artificial Sequence
  Artificial sequence related to HLA knockouts in cell therapy
gtggatagagcaggagggtc

SEQ ID NO: 19255 - DNA, 20 bp, Artificial Sequence
  Artificial sequence related to HLA knockouts in cell therapy
tggatagagcaggagggtcc

SEQ ID NO: 19256 - DNA, 20 bp, Artificial Sequence
  Artificial sequence related to HLA knockouts in cell therapy
ggatagagcaggagggtccg

SEQ ID NO: 19257 - DNA, 20 bp, Artificial Sequence
  Artificial sequence related to HLA knockouts in cell therapy
gatagagcaggagggtccgg

SEQ ID NO: 19258 - DNA, 20 bp, Artificial Sequence
  Artificial sequence related to HLA knockouts in cell therapy
atagagcaggagggtccgga

SEQ ID NO: 19259 - DNA, 20 bp, Artificial Sequence
  Artificial sequence related to HLA knockouts in cell therapy
tagagcaggagggtccggag

SEQ ID NO: 19260 - DNA, 20 bp, Artificial Sequence
  Artificial sequence related to HLA knockouts in cell therapy
agagcaggagggtccggagt

SEQ ID NO: 19261 - DNA, 20 bp, Artificial Sequence
  Artificial sequence related to HLA knockouts in cell therapy
gagcaggagggtccggagta

SEQ ID NO: 19262 - DNA, 20 bp, Artificial Sequence
  Artificial sequence related to HLA knockouts in cell therapy
agcaggagggtccggagtat

SEQ ID NO: 19263 - DNA, 20 bp, Artificial Sequence
  Artificial sequence related to HLA knockouts in cell therapy
caggagggtccggagtattg

SEQ ID NO: 19264 - DNA, 20 bp, Artificial Sequence
  Artificial sequence related to HLA knockouts in cell therapy
aggagggtccggagtattgg

SEQ ID NO: 19265 - DNA, 20 bp, Artificial Sequence
  Artificial sequence related to HLA knockouts in cell therapy
ggagggtccggagtattggg

SEQ ID NO: 19266 - DNA, 20 bp, Artificial Sequence
  Artificial sequence related to HLA knockouts in cell therapy
gagggtccggagtattggga

SEQ ID NO: 19267 - DNA, 20 bp, Artificial Sequence
  Artificial sequence related to HLA knockouts in cell therapy
agggtccggagtattgggac

SEQ ID NO: 19268 - DNA, 20 bp, Artificial Sequence
  Artificial sequence related to HLA knockouts in cell therapy
gggtccggagtattgggacg

SEQ ID NO: 19269 - DNA, 20 bp, Artificial Sequence
  Artificial sequence related to HLA knockouts in cell therapy
ggtccggagtattgggacgg

SEQ ID NO: 19270 - DNA, 20 bp, Artificial Sequence
  Artificial sequence related to HLA knockouts in cell therapy
gtccggagtattgggacggg

SEQ ID NO: 19271 - DNA, 20 bp, Artificial Sequence
  Artificial sequence related to HLA knockouts in cell therapy
tccggagtattgggacgggg

SEQ ID NO: 19272 - DNA, 20 bp, Artificial Sequence
  Artificial sequence related to HLA knockouts in cell therapy
ccggagtattgggacgggga

SEQ ID NO: 19273 - DNA, 20 bp, Artificial Sequence
  Artificial sequence related to HLA knockouts in cell therapy
cggagtattgggacggggag

SEQ ID NO: 19274 - DNA, 20 bp, Artificial Sequence
  Artificial sequence related to HLA knockouts in cell therapy
ggagtattgggacggggaga

SEQ ID NO: 19275 - DNA, 20 bp, Artificial Sequence
  Artificial sequence related to HLA knockouts in cell therapy
gagtattgggacggggagac

SEQ ID NO: 19276 - DNA, 20 bp, Artificial Sequence
  Artificial sequence related to HLA knockouts in cell therapy
gtattgggacggggagacac

SEQ ID NO: 19277 - DNA, 20 bp, Artificial Sequence
  Artificial sequence related to HLA knockouts in cell therapy
tattgggacggggagacacg

SEQ ID NO: 19278 - DNA, 20 bp, Artificial Sequence
  Artificial sequence related to HLA knockouts in cell therapy
attgggacggggagacacgg

SEQ ID NO: 19279 - DNA, 20 bp, Artificial Sequence
  Artificial sequence related to HLA knockouts in cell therapy
ttgggacggggagacacgga

SEQ ID NO: 19280 - DNA, 20 bp, Artificial Sequence
  Artificial sequence related to HLA knockouts in cell therapy
tgggacggggagacacggaa

SEQ ID NO: 19281 - DNA, 20 bp, Artificial Sequence
  Artificial sequence related to HLA knockouts in cell therapy
gggacggggagacacggaaa

SEQ ID NO: 19282 - DNA, 20 bp, Artificial Sequence
  Artificial sequence related to HLA knockouts in cell therapy
gacggggagacacggaaagt

SEQ ID NO: 19283 - DNA, 20 bp, Artificial Sequence
  Artificial sequence related to HLA knockouts in cell therapy
acggggagacacggaaagtg

SEQ ID NO: 19284 - DNA, 20 bp, Artificial Sequence
  Artificial sequence related to HLA knockouts in cell therapy
cggggagacacggaaagtga

SEQ ID NO: 19285 - DNA, 20 bp, Artificial Sequence
  Artificial sequence related to HLA knockouts in cell therapy
gacacggaaagtgaaggccc

SEQ ID NO: 19286 - DNA, 20 bp, Artificial Sequence
  Artificial sequence related to HLA knockouts in cell therapy
cacggaaagtgaaggcccac

SEQ ID NO: 19287 - DNA, 20 bp, Artificial Sequence
  Artificial sequence related to HLA knockouts in cell therapy
cggaaagtgaaggcccactc

SEQ ID NO: 19288 - DNA, 20 bp, Artificial Sequence
  Artificial sequence related to HLA knockouts in cell therapy
gtgaaggcccactcacagac

SEQ ID NO: 19289 - DNA, 20 bp, Artificial Sequence
  Artificial sequence related to HLA knockouts in cell therapy
gaaggcccactcacagactc

SEQ ID NO: 19290 - DNA, 20 bp, Artificial Sequence
  Artificial sequence related to HLA knockouts in cell therapy
aggcccactcacagactcac

SEQ ID NO: 19291 - DNA, 20 bp, Artificial Sequence
  Artificial sequence related to HLA knockouts in cell therapy
ggcccactcacagactcacc

SEQ ID NO: 19292 - DNA, 20 bp, Artificial Sequence
  Artificial sequence related to HLA knockouts in cell therapy
gcccactcacagactcaccg

SEQ ID NO: 19293 - DNA, 20 bp, Artificial Sequence
  Artificial sequence related to HLA knockouts in cell therapy
cccactcacagactcaccga

SEQ ID NO: 19294 - DNA, 20 bp, Artificial Sequence
  Artificial sequence related to HLA knockouts in cell therapy
ccactcacagactcaccgag

SEQ ID NO: 19295 - DNA, 20 bp, Artificial Sequence
  Artificial sequence related to HLA knockouts in cell therapy
ctcacagactcaccgagtgg

SEQ ID NO: 19296 - DNA, 20 bp, Artificial Sequence
  Artificial sequence related to HLA knockouts in cell therapy
cacagactcaccgagtggac

SEQ ID NO: 19297 - DNA, 20 bp, Artificial Sequence
  Artificial sequence related to HLA knockouts in cell therapy
acagactcaccgagtggacc

SEQ ID NO: 19298 - DNA, 20 bp, Artificial Sequence
  Artificial sequence related to HLA knockouts in cell therapy
cagactcaccgagtggacct

SEQ ID NO: 19299 - DNA, 20 bp, Artificial Sequence
  Artificial sequence related to HLA knockouts in cell therapy
agactcaccgagtggacctg

SEQ ID NO: 19300 - DNA, 20 bp, Artificial Sequence
  Artificial sequence related to HLA knockouts in cell therapy
gactcaccgagtggacctgg

SEQ ID NO: 19301 - DNA, 20 bp, Artificial Sequence
  Artificial sequence related to HLA knockouts in cell therapy
actcaccgagtggacctggg

SEQ ID NO: 19302 - DNA, 20 bp, Artificial Sequence
  Artificial sequence related to HLA knockouts in cell therapy
ctcaccgagtggacctgggg

SEQ ID NO: 19303 - DNA, 20 bp, Artificial Sequence
  Artificial sequence related to HLA knockouts in cell therapy
tcaccgagtggacctgggga

SEQ ID NO: 19304 - DNA, 20 bp, Artificial Sequence
  Artificial sequence related to HLA knockouts in cell therapy
caccgagtggacctggggac

SEQ ID NO: 19305 - DNA, 20 bp, Artificial Sequence
  Artificial sequence related to HLA knockouts in cell therapy
accgagtggacctggggacc

SEQ ID NO: 19306 - DNA, 20 bp, Artificial Sequence
  Artificial sequence related to HLA knockouts in cell therapy
ccgagtggacctggggaccc

SEQ ID NO: 19307 - DNA, 20 bp, Artificial Sequence
  Artificial sequence related to HLA knockouts in cell therapy
cgagtggacctggggaccct

SEQ ID NO: 19308 - DNA, 20 bp, Artificial Sequence
  Artificial sequence related to HLA knockouts in cell therapy
gagtggacctggggaccctg

SEQ ID NO: 19309 - DNA, 20 bp, Artificial Sequence
  Artificial sequence related to HLA knockouts in cell therapy
agtggacctggggaccctgc

SEQ ID NO: 19310 - DNA, 20 bp, Artificial Sequence
  Artificial sequence related to HLA knockouts in cell therapy
gtggacctggggaccctgcg

SEQ ID NO: 19311 - DNA, 20 bp, Artificial Sequence
  Artificial sequence related to HLA knockouts in cell therapy
tggacctggggaccctgcgc

SEQ ID NO: 19312 - DNA, 20 bp, Artificial Sequence
  Artificial sequence related to HLA knockouts in cell therapy
ggacctggggaccctgcgcg

SEQ ID NO: 19313 - DNA, 20 bp, Artificial Sequence
  Artificial sequence related to HLA knockouts in cell therapy
gacctggggaccctgcgcgg

SEQ ID NO: 19314 - DNA, 20 bp, Artificial Sequence
  Artificial sequence related to HLA knockouts in cell therapy
acctggggaccctgcgcggc

SEQ ID NO: 19315 - DNA, 20 bp, Artificial Sequence
  Artificial sequence related to HLA knockouts in cell therapy
cctggggaccctgcgcggct

SEQ ID NO: 19316 - DNA, 20 bp, Artificial Sequence
  Artificial sequence related to HLA knockouts in cell therapy
ctggggaccctgcgcggcta

SEQ ID NO: 19317 - DNA, 20 bp, Artificial Sequence
  Artificial sequence related to HLA knockouts in cell therapy
tggggaccctgcgcggctac

SEQ ID NO: 19318 - DNA, 20 bp, Artificial Sequence
  Artificial sequence related to HLA knockouts in cell therapy
ggggaccctgcgcggctact

SEQ ID NO: 19319 - DNA, 20 bp, Artificial Sequence
  Artificial sequence related to HLA knockouts in cell therapy
gggaccctgcgcggctacta

SEQ ID NO: 19320 - DNA, 20 bp, Artificial Sequence
  Artificial sequence related to HLA knockouts in cell therapy
ggaccctgcgcggctactac

SEQ ID NO: 19321 - DNA, 20 bp, Artificial Sequence
  Artificial sequence related to HLA knockouts in cell therapy
gaccctgcgcggctactaca

SEQ ID NO: 19322 - DNA, 20 bp, Artificial Sequence
  Artificial sequence related to HLA knockouts in cell therapy
accctgcgcggctactacaa

SEQ ID NO: 19323 - DNA, 20 bp, Artificial Sequence
  Artificial sequence related to HLA knockouts in cell therapy
ccctgcgcggctactacaac

SEQ ID NO: 19324 - DNA, 20 bp, Artificial Sequence
  Artificial sequence related to HLA knockouts in cell therapy
cctgcgcggctactacaacc

SEQ ID NO: 19325 - DNA, 20 bp, Artificial Sequence
  Artificial sequence related to HLA knockouts in cell therapy
ctgcgcggctactacaacca

SEQ ID NO: 19326 - DNA, 20 bp, Artificial Sequence
  Artificial sequence related to HLA knockouts in cell therapy
tgcgcggctactacaaccag

SEQ ID NO: 19327 - DNA, 20 bp, Artificial Sequence
  Artificial sequence related to HLA knockouts in cell therapy
gcgcggctactacaaccaga

SEQ ID NO: 19328 - DNA, 20 bp, Artificial Sequence
  Artificial sequence related to HLA knockouts in cell therapy
cgcggctactacaaccagag

SEQ ID NO: 19329 - DNA, 20 bp, Artificial Sequence
  Artificial sequence related to HLA knockouts in cell therapy
gcggctactacaaccagagc

SEQ ID NO: 19330 - DNA, 20 bp, Artificial Sequence
  Artificial sequence related to HLA knockouts in cell therapy
cggctactacaaccagagcg

SEQ ID NO: 19331 - DNA, 20 bp, Artificial Sequence
  Artificial sequence related to HLA knockouts in cell therapy
actacaaccagagcgaggcc

SEQ ID NO: 19332 - DNA, 20 bp, Artificial Sequence
  Artificial sequence related to HLA knockouts in cell therapy
ctacaaccagagcgaggccg

SEQ ID NO: 19333 - DNA, 20 bp, Artificial Sequence
  Artificial sequence related to HLA knockouts in cell therapy
tacaaccagagcgaggccgg

SEQ ID NO: 19334 - DNA, 20 bp, Artificial Sequence
  Artificial sequence related to HLA knockouts in cell therapy
acaaccagagcgaggccggt

SEQ ID NO: 19335 - DNA, 20 bp, Artificial Sequence
  Artificial sequence related to HLA knockouts in cell therapy
caaccagagcgaggccggtt

SEQ ID NO: 19336 - DNA, 20 bp, Artificial Sequence
  Artificial sequence related to HLA knockouts in cell therapy
aaccagagcgaggccggttc

SEQ ID NO: 19337 - DNA, 20 bp, Artificial Sequence
  Artificial sequence related to HLA knockouts in cell therapy
accagagcgaggccggttct

SEQ ID NO: 19338 - DNA, 20 bp, Artificial Sequence
  Artificial sequence related to HLA knockouts in cell therapy
ccagagcgaggccggttctc

SEQ ID NO: 19339 - DNA, 20 bp, Artificial Sequence
  Artificial sequence related to HLA knockouts in cell therapy
cagagcgaggccggttctca

SEQ ID NO: 19340 - DNA, 20 bp, Artificial Sequence
  Artificial sequence related to HLA knockouts in cell therapy
agagcgaggccggttctcac

SEQ ID NO: 19341 - DNA, 20 bp, Artificial Sequence
  Artificial sequence related to HLA knockouts in cell therapy
gagcgaggccggttctcaca

SEQ ID NO: 19342 - DNA, 20 bp, Artificial Sequence
  Artificial sequence related to HLA knockouts in cell therapy
agcgaggccggttctcacac

SEQ ID NO: 19343 - DNA, 20 bp, Artificial Sequence
  Artificial sequence related to HLA knockouts in cell therapy
gcgaggccggttctcacacc

SEQ ID NO: 19344 - DNA, 20 bp, Artificial Sequence
  Artificial sequence related to HLA knockouts in cell therapy
cgaggccggttctcacaccg

SEQ ID NO: 19345 - DNA, 20 bp, Artificial Sequence
  Artificial sequence related to HLA knockouts in cell therapy
gaggccggttctcacaccgt

SEQ ID NO: 19346 - DNA, 20 bp, Artificial Sequence
  Artificial sequence related to HLA knockouts in cell therapy
aggccggttctcacaccgtc

SEQ ID NO: 19347 - DNA, 20 bp, Artificial Sequence
  Artificial sequence related to HLA knockouts in cell therapy
ggccggttctcacaccgtcc

SEQ ID NO: 19348 - DNA, 20 bp, Artificial Sequence
  Artificial sequence related to HLA knockouts in cell therapy
gccggttctcacaccgtcca

SEQ ID NO: 19349 - DNA, 20 bp, Artificial Sequence
  Artificial sequence related to HLA knockouts in cell therapy
ccggttctcacaccgtccag

SEQ ID NO: 19350 - DNA, 20 bp, Artificial Sequence
  Artificial sequence related to HLA knockouts in cell therapy
cggttctcacaccgtccaga

SEQ ID NO: 19351 - DNA, 20 bp, Artificial Sequence
  Artificial sequence related to HLA knockouts in cell therapy
ggttctcacaccgtccagag

SEQ ID NO: 19352 - DNA, 20 bp, Artificial Sequence
  Artificial sequence related to HLA knockouts in cell therapy
gttctcacaccgtccagagg

SEQ ID NO: 19353 - DNA, 20 bp, Artificial Sequence
  Artificial sequence related to HLA knockouts in cell therapy
ctcacaccgtccagaggatg

SEQ ID NO: 19354 - DNA, 20 bp, Artificial Sequence
  Artificial sequence related to HLA knockouts in cell therapy
ccgtccagaggatgtatggc

SEQ ID NO: 19355 - DNA, 20 bp, Artificial Sequence
  Artificial sequence related to HLA knockouts in cell therapy
ccagaggatgtatggctgcg

SEQ ID NO: 19356 - DNA, 20 bp, Artificial Sequence
  Artificial sequence related to HLA knockouts in cell therapy
gaggatgtatggctgcgacg

SEQ ID NO: 19357 - DNA, 20 bp, Artificial Sequence
  Artificial sequence related to HLA knockouts in cell therapy
ggatgtatggctgcgacgtg

SEQ ID NO: 19358 - DNA, 20 bp, Artificial Sequence
  Artificial sequence related to HLA knockouts in cell therapy
gatgtatggctgcgacgtgg

SEQ ID NO: 19359 - DNA, 20 bp, Artificial Sequence
  Artificial sequence related to HLA knockouts in cell therapy
atgtatggctgcgacgtggg

SEQ ID NO: 19360 - DNA, 20 bp, Artificial Sequence
  Artificial sequence related to HLA knockouts in cell therapy
tgtatggctgcgacgtgggg

SEQ ID NO: 19361 - DNA, 20 bp, Artificial Sequence
  Artificial sequence related to HLA knockouts in cell therapy
gtatggctgcgacgtggggt

SEQ ID NO: 19362 - DNA, 20 bp, Artificial Sequence
  Artificial sequence related to HLA knockouts in cell therapy
tatggctgcgacgtggggtc

SEQ ID NO: 19363 - DNA, 20 bp, Artificial Sequence
  Artificial sequence related to HLA knockouts in cell therapy
atggctgcgacgtggggtcg

SEQ ID NO: 19364 - DNA, 20 bp, Artificial Sequence
  Artificial sequence related to HLA knockouts in cell therapy
tggctgcgacgtggggtcgg

SEQ ID NO: 19365 - DNA, 20 bp, Artificial Sequence
  Artificial sequence related to HLA knockouts in cell therapy
ggctgcgacgtggggtcgga

SEQ ID NO: 19366 - DNA, 20 bp, Artificial Sequence
  Artificial sequence related to HLA knockouts in cell therapy
gctgcgacgtggggtcggac

SEQ ID NO: 19367 - DNA, 20 bp, Artificial Sequence
  Artificial sequence related to HLA knockouts in cell therapy
ctgcgacgtggggtcggact

SEQ ID NO: 19368 - DNA, 20 bp, Artificial Sequence
  Artificial sequence related to HLA knockouts in cell therapy
tgcgacgtggggtcggactg

SEQ ID NO: 19369 - DNA, 20 bp, Artificial Sequence
  Artificial sequence related to HLA knockouts in cell therapy
gcgacgtggggtcggactgg

SEQ ID NO: 19370 - DNA, 20 bp, Artificial Sequence
  Artificial sequence related to HLA knockouts in cell therapy
cgacgtggggtcggactggc

SEQ ID NO: 19371 - DNA, 20 bp, Artificial Sequence
  Artificial sequence related to HLA knockouts in cell therapy
gacgtggggtcggactggcg

SEQ ID NO: 19372 - DNA, 20 bp, Artificial Sequence
  Artificial sequence related to HLA knockouts in cell therapy
acgtggggtcggactggcgc

SEQ ID NO: 19373 - DNA, 20 bp, Artificial Sequence
  Artificial sequence related to HLA knockouts in cell therapy
cgtggggtcggactggcgct

SEQ ID NO: 19374 - DNA, 20 bp, Artificial Sequence
  Artificial sequence related to HLA knockouts in cell therapy
gtggggtcggactggcgctt

SEQ ID NO: 19375 - DNA, 20 bp, Artificial Sequence
  Artificial sequence related to HLA knockouts in cell therapy
tggggtcggactggcgcttc

SEQ ID NO: 19376 - DNA, 20 bp, Artificial Sequence
  Artificial sequence related to HLA knockouts in cell therapy
ggggtcggactggcgcttcc

SEQ ID NO: 19377 - DNA, 20 bp, Artificial Sequence
  Artificial sequence related to HLA knockouts in cell therapy
gggtcggactggcgcttcct

SEQ ID NO: 19378 - DNA, 20 bp, Artificial Sequence
  Artificial sequence related to HLA knockouts in cell therapy
ggtcggactggcgcttcctc

SEQ ID NO: 19379 - DNA, 20 bp, Artificial Sequence
  Artificial sequence related to HLA knockouts in cell therapy
gtcggactggcgcttcctcc

SEQ ID NO: 19380 - DNA, 20 bp, Artificial Sequence
  Artificial sequence related to HLA knockouts in cell therapy
tcggactggcgcttcctccg

SEQ ID NO: 19381 - DNA, 20 bp, Artificial Sequence
  Artificial sequence related to HLA knockouts in cell therapy
cggactggcgcttcctccgc

SEQ ID NO: 19382 - DNA, 20 bp, Artificial Sequence
  Artificial sequence related to HLA knockouts in cell therapy
ggactggcgcttcctccgcg

SEQ ID NO: 19383 - DNA, 20 bp, Artificial Sequence
  Artificial sequence related to HLA knockouts in cell therapy
gactggcgcttcctccgcgg

SEQ ID NO: 19384 - DNA, 20 bp, Artificial Sequence
  Artificial sequence related to HLA knockouts in cell therapy
actggcgcttcctccgcggg

SEQ ID NO: 19385 - DNA, 20 bp, Artificial Sequence
  Artificial sequence related to HLA knockouts in cell therapy
ctggcgcttcctccgcgggt

SEQ ID NO: 19386 - DNA, 20 bp, Artificial Sequence
  Artificial sequence related to HLA knockouts in cell therapy
tggcgcttcctccgcgggta

SEQ ID NO: 19387 - DNA, 20 bp, Artificial Sequence
  Artificial sequence related to HLA knockouts in cell therapy
ggcgcttcctccgcgggtac

SEQ ID NO: 19388 - DNA, 20 bp, Artificial Sequence
  Artificial sequence related to HLA knockouts in cell therapy
gcgcttcctccgcgggtacc

SEQ ID NO: 19389 - DNA, 20 bp, Artificial Sequence
  Artificial sequence related to HLA knockouts in cell therapy
cgcttcctccgcgggtacca

SEQ ID NO: 19390 - DNA, 20 bp, Artificial Sequence
  Artificial sequence related to HLA knockouts in cell therapy
gcttcctccgcgggtaccac

SEQ ID NO: 19391 - DNA, 20 bp, Artificial Sequence
  Artificial sequence related to HLA knockouts in cell therapy
cttcctccgcgggtaccacc

SEQ ID NO: 19392 - DNA, 20 bp, Artificial Sequence
  Artificial sequence related to HLA knockouts in cell therapy
ttcctccgcgggtaccacca

SEQ ID NO: 19393 - DNA, 20 bp, Artificial Sequence
  Artificial sequence related to HLA knockouts in cell therapy
tcctccgcgggtaccaccag

SEQ ID NO: 19394 - DNA, 20 bp, Artificial Sequence
  Artificial sequence related to HLA knockouts in cell therapy
cctccgcgggtaccaccagt

SEQ ID NO: 19395 - DNA, 20 bp, Artificial Sequence
  Artificial sequence related to HLA knockouts in cell therapy
ctccgcgggtaccaccagta

SEQ ID NO: 19396 - DNA, 20 bp, Artificial Sequence
  Artificial sequence related to HLA knockouts in cell therapy
tccgcgggtaccaccagtac

SEQ ID NO: 19397 - DNA, 20 bp, Artificial Sequence
  Artificial sequence related to HLA knockouts in cell therapy
ccgcgggtaccaccagtacg

SEQ ID NO: 19398 - DNA, 20 bp, Artificial Sequence
  Artificial sequence related to HLA knockouts in cell therapy
cgcgggtaccaccagtacgc

SEQ ID NO: 19399 - DNA, 20 bp, Artificial Sequence
  Artificial sequence related to HLA knockouts in cell therapy
gcgggtaccaccagtacgcc

SEQ ID NO: 19400 - DNA, 20 bp, Artificial Sequence
  Artificial sequence related to HLA knockouts in cell therapy
cgggtaccaccagtacgcct

SEQ ID NO: 19401 - DNA, 20 bp, Artificial Sequence
  Artificial sequence related to HLA knockouts in cell therapy
gggtaccaccagtacgccta

SEQ ID NO: 19402 - DNA, 20 bp, Artificial Sequence
  Artificial sequence related to HLA knockouts in cell therapy
ggtaccaccagtacgcctac

SEQ ID NO: 19403 - DNA, 20 bp, Artificial Sequence
  Artificial sequence related to HLA knockouts in cell therapy
gtaccaccagtacgcctacg

SEQ ID NO: 19404 - DNA, 20 bp, Artificial Sequence
  Artificial sequence related to HLA knockouts in cell therapy
accaccagtacgcctacgac

SEQ ID NO: 19405 - DNA, 20 bp, Artificial Sequence
  Artificial sequence related to HLA knockouts in cell therapy
ccaccagtacgcctacgacg

SEQ ID NO: 19406 - DNA, 20 bp, Artificial Sequence
  Artificial sequence related to HLA knockouts in cell therapy
caccagtacgcctacgacgg

SEQ ID NO: 19407 - DNA, 20 bp, Artificial Sequence
  Artificial sequence related to HLA knockouts in cell therapy
accagtacgcctacgacggc

SEQ ID NO: 19408 - DNA, 20 bp, Artificial Sequence
  Artificial sequence related to HLA knockouts in cell therapy
ccagtacgcctacgacggca

SEQ ID NO: 19409 - DNA, 20 bp, Artificial Sequence
  Artificial sequence related to HLA knockouts in cell therapy
cagtacgcctacgacggcaa

SEQ ID NO: 19410 - DNA, 20 bp, Artificial Sequence
  Artificial sequence related to HLA knockouts in cell therapy
agtacgcctacgacggcaag

SEQ ID NO: 19411 - DNA, 20 bp, Artificial Sequence
  Artificial sequence related to HLA knockouts in cell therapy
gtacgcctacgacggcaagg

SEQ ID NO: 19412 - DNA, 20 bp, Artificial Sequence
  Artificial sequence related to HLA knockouts in cell therapy
tacgcctacgacggcaagga

SEQ ID NO: 19413 - DNA, 20 bp, Artificial Sequence
  Artificial sequence related to HLA knockouts in cell therapy
acgcctacgacggcaaggat

SEQ ID NO: 19414 - DNA, 20 bp, Artificial Sequence
  Artificial sequence related to HLA knockouts in cell therapy
cgcctacgacggcaaggatt

SEQ ID NO: 19415 - DNA, 20 bp, Artificial Sequence
  Artificial sequence related to HLA knockouts in cell therapy
cggcaaggattacatcgccc

SEQ ID NO: 19416 - DNA, 20 bp, Artificial Sequence
  Artificial sequence related to HLA knockouts in cell therapy
catcgccctgaaagaggacc

SEQ ID NO: 19417 - DNA, 20 bp, Artificial Sequence
  Artificial sequence related to HLA knockouts in cell therapy
tcgccctgaaagaggacctg

SEQ ID NO: 19418 - DNA, 20 bp, Artificial Sequence
  Artificial sequence related to HLA knockouts in cell therapy
cgccctgaaagaggacctgc

SEQ ID NO: 19419 - DNA, 20 bp, Artificial Sequence
  Artificial sequence related to HLA knockouts in cell therapy
gccctgaaagaggacctgcg

SEQ ID NO: 19420 - DNA, 20 bp, Artificial Sequence
  Artificial sequence related to HLA knockouts in cell therapy
ccctgaaagaggacctgcgc

SEQ ID NO: 19421 - DNA, 20 bp, Artificial Sequence
  Artificial sequence related to HLA knockouts in cell therapy
cctgaaagaggacctgcgct

SEQ ID NO: 19422 - DNA, 20 bp, Artificial Sequence
  Artificial sequence related to HLA knockouts in cell therapy
ctgaaagaggacctgcgctc

SEQ ID NO: 19423 - DNA, 20 bp, Artificial Sequence
  Artificial sequence related to HLA knockouts in cell therapy
aagaggacctgcgctcttgg

SEQ ID NO: 19424 - DNA, 20 bp, Artificial Sequence
  Artificial sequence related to HLA knockouts in cell therapy
agaggacctgcgctcttgga

SEQ ID NO: 19425 - DNA, 20 bp, Artificial Sequence
  Artificial sequence related to HLA knockouts in cell therapy
gaggacctgcgctcttggac

SEQ ID NO: 19426 - DNA, 20 bp, Artificial Sequence
  Artificial sequence related to HLA knockouts in cell therapy
aggacctgcgctcttggacc

SEQ ID NO: 19427 - DNA, 20 bp, Artificial Sequence
  Artificial sequence related to HLA knockouts in cell therapy
ggacctgcgctcttggaccg

SEQ ID NO: 19428 - DNA, 20 bp, Artificial Sequence
  Artificial sequence related to HLA knockouts in cell therapy
gacctgcgctcttggaccgc

SEQ ID NO: 19429 - DNA, 20 bp, Artificial Sequence
  Artificial sequence related to HLA knockouts in cell therapy
acctgcgctcttggaccgcg

SEQ ID NO: 19430 - DNA, 20 bp, Artificial Sequence
  Artificial sequence related to HLA knockouts in cell therapy
cctgcgctcttggaccgcgg

SEQ ID NO: 19431 - DNA, 20 bp, Artificial Sequence
  Artificial sequence related to HLA knockouts in cell therapy
ctgcgctcttggaccgcggc

SEQ ID NO: 19432 - DNA, 20 bp, Artificial Sequence
  Artificial sequence related to HLA knockouts in cell therapy
tgcgctcttggaccgcggcg

SEQ ID NO: 19433 - DNA, 20 bp, Artificial Sequence
  Artificial sequence related to HLA knockouts in cell therapy
gcgctcttggaccgcggcgg

SEQ ID NO: 19434 - DNA, 20 bp, Artificial Sequence
  Artificial sequence related to HLA knockouts in cell therapy
cgctcttggaccgcggcgga

SEQ ID NO: 19435 - DNA, 20 bp, Artificial Sequence
  Artificial sequence related to HLA knockouts in cell therapy
gctcttggaccgcggcggac

SEQ ID NO: 19436 - DNA, 20 bp, Artificial Sequence
  Artificial sequence related to HLA knockouts in cell therapy
ctcttggaccgcggcggaca

SEQ ID NO: 19437 - DNA, 20 bp, Artificial Sequence
  Artificial sequence related to HLA knockouts in cell therapy
tcttggaccgcggcggacat

SEQ ID NO: 19438 - DNA, 20 bp, Artificial Sequence
  Artificial sequence related to HLA knockouts in cell therapy
cttggaccgcggcggacatg

SEQ ID NO: 19439 - DNA, 20 bp, Artificial Sequence
  Artificial sequence related to HLA knockouts in cell therapy
ttggaccgcggcggacatgg

SEQ ID NO: 19440 - DNA, 20 bp, Artificial Sequence
  Artificial sequence related to HLA knockouts in cell therapy
tggaccgcggcggacatggc

SEQ ID NO: 19441 - DNA, 20 bp, Artificial Sequence
  Artificial sequence related to HLA knockouts in cell therapy
ggaccgcggcggacatggca

SEQ ID NO: 19442 - DNA, 20 bp, Artificial Sequence
  Artificial sequence related to HLA knockouts in cell therapy
gaccgcggcggacatggcag

SEQ ID NO: 19443 - DNA, 20 bp, Artificial Sequence
  Artificial sequence related to HLA knockouts in cell therapy
accgcggcggacatggcagc

SEQ ID NO: 19444 - DNA, 20 bp, Artificial Sequence
  Artificial sequence related to HLA knockouts in cell therapy
ccgcggcggacatggcagct

SEQ ID NO: 19445 - DNA, 20 bp, Artificial Sequence
  Artificial sequence related to HLA knockouts in cell therapy
cgcggcggacatggcagctc

SEQ ID NO: 19446 - DNA, 20 bp, Artificial Sequence
  Artificial sequence related to HLA knockouts in cell therapy
gcggcggacatggcagctca

SEQ ID NO: 19447 - DNA, 20 bp, Artificial Sequence
  Artificial sequence related to HLA knockouts in cell therapy
cggcggacatggcagctcag

SEQ ID NO: 19448 - DNA, 20 bp, Artificial Sequence
  Artificial sequence related to HLA knockouts in cell therapy
ggcggacatggcagctcaga

SEQ ID NO: 19449 - DNA, 20 bp, Artificial Sequence
  Artificial sequence related to HLA knockouts in cell therapy
gcggacatggcagctcagac

SEQ ID NO: 19450 - DNA, 20 bp, Artificial Sequence
  Artificial sequence related to HLA knockouts in cell therapy
cggacatggcagctcagacc

SEQ ID NO: 19451 - DNA, 20 bp, Artificial Sequence
  Artificial sequence related to HLA knockouts in cell therapy
ggacatggcagctcagacca

SEQ ID NO: 19452 - DNA, 20 bp, Artificial Sequence
  Artificial sequence related to HLA knockouts in cell therapy
gacatggcagctcagaccac

SEQ ID NO: 19453 - DNA, 20 bp, Artificial Sequence
  Artificial sequence related to HLA knockouts in cell therapy
acatggcagctcagaccacc

SEQ ID NO: 19454 - DNA, 20 bp, Artificial Sequence
  Artificial sequence related to HLA knockouts in cell therapy
catggcagctcagaccacca

SEQ ID NO: 19455 - DNA, 20 bp, Artificial Sequence
  Artificial sequence related to HLA knockouts in cell therapy
tggcagctcagaccaccaag

SEQ ID NO: 19456 - DNA, 20 bp, Artificial Sequence
  Artificial sequence related to HLA knockouts in cell therapy
ggcagctcagaccaccaagc

SEQ ID NO: 19457 - DNA, 20 bp, Artificial Sequence
  Artificial sequence related to HLA knockouts in cell therapy
gcagctcagaccaccaagca

SEQ ID NO: 19458 - DNA, 20 bp, Artificial Sequence
  Artificial sequence related to HLA knockouts in cell therapy
cagctcagaccaccaagcac

SEQ ID NO: 19459 - DNA, 20 bp, Artificial Sequence
  Artificial sequence related to HLA knockouts in cell therapy
gaccaccaagcacaagtggg

SEQ ID NO: 19460 - DNA, 20 bp, Artificial Sequence
  Artificial sequence related to HLA knockouts in cell therapy
ccaccaagcacaagtgggag

SEQ ID NO: 19461 - DNA, 20 bp, Artificial Sequence
  Artificial sequence related to HLA knockouts in cell therapy
caccaagcacaagtgggagg

SEQ ID NO: 19462 - DNA, 20 bp, Artificial Sequence
  Artificial sequence related to HLA knockouts in cell therapy
accaagcacaagtgggaggc

SEQ ID NO: 19463 - DNA, 20 bp, Artificial Sequence
  Artificial sequence related to HLA knockouts in cell therapy
ccaagcacaagtgggaggcg

SEQ ID NO: 19464 - DNA, 20 bp, Artificial Sequence
  Artificial sequence related to HLA knockouts in cell therapy
caagcacaagtgggaggcgg

SEQ ID NO: 19465 - DNA, 20 bp, Artificial Sequence
  Artificial sequence related to HLA knockouts in cell therapy
aagcacaagtgggaggcggc

SEQ ID NO: 19466 - DNA, 20 bp, Artificial Sequence
  Artificial sequence related to HLA knockouts in cell therapy
agcacaagtgggaggcggcc

SEQ ID NO: 19467 - DNA, 20 bp, Artificial Sequence
  Artificial sequence related to HLA knockouts in cell therapy
gcacaagtgggaggcggccc

SEQ ID NO: 19468 - DNA, 20 bp, Artificial Sequence
  Artificial sequence related to HLA knockouts in cell therapy
cacaagtgggaggcggccca

SEQ ID NO: 19469 - DNA, 20 bp, Artificial Sequence
  Artificial sequence related to HLA knockouts in cell therapy
acaagtgggaggcggcccat

SEQ ID NO: 19470 - DNA, 20 bp, Artificial Sequence
  Artificial sequence related to HLA knockouts in cell therapy
caagtgggaggcggcccatg

SEQ ID NO: 19471 - DNA, 20 bp, Artificial Sequence
  Artificial sequence related to HLA knockouts in cell therapy
aagtgggaggcggcccatgt

SEQ ID NO: 19472 - DNA, 20 bp, Artificial Sequence
  Artificial sequence related to HLA knockouts in cell therapy
agtgggaggcggcccatgtg

SEQ ID NO: 19473 - DNA, 20 bp, Artificial Sequence
  Artificial sequence related to HLA knockouts in cell therapy
gtgggaggcggcccatgtgg

SEQ ID NO: 19474 - DNA, 20 bp, Artificial Sequence
  Artificial sequence related to HLA knockouts in cell therapy
tgggaggcggcccatgtggc

SEQ ID NO: 19475 - DNA, 20 bp, Artificial Sequence
  Artificial sequence related to HLA knockouts in cell therapy
gggaggcggcccatgtggcg

SEQ ID NO: 19476 - DNA, 20 bp, Artificial Sequence
  Artificial sequence related to HLA knockouts in cell therapy
ggaggcggcccatgtggcgg

SEQ ID NO: 19477 - DNA, 20 bp, Artificial Sequence
  Artificial sequence related to HLA knockouts in cell therapy
gaggcggcccatgtggcgga

SEQ ID NO: 19478 - DNA, 20 bp, Artificial Sequence
  Artificial sequence related to HLA knockouts in cell therapy
aggcggcccatgtggcggag

SEQ ID NO: 19479 - DNA, 20 bp, Artificial Sequence
  Artificial sequence related to HLA knockouts in cell therapy
ggcggcccatgtggcggagc

SEQ ID NO: 19480 - DNA, 20 bp, Artificial Sequence
  Artificial sequence related to HLA knockouts in cell therapy
gcggcccatgtggcggagca

SEQ ID NO: 19481 - DNA, 20 bp, Artificial Sequence
  Artificial sequence related to HLA knockouts in cell therapy
cggcccatgtggcggagcag

SEQ ID NO: 19482 - DNA, 20 bp, Artificial Sequence
  Artificial sequence related to HLA knockouts in cell therapy
ggcccatgtggcggagcagt

SEQ ID NO: 19483 - DNA, 20 bp, Artificial Sequence
  Artificial sequence related to HLA knockouts in cell therapy
gcccatgtggcggagcagtt

SEQ ID NO: 19484 - DNA, 20 bp, Artificial Sequence
  Artificial sequence related to HLA knockouts in cell therapy
cccatgtggcggagcagttg

SEQ ID NO: 19485 - DNA, 20 bp, Artificial Sequence
  Artificial sequence related to HLA knockouts in cell therapy
ccatgtggcggagcagttga

SEQ ID NO: 19486 - DNA, 20 bp, Artificial Sequence
  Artificial sequence related to HLA knockouts in cell therapy
catgtggcggagcagttgag

SEQ ID NO: 19487 - DNA, 20 bp, Artificial Sequence
  Artificial sequence related to HLA knockouts in cell therapy
tgtggcggagcagttgagag

SEQ ID NO: 19488 - DNA, 20 bp, Artificial Sequence
  Artificial sequence related to HLA knockouts in cell therapy
gtggcggagcagttgagagc

SEQ ID NO: 19489 - DNA, 20 bp, Artificial Sequence
  Artificial sequence related to HLA knockouts in cell therapy
tggcggagcagttgagagcc

SEQ ID NO: 19490 - DNA, 20 bp, Artificial Sequence
  Artificial sequence related to HLA knockouts in cell therapy
ggcggagcagttgagagcct

SEQ ID NO: 19491 - DNA, 20 bp, Artificial Sequence
  Artificial sequence related to HLA knockouts in cell therapy
gcggagcagttgagagccta

SEQ ID NO: 19492 - DNA, 20 bp, Artificial Sequence
  Artificial sequence related to HLA knockouts in cell therapy
cggagcagttgagagcctac

SEQ ID NO: 19493 - DNA, 20 bp, Artificial Sequence
  Artificial sequence related to HLA knockouts in cell therapy
ggagcagttgagagcctacc

SEQ ID NO: 19494 - DNA, 20 bp, Artificial Sequence
  Artificial sequence related to HLA knockouts in cell therapy
gcagttgagagcctacctgg

SEQ ID NO: 19495 - DNA, 20 bp, Artificial Sequence
  Artificial sequence related to HLA knockouts in cell therapy
gttgagagcctacctggagg

SEQ ID NO: 19496 - DNA, 20 bp, Artificial Sequence
  Artificial sequence related to HLA knockouts in cell therapy
ttgagagcctacctggaggg

SEQ ID NO: 19497 - DNA, 20 bp, Artificial Sequence
  Artificial sequence related to HLA knockouts in cell therapy
tgagagcctacctggagggc

SEQ ID NO: 19498 - DNA, 20 bp, Artificial Sequence
  Artificial sequence related to HLA knockouts in cell therapy
gagagcctacctggagggca

SEQ ID NO: 19499 - DNA, 20 bp, Artificial Sequence
  Artificial sequence related to HLA knockouts in cell therapy
agagcctacctggagggcac

SEQ ID NO: 19500 - DNA, 20 bp, Artificial Sequence
  Artificial sequence related to HLA knockouts in cell therapy
gagcctacctggagggcacg

SEQ ID NO: 19501 - DNA, 20 bp, Artificial Sequence
  Artificial sequence related to HLA knockouts in cell therapy
agcctacctggagggcacgt

SEQ ID NO: 19502 - DNA, 20 bp, Artificial Sequence
  Artificial sequence related to HLA knockouts in cell therapy
gcctacctggagggcacgtg

SEQ ID NO: 19503 - DNA, 20 bp, Artificial Sequence
  Artificial sequence related to HLA knockouts in cell therapy
cctacctggagggcacgtgc

SEQ ID NO: 19504 - DNA, 20 bp, Artificial Sequence
  Artificial sequence related to HLA knockouts in cell therapy
ctacctggagggcacgtgcg

SEQ ID NO: 19505 - DNA, 20 bp, Artificial Sequence
  Artificial sequence related to HLA knockouts in cell therapy
tacctggagggcacgtgcgt

SEQ ID NO: 19506 - DNA, 20 bp, Artificial Sequence
  Artificial sequence related to HLA knockouts in cell therapy
acctggagggcacgtgcgtg

SEQ ID NO: 19507 - DNA, 20 bp, Artificial Sequence
  Artificial sequence related to HLA knockouts in cell therapy
cctggagggcacgtgcgtgg

SEQ ID NO: 19508 - DNA, 20 bp, Artificial Sequence
  Artificial sequence related to HLA knockouts in cell therapy
ctggagggcacgtgcgtgga

SEQ ID NO: 19509 - DNA, 20 bp, Artificial Sequence
  Artificial sequence related to HLA knockouts in cell therapy
tggagggcacgtgcgtggag

SEQ ID NO: 19510 - DNA, 20 bp, Artificial Sequence
  Artificial sequence related to HLA knockouts in cell therapy
ggagggcacgtgcgtggagt

SEQ ID NO: 19511 - DNA, 20 bp, Artificial Sequence
  Artificial sequence related to HLA knockouts in cell therapy
gagggcacgtgcgtggagtg

SEQ ID NO: 19512 - DNA, 20 bp, Artificial Sequence
  Artificial sequence related to HLA knockouts in cell therapy
agggcacgtgcgtggagtgg

SEQ ID NO: 19513 - DNA, 20 bp, Artificial Sequence
  Artificial sequence related to HLA knockouts in cell therapy
gggcacgtgcgtggagtggc

SEQ ID NO: 19514 - DNA, 20 bp, Artificial Sequence
  Artificial sequence related to HLA knockouts in cell therapy
ggcacgtgcgtggagtggct

SEQ ID NO: 19515 - DNA, 20 bp, Artificial Sequence
  Artificial sequence related to HLA knockouts in cell therapy
gcacgtgcgtggagtggctc

SEQ ID NO: 19516 - DNA, 20 bp, Artificial Sequence
  Artificial sequence related to HLA knockouts in cell therapy
cacgtgcgtggagtggctcc

SEQ ID NO: 19517 - DNA, 20 bp, Artificial Sequence
  Artificial sequence related to HLA knockouts in cell therapy
acgtgcgtggagtggctccg

SEQ ID NO: 19518 - DNA, 20 bp, Artificial Sequence
  Artificial sequence related to HLA knockouts in cell therapy
cgtgcgtggagtggctccgc

SEQ ID NO: 19519 - DNA, 20 bp, Artificial Sequence
  Artificial sequence related to HLA knockouts in cell therapy
gtgcgtggagtggctccgca

SEQ ID NO: 19520 - DNA, 20 bp, Artificial Sequence
  Artificial sequence related to HLA knockouts in cell therapy
tgcgtggagtggctccgcag

SEQ ID NO: 19521 - DNA, 20 bp, Artificial Sequence
  Artificial sequence related to HLA knockouts in cell therapy
gcgtggagtggctccgcaga

SEQ ID NO: 19522 - DNA, 20 bp, Artificial Sequence
  Artificial sequence related to HLA knockouts in cell therapy
cgtggagtggctccgcagat

SEQ ID NO: 19523 - DNA, 20 bp, Artificial Sequence
  Artificial sequence related to HLA knockouts in cell therapy
gtggagtggctccgcagata

SEQ ID NO: 19524 - DNA, 20 bp, Artificial Sequence
  Artificial sequence related to HLA knockouts in cell therapy
tggagtggctccgcagatac

SEQ ID NO: 19525 - DNA, 20 bp, Artificial Sequence
  Artificial sequence related to HLA knockouts in cell therapy
ggagtggctccgcagatacc

SEQ ID NO: 19526 - DNA, 20 bp, Artificial Sequence
  Artificial sequence related to HLA knockouts in cell therapy
gagtggctccgcagatacct

SEQ ID NO: 19527 - DNA, 20 bp, Artificial Sequence
  Artificial sequence related to HLA knockouts in cell therapy
agtggctccgcagatacctg

SEQ ID NO: 19528 - DNA, 20 bp, Artificial Sequence
  Artificial sequence related to HLA knockouts in cell therapy
gtggctccgcagatacctgg

SEQ ID NO: 19529 - DNA, 20 bp, Artificial Sequence
  Artificial sequence related to HLA knockouts in cell therapy
tggctccgcagatacctgga

SEQ ID NO: 19530 - DNA, 20 bp, Artificial Sequence
  Artificial sequence related to HLA knockouts in cell therapy
ggctccgcagatacctggag

SEQ ID NO: 19531 - DNA, 20 bp, Artificial Sequence
  Artificial sequence related to HLA knockouts in cell therapy
gctccgcagatacctggaga

SEQ ID NO: 19532 - DNA, 20 bp, Artificial Sequence
  Artificial sequence related to HLA knockouts in cell therapy
ccgcagatacctggagaacg

SEQ ID NO: 19533 - DNA, 20 bp, Artificial Sequence
  Artificial sequence related to HLA knockouts in cell therapy
cgcagatacctggagaacgg

SEQ ID NO: 19534 - DNA, 20 bp, Artificial Sequence
  Artificial sequence related to HLA knockouts in cell therapy
gcagatacctggagaacggg

SEQ ID NO: 19535 - DNA, 20 bp, Artificial Sequence
  Artificial sequence related to HLA knockouts in cell therapy
acctggagaacgggaaggag

SEQ ID NO: 19536 - DNA, 20 bp, Artificial Sequence
  Artificial sequence related to HLA knockouts in cell therapy
cctggagaacgggaaggaga

SEQ ID NO: 19537 - DNA, 20 bp, Artificial Sequence
  Artificial sequence related to HLA knockouts in cell therapy
ctggagaacgggaaggagac

SEQ ID NO: 19538 - DNA, 20 bp, Artificial Sequence
  Artificial sequence related to HLA knockouts in cell therapy
tggagaacgggaaggagacg

SEQ ID NO: 19539 - DNA, 20 bp, Artificial Sequence
  Artificial sequence related to HLA knockouts in cell therapy
ggagaacgggaaggagacgc

SEQ ID NO: 19540 - DNA, 20 bp, Artificial Sequence
  Artificial sequence related to HLA knockouts in cell therapy
gagaacgggaaggagacgct

SEQ ID NO: 19541 - DNA, 20 bp, Artificial Sequence
  Artificial sequence related to HLA knockouts in cell therapy
agaacgggaaggagacgctg

SEQ ID NO: 19542 - DNA, 20 bp, Artificial Sequence
  Artificial sequence related to HLA knockouts in cell therapy
gaacgggaaggagacgctgc

SEQ ID NO: 19543 - DNA, 20 bp, Artificial Sequence
  Artificial sequence related to HLA knockouts in cell therapy
aacgggaaggagacgctgca

SEQ ID NO: 19544 - DNA, 20 bp, Artificial Sequence
  Artificial sequence related to HLA knockouts in cell therapy
acgggaaggagacgctgcag

SEQ ID NO: 19545 - DNA, 20 bp, Artificial Sequence
  Artificial sequence related to HLA knockouts in cell therapy
cgggaaggagacgctgcagc

SEQ ID NO: 19546 - DNA, 20 bp, Artificial Sequence
  Artificial sequence related to HLA knockouts in cell therapy
gggaaggagacgctgcagcg

SEQ ID NO: 19547 - DNA, 20 bp, Artificial Sequence
  Artificial sequence related to HLA knockouts in cell therapy
ggaaggagacgctgcagcgc

SEQ ID NO: 19548 - DNA, 20 bp, Artificial Sequence
  Artificial sequence related to HLA knockouts in cell therapy
gaaggagacgctgcagcgca

SEQ ID NO: 19549 - DNA, 20 bp, Artificial Sequence
  Artificial sequence related to HLA knockouts in cell therapy
aaggagacgctgcagcgcac

SEQ ID NO: 19550 - DNA, 20 bp, Artificial Sequence
  Artificial sequence related to HLA knockouts in cell therapy
aggagacgctgcagcgcacg

SEQ ID NO: 19551 - DNA, 20 bp, Artificial Sequence
  Artificial sequence related to HLA knockouts in cell therapy
ggagacgctgcagcgcacgg

SEQ ID NO: 19552 - DNA, 20 bp, Artificial Sequence
  Artificial sequence related to HLA knockouts in cell therapy
gagacgctgcagcgcacgga

SEQ ID NO: 19553 - DNA, 20 bp, Artificial Sequence
  Artificial sequence related to HLA knockouts in cell therapy
agacgctgcagcgcacggac

SEQ ID NO: 19554 - DNA, 20 bp, Artificial Sequence
  Artificial sequence related to HLA knockouts in cell therapy
gacgctgcagcgcacggacg

SEQ ID NO: 19555 - DNA, 20 bp, Artificial Sequence
  Artificial sequence related to HLA knockouts in cell therapy
acgctgcagcgcacggacgc

SEQ ID NO: 19556 - DNA, 20 bp, Artificial Sequence
  Artificial sequence related to HLA knockouts in cell therapy
cgctgcagcgcacggacgcc

SEQ ID NO: 19557 - DNA, 20 bp, Artificial Sequence
  Artificial sequence related to HLA knockouts in cell therapy
gctgcagcgcacggacgccc

SEQ ID NO: 19558 - DNA, 20 bp, Artificial Sequence
  Artificial sequence related to HLA knockouts in cell therapy
ctgcagcgcacggacgcccc

SEQ ID NO: 19559 - DNA, 20 bp, Artificial Sequence
  Artificial sequence related to HLA knockouts in cell therapy
tgcagcgcacggacgccccc

SEQ ID NO: 19560 - DNA, 20 bp, Artificial Sequence
  Artificial sequence related to HLA knockouts in cell therapy
gcagcgcacggacgccccca

SEQ ID NO: 19561 - DNA, 20 bp, Artificial Sequence
  Artificial sequence related to HLA knockouts in cell therapy
cagcgcacggacgcccccaa

SEQ ID NO: 19562 - DNA, 20 bp, Artificial Sequence
  Artificial sequence related to HLA knockouts in cell therapy
agcgcacggacgcccccaaa

SEQ ID NO: 19563 - DNA, 20 bp, Artificial Sequence
  Artificial sequence related to HLA knockouts in cell therapy
gcgcacggacgcccccaaaa

SEQ ID NO: 19564 - DNA, 20 bp, Artificial Sequence
  Artificial sequence related to HLA knockouts in cell therapy
cgcacggacgcccccaaaac

SEQ ID NO: 19565 - DNA, 20 bp, Artificial Sequence
  Artificial sequence related to HLA knockouts in cell therapy
gcacggacgcccccaaaacg

SEQ ID NO: 19566 - DNA, 20 bp, Artificial Sequence
  Artificial sequence related to HLA knockouts in cell therapy
cacggacgcccccaaaacgc

SEQ ID NO: 19567 - DNA, 20 bp, Artificial Sequence
  Artificial sequence related to HLA knockouts in cell therapy
acggacgcccccaaaacgca

SEQ ID NO: 19568 - DNA, 20 bp, Artificial Sequence
  Artificial sequence related to HLA knockouts in cell therapy
cggacgcccccaaaacgcat

SEQ ID NO: 19569 - DNA, 20 bp, Artificial Sequence
  Artificial sequence related to HLA knockouts in cell therapy
ggacgcccccaaaacgcata

SEQ ID NO: 19570 - DNA, 20 bp, Artificial Sequence
  Artificial sequence related to HLA knockouts in cell therapy
gactcaccacgctgtctctg

SEQ ID NO: 19571 - DNA, 20 bp, Artificial Sequence
  Artificial sequence related to HLA knockouts in cell therapy
ctcaccacgctgtctctgac

SEQ ID NO: 19572 - DNA, 20 bp, Artificial Sequence
  Artificial sequence related to HLA knockouts in cell therapy
tcaccacgctgtctctgacc

SEQ ID NO: 19573 - DNA, 20 bp, Artificial Sequence
  Artificial sequence related to HLA knockouts in cell therapy
caccacgctgtctctgacca

SEQ ID NO: 19574 - DNA, 20 bp, Artificial Sequence
  Artificial sequence related to HLA knockouts in cell therapy
ccacgctgtctctgaccatg

SEQ ID NO: 19575 - DNA, 20 bp, Artificial Sequence
  Artificial sequence related to HLA knockouts in cell therapy
ctctgaccatgaagccaccc

SEQ ID NO: 19576 - DNA, 20 bp, Artificial Sequence
  Artificial sequence related to HLA knockouts in cell therapy
ctgaccatgaagccaccctg

SEQ ID NO: 19577 - DNA, 20 bp, Artificial Sequence
  Artificial sequence related to HLA knockouts in cell therapy
gaccatgaagccaccctgag

SEQ ID NO: 19578 - DNA, 20 bp, Artificial Sequence
  Artificial sequence related to HLA knockouts in cell therapy
accatgaagccaccctgagg

SEQ ID NO: 19579 - DNA, 20 bp, Artificial Sequence
  Artificial sequence related to HLA knockouts in cell therapy
ccatgaagccaccctgaggt

SEQ ID NO: 19580 - DNA, 20 bp, Artificial Sequence
  Artificial sequence related to HLA knockouts in cell therapy
catgaagccaccctgaggtg

SEQ ID NO: 19581 - DNA, 20 bp, Artificial Sequence
  Artificial sequence related to HLA knockouts in cell therapy
atgaagccaccctgaggtgc

SEQ ID NO: 19582 - DNA, 20 bp, Artificial Sequence
  Artificial sequence related to HLA knockouts in cell therapy
tgaagccaccctgaggtgct

SEQ ID NO: 19583 - DNA, 20 bp, Artificial Sequence
  Artificial sequence related to HLA knockouts in cell therapy
gaagccaccctgaggtgctg

SEQ ID NO: 19584 - DNA, 20 bp, Artificial Sequence
  Artificial sequence related to HLA knockouts in cell therapy
aagccaccctgaggtgctgg

SEQ ID NO: 19585 - DNA, 20 bp, Artificial Sequence
  Artificial sequence related to HLA knockouts in cell therapy
agccaccctgaggtgctggg

SEQ ID NO: 19586 - DNA, 20 bp, Artificial Sequence
  Artificial sequence related to HLA knockouts in cell therapy
gccaccctgaggtgctgggc

SEQ ID NO: 19587 - DNA, 20 bp, Artificial Sequence
  Artificial sequence related to HLA knockouts in cell therapy
ccaccctgaggtgctgggcc

SEQ ID NO: 19588 - DNA, 20 bp, Artificial Sequence
  Artificial sequence related to HLA knockouts in cell therapy
caccctgaggtgctgggccc

SEQ ID NO: 19589 - DNA, 20 bp, Artificial Sequence
  Artificial sequence related to HLA knockouts in cell therapy
accctgaggtgctgggccct

SEQ ID NO: 19590 - DNA, 20 bp, Artificial Sequence
  Artificial sequence related to HLA knockouts in cell therapy
ccctgaggtgctgggccctg

SEQ ID NO: 19591 - DNA, 20 bp, Artificial Sequence
  Artificial sequence related to HLA knockouts in cell therapy
cctgaggtgctgggccctga

SEQ ID NO: 19592 - DNA, 20 bp, Artificial Sequence
  Artificial sequence related to HLA knockouts in cell therapy
ctgaggtgctgggccctgag

SEQ ID NO: 19593 - DNA, 20 bp, Artificial Sequence
  Artificial sequence related to HLA knockouts in cell therapy
tgaggtgctgggccctgagc

SEQ ID NO: 19594 - DNA, 20 bp, Artificial Sequence
  Artificial sequence related to HLA knockouts in cell therapy
gaggtgctgggccctgagct

SEQ ID NO: 19595 - DNA, 20 bp, Artificial Sequence
  Artificial sequence related to HLA knockouts in cell therapy
aggtgctgggccctgagctt

SEQ ID NO: 19596 - DNA, 20 bp, Artificial Sequence
  Artificial sequence related to HLA knockouts in cell therapy
ggtgctgggccctgagcttc

SEQ ID NO: 19597 - DNA, 20 bp, Artificial Sequence
  Artificial sequence related to HLA knockouts in cell therapy
gtgctgggccctgagcttct

SEQ ID NO: 19598 - DNA, 20 bp, Artificial Sequence
  Artificial sequence related to HLA knockouts in cell therapy
tgctgggccctgagcttcta

SEQ ID NO: 19599 - DNA, 20 bp, Artificial Sequence
  Artificial sequence related to HLA knockouts in cell therapy
gctgggccctgagcttctac

SEQ ID NO: 19600 - DNA, 20 bp, Artificial Sequence
  Artificial sequence related to HLA knockouts in cell therapy
ctgggccctgagcttctacc

SEQ ID NO: 19601 - DNA, 20 bp, Artificial Sequence
  Artificial sequence related to HLA knockouts in cell therapy
tgggccctgagcttctaccc

SEQ ID NO: 19602 - DNA, 20 bp, Artificial Sequence
  Artificial sequence related to HLA knockouts in cell therapy
gggccctgagcttctaccct

SEQ ID NO: 19603 - DNA, 20 bp, Artificial Sequence
  Artificial sequence related to HLA knockouts in cell therapy
ggccctgagcttctaccctg

SEQ ID NO: 19604 - DNA, 20 bp, Artificial Sequence
  Artificial sequence related to HLA knockouts in cell therapy
gccctgagcttctaccctgc

SEQ ID NO: 19605 - DNA, 20 bp, Artificial Sequence
  Artificial sequence related to HLA knockouts in cell therapy
ccctgagcttctaccctgcg

SEQ ID NO: 19606 - DNA, 20 bp, Artificial Sequence
  Artificial sequence related to HLA knockouts in cell therapy
cctgagcttctaccctgcgg

SEQ ID NO: 19607 - DNA, 20 bp, Artificial Sequence
  Artificial sequence related to HLA knockouts in cell therapy
ctgagcttctaccctgcgga

SEQ ID NO: 19608 - DNA, 20 bp, Artificial Sequence
  Artificial sequence related to HLA knockouts in cell therapy
tgagcttctaccctgcggag

SEQ ID NO: 19609 - DNA, 20 bp, Artificial Sequence
  Artificial sequence related to HLA knockouts in cell therapy
gagcttctaccctgcggaga

SEQ ID NO: 19610 - DNA, 20 bp, Artificial Sequence
  Artificial sequence related to HLA knockouts in cell therapy
gcttctaccctgcggagatc

SEQ ID NO: 19611 - DNA, 20 bp, Artificial Sequence
  Artificial sequence related to HLA knockouts in cell therapy
ctaccctgcggagatcacac

SEQ ID NO: 19612 - DNA, 20 bp, Artificial Sequence
  Artificial sequence related to HLA knockouts in cell therapy
accctgcggagatcacactg

SEQ ID NO: 19613 - DNA, 20 bp, Artificial Sequence
  Artificial sequence related to HLA knockouts in cell therapy
ccctgcggagatcacactga

SEQ ID NO: 19614 - DNA, 20 bp, Artificial Sequence
  Artificial sequence related to HLA knockouts in cell therapy
cctgcggagatcacactgac

SEQ ID NO: 19615 - DNA, 20 bp, Artificial Sequence
  Artificial sequence related to HLA knockouts in cell therapy
ctgcggagatcacactgacc

SEQ ID NO: 19616 - DNA, 20 bp, Artificial Sequence
  Artificial sequence related to HLA knockouts in cell therapy
gcggagatcacactgacctg

SEQ ID NO: 19617 - DNA, 20 bp, Artificial Sequence
  Artificial sequence related to HLA knockouts in cell therapy
cggagatcacactgacctgg

SEQ ID NO: 19618 - DNA, 20 bp, Artificial Sequence
  Artificial sequence related to HLA knockouts in cell therapy
ggagatcacactgacctggc

SEQ ID NO: 19619 - DNA, 20 bp, Artificial Sequence
  Artificial sequence related to HLA knockouts in cell therapy
gatcacactgacctggcagc

SEQ ID NO: 19620 - DNA, 20 bp, Artificial Sequence
  Artificial sequence related to HLA knockouts in cell therapy
atcacactgacctggcagcg

SEQ ID NO: 19621 - DNA, 20 bp, Artificial Sequence
  Artificial sequence related to HLA knockouts in cell therapy
tcacactgacctggcagcgg

SEQ ID NO: 19622 - DNA, 20 bp, Artificial Sequence
  Artificial sequence related to HLA knockouts in cell therapy
cacactgacctggcagcggg

SEQ ID NO: 19623 - DNA, 20 bp, Artificial Sequence
  Artificial sequence related to HLA knockouts in cell therapy
acactgacctggcagcggga

SEQ ID NO: 19624 - DNA, 20 bp, Artificial Sequence
  Artificial sequence related to HLA knockouts in cell therapy
cactgacctggcagcgggat

SEQ ID NO: 19625 - DNA, 20 bp, Artificial Sequence
  Artificial sequence related to HLA knockouts in cell therapy
actgacctggcagcgggatg

SEQ ID NO: 19626 - DNA, 20 bp, Artificial Sequence
  Artificial sequence related to HLA knockouts in cell therapy
ctgacctggcagcgggatgg

SEQ ID NO: 19627 - DNA, 20 bp, Artificial Sequence
  Artificial sequence related to HLA knockouts in cell therapy
tgacctggcagcgggatggg

SEQ ID NO: 19628 - DNA, 20 bp, Artificial Sequence
  Artificial sequence related to HLA knockouts in cell therapy
gacctggcagcgggatgggg

SEQ ID NO: 19629 - DNA, 20 bp, Artificial Sequence
  Artificial sequence related to HLA knockouts in cell therapy
acctggcagcgggatgggga

SEQ ID NO: 19630 - DNA, 20 bp, Artificial Sequence
  Artificial sequence related to HLA knockouts in cell therapy
cctggcagcgggatggggag

SEQ ID NO: 19631 - DNA, 20 bp, Artificial Sequence
  Artificial sequence related to HLA knockouts in cell therapy
ctggcagcgggatggggagg

SEQ ID NO: 19632 - DNA, 20 bp, Artificial Sequence
  Artificial sequence related to HLA knockouts in cell therapy
tggcagcgggatggggagga

SEQ ID NO: 19633 - DNA, 20 bp, Artificial Sequence
  Artificial sequence related to HLA knockouts in cell therapy
ggcagcgggatggggaggac

SEQ ID NO: 19634 - DNA, 20 bp, Artificial Sequence
  Artificial sequence related to HLA knockouts in cell therapy
gcagcgggatggggaggacc

SEQ ID NO: 19635 - DNA, 20 bp, Artificial Sequence
  Artificial sequence related to HLA knockouts in cell therapy
cagcgggatggggaggacca

SEQ ID NO: 19636 - DNA, 20 bp, Artificial Sequence
  Artificial sequence related to HLA knockouts in cell therapy
agcgggatggggaggaccag

SEQ ID NO: 19637 - DNA, 20 bp, Artificial Sequence
  Artificial sequence related to HLA knockouts in cell therapy
gcgggatggggaggaccaga

SEQ ID NO: 19638 - DNA, 20 bp, Artificial Sequence
  Artificial sequence related to HLA knockouts in cell therapy
cgggatggggaggaccagac

SEQ ID NO: 19639 - DNA, 20 bp, Artificial Sequence
  Artificial sequence related to HLA knockouts in cell therapy
gggatggggaggaccagacc

SEQ ID NO: 19640 - DNA, 20 bp, Artificial Sequence
  Artificial sequence related to HLA knockouts in cell therapy
ggatggggaggaccagaccc

SEQ ID NO: 19641 - DNA, 20 bp, Artificial Sequence
  Artificial sequence related to HLA knockouts in cell therapy
gatggggaggaccagaccca

SEQ ID NO: 19642 - DNA, 20 bp, Artificial Sequence
  Artificial sequence related to HLA knockouts in cell therapy
atggggaggaccagacccag

SEQ ID NO: 19643 - DNA, 20 bp, Artificial Sequence
  Artificial sequence related to HLA knockouts in cell therapy
tggggaggaccagacccagg

SEQ ID NO: 19644 - DNA, 20 bp, Artificial Sequence
  Artificial sequence related to HLA knockouts in cell therapy
ggggaggaccagacccagga

SEQ ID NO: 19645 - DNA, 20 bp, Artificial Sequence
  Artificial sequence related to HLA knockouts in cell therapy
gggaggaccagacccaggac

SEQ ID NO: 19646 - DNA, 20 bp, Artificial Sequence
  Artificial sequence related to HLA knockouts in cell therapy
ggaggaccagacccaggaca

SEQ ID NO: 19647 - DNA, 20 bp, Artificial Sequence
  Artificial sequence related to HLA knockouts in cell therapy
gaggaccagacccaggacac

SEQ ID NO: 19648 - DNA, 20 bp, Artificial Sequence
  Artificial sequence related to HLA knockouts in cell therapy
aggaccagacccaggacacg

SEQ ID NO: 19649 - DNA, 20 bp, Artificial Sequence
  Artificial sequence related to HLA knockouts in cell therapy
ggaccagacccaggacacgg

SEQ ID NO: 19650 - DNA, 20 bp, Artificial Sequence
  Artificial sequence related to HLA knockouts in cell therapy
gaccagacccaggacacgga

SEQ ID NO: 19651 - DNA, 20 bp, Artificial Sequence
  Artificial sequence related to HLA knockouts in cell therapy
accagacccaggacacggag

SEQ ID NO: 19652 - DNA, 20 bp, Artificial Sequence
  Artificial sequence related to HLA knockouts in cell therapy
ccagacccaggacacggagc

SEQ ID NO: 19653 - DNA, 20 bp, Artificial Sequence
  Artificial sequence related to HLA knockouts in cell therapy
cagacccaggacacggagct

SEQ ID NO: 19654 - DNA, 20 bp, Artificial Sequence
  Artificial sequence related to HLA knockouts in cell therapy
agacccaggacacggagctc

SEQ ID NO: 19655 - DNA, 20 bp, Artificial Sequence
  Artificial sequence related to HLA knockouts in cell therapy
gacccaggacacggagctcg

SEQ ID NO: 19656 - DNA, 20 bp, Artificial Sequence
  Artificial sequence related to HLA knockouts in cell therapy
acccaggacacggagctcgt

SEQ ID NO: 19657 - DNA, 20 bp, Artificial Sequence
  Artificial sequence related to HLA knockouts in cell therapy
cccaggacacggagctcgtg

SEQ ID NO: 19658 - DNA, 20 bp, Artificial Sequence
  Artificial sequence related to HLA knockouts in cell therapy
ccaggacacggagctcgtgg

SEQ ID NO: 19659 - DNA, 20 bp, Artificial Sequence
  Artificial sequence related to HLA knockouts in cell therapy
caggacacggagctcgtgga

SEQ ID NO: 19660 - DNA, 20 bp, Artificial Sequence
  Artificial sequence related to HLA knockouts in cell therapy
aggacacggagctcgtggag

SEQ ID NO: 19661 - DNA, 20 bp, Artificial Sequence
  Artificial sequence related to HLA knockouts in cell therapy
ggacacggagctcgtggaga

SEQ ID NO: 19662 - DNA, 20 bp, Artificial Sequence
  Artificial sequence related to HLA knockouts in cell therapy
gacacggagctcgtggagac

SEQ ID NO: 19663 - DNA, 20 bp, Artificial Sequence
  Artificial sequence related to HLA knockouts in cell therapy
acacggagctcgtggagacc

SEQ ID NO: 19664 - DNA, 20 bp, Artificial Sequence
  Artificial sequence related to HLA knockouts in cell therapy
cacggagctcgtggagacca

SEQ ID NO: 19665 - DNA, 20 bp, Artificial Sequence
  Artificial sequence related to HLA knockouts in cell therapy
acggagctcgtggagaccag

SEQ ID NO: 19666 - DNA, 20 bp, Artificial Sequence
  Artificial sequence related to HLA knockouts in cell therapy
cggagctcgtggagaccagg

SEQ ID NO: 19667 - DNA, 20 bp, Artificial Sequence
  Artificial sequence related to HLA knockouts in cell therapy
ggagctcgtggagaccaggc

SEQ ID NO: 19668 - DNA, 20 bp, Artificial Sequence
  Artificial sequence related to HLA knockouts in cell therapy
gagctcgtggagaccaggcc

SEQ ID NO: 19669 - DNA, 20 bp, Artificial Sequence
  Artificial sequence related to HLA knockouts in cell therapy
agctcgtggagaccaggcct

SEQ ID NO: 19670 - DNA, 20 bp, Artificial Sequence
  Artificial sequence related to HLA knockouts in cell therapy
gctcgtggagaccaggcctg

SEQ ID NO: 19671 - DNA, 20 bp, Artificial Sequence
  Artificial sequence related to HLA knockouts in cell therapy
ctcgtggagaccaggcctgc

SEQ ID NO: 19672 - DNA, 20 bp, Artificial Sequence
  Artificial sequence related to HLA knockouts in cell therapy
tcgtggagaccaggcctgca

SEQ ID NO: 19673 - DNA, 20 bp, Artificial Sequence
  Artificial sequence related to HLA knockouts in cell therapy
cgtggagaccaggcctgcag

SEQ ID NO: 19674 - DNA, 20 bp, Artificial Sequence
  Artificial sequence related to HLA knockouts in cell therapy
gtggagaccaggcctgcagg

SEQ ID NO: 19675 - DNA, 20 bp, Artificial Sequence
  Artificial sequence related to HLA knockouts in cell therapy
tggagaccaggcctgcaggg

SEQ ID NO: 19676 - DNA, 20 bp, Artificial Sequence
  Artificial sequence related to HLA knockouts in cell therapy
ggagaccaggcctgcagggg

SEQ ID NO: 19677 - DNA, 20 bp, Artificial Sequence
  Artificial sequence related to HLA knockouts in cell therapy
gagaccaggcctgcagggga

SEQ ID NO: 19678 - DNA, 20 bp, Artificial Sequence
  Artificial sequence related to HLA knockouts in cell therapy
agaccaggcctgcaggggat

SEQ ID NO: 19679 - DNA, 20 bp, Artificial Sequence
  Artificial sequence related to HLA knockouts in cell therapy
gaccaggcctgcaggggatg

SEQ ID NO: 19680 - DNA, 20 bp, Artificial Sequence
  Artificial sequence related to HLA knockouts in cell therapy
accaggcctgcaggggatgg

SEQ ID NO: 19681 - DNA, 20 bp, Artificial Sequence
  Artificial sequence related to HLA knockouts in cell therapy
ccaggcctgcaggggatgga

SEQ ID NO: 19682 - DNA, 20 bp, Artificial Sequence
  Artificial sequence related to HLA knockouts in cell therapy
caggcctgcaggggatggaa

SEQ ID NO: 19683 - DNA, 20 bp, Artificial Sequence
  Artificial sequence related to HLA knockouts in cell therapy
aggcctgcaggggatggaac

SEQ ID NO: 19684 - DNA, 20 bp, Artificial Sequence
  Artificial sequence related to HLA knockouts in cell therapy
ggcctgcaggggatggaacc

SEQ ID NO: 19685 - DNA, 20 bp, Artificial Sequence
  Artificial sequence related to HLA knockouts in cell therapy
gcctgcaggggatggaacct

SEQ ID NO: 19686 - DNA, 20 bp, Artificial Sequence
  Artificial sequence related to HLA knockouts in cell therapy
cctgcaggggatggaacctt

SEQ ID NO: 19687 - DNA, 20 bp, Artificial Sequence
  Artificial sequence related to HLA knockouts in cell therapy
ctgcaggggatggaaccttc

SEQ ID NO: 19688 - DNA, 20 bp, Artificial Sequence
  Artificial sequence related to HLA knockouts in cell therapy
tgcaggggatggaaccttcc

SEQ ID NO: 19689 - DNA, 20 bp, Artificial Sequence
  Artificial sequence related to HLA knockouts in cell therapy
gcaggggatggaaccttcca

SEQ ID NO: 19690 - DNA, 20 bp, Artificial Sequence
  Artificial sequence related to HLA knockouts in cell therapy
caggggatggaaccttccag

SEQ ID NO: 19691 - DNA, 20 bp, Artificial Sequence
  Artificial sequence related to HLA knockouts in cell therapy
ggaaccttccagaagtgggc

SEQ ID NO: 19692 - DNA, 20 bp, Artificial Sequence
  Artificial sequence related to HLA knockouts in cell therapy
gaaccttccagaagtgggcg

SEQ ID NO: 19693 - DNA, 20 bp, Artificial Sequence
  Artificial sequence related to HLA knockouts in cell therapy
aaccttccagaagtgggcgg

SEQ ID NO: 19694 - DNA, 20 bp, Artificial Sequence
  Artificial sequence related to HLA knockouts in cell therapy
accttccagaagtgggcggc

SEQ ID NO: 19695 - DNA, 20 bp, Artificial Sequence
  Artificial sequence related to HLA knockouts in cell therapy
ccttccagaagtgggcggct

SEQ ID NO: 19696 - DNA, 20 bp, Artificial Sequence
  Artificial sequence related to HLA knockouts in cell therapy
cttccagaagtgggcggctg

SEQ ID NO: 19697 - DNA, 20 bp, Artificial Sequence
  Artificial sequence related to HLA knockouts in cell therapy
ttccagaagtgggcggctgt

SEQ ID NO: 19698 - DNA, 20 bp, Artificial Sequence
  Artificial sequence related to HLA knockouts in cell therapy
tccagaagtgggcggctgtg

SEQ ID NO: 19699 - DNA, 20 bp, Artificial Sequence
  Artificial sequence related to HLA knockouts in cell therapy
ccagaagtgggcggctgtgg

SEQ ID NO: 19700 - DNA, 20 bp, Artificial Sequence
  Artificial sequence related to HLA knockouts in cell therapy
cagaagtgggcggctgtggt

SEQ ID NO: 19701 - DNA, 20 bp, Artificial Sequence
  Artificial sequence related to HLA knockouts in cell therapy
agaagtgggcggctgtggtg

SEQ ID NO: 19702 - DNA, 20 bp, Artificial Sequence
  Artificial sequence related to HLA knockouts in cell therapy
gaagtgggcggctgtggtgg

SEQ ID NO: 19703 - DNA, 20 bp, Artificial Sequence
  Artificial sequence related to HLA knockouts in cell therapy
aagtgggcggctgtggtggt

SEQ ID NO: 19704 - DNA, 20 bp, Artificial Sequence
  Artificial sequence related to HLA knockouts in cell therapy
agtgggcggctgtggtggtg

SEQ ID NO: 19705 - DNA, 20 bp, Artificial Sequence
  Artificial sequence related to HLA knockouts in cell therapy
gtgggcggctgtggtggtgc

SEQ ID NO: 19706 - DNA, 20 bp, Artificial Sequence
  Artificial sequence related to HLA knockouts in cell therapy
tgggcggctgtggtggtgcc

SEQ ID NO: 19707 - DNA, 20 bp, Artificial Sequence
  Artificial sequence related to HLA knockouts in cell therapy
gggcggctgtggtggtgcct

SEQ ID NO: 19708 - DNA, 20 bp, Artificial Sequence
  Artificial sequence related to HLA knockouts in cell therapy
ggcggctgtggtggtgcctt

SEQ ID NO: 19709 - DNA, 20 bp, Artificial Sequence
  Artificial sequence related to HLA knockouts in cell therapy
gcggctgtggtggtgccttc

SEQ ID NO: 19710 - DNA, 20 bp, Artificial Sequence
  Artificial sequence related to HLA knockouts in cell therapy
cggctgtggtggtgccttct

SEQ ID NO: 19711 - DNA, 20 bp, Artificial Sequence
  Artificial sequence related to HLA knockouts in cell therapy
ggctgtggtggtgccttctg

SEQ ID NO: 19712 - DNA, 20 bp, Artificial Sequence
  Artificial sequence related to HLA knockouts in cell therapy
ctgtggtggtgccttctgga

SEQ ID NO: 19713 - DNA, 20 bp, Artificial Sequence
  Artificial sequence related to HLA knockouts in cell therapy
tgtggtggtgccttctggac

SEQ ID NO: 19714 - DNA, 20 bp, Artificial Sequence
  Artificial sequence related to HLA knockouts in cell therapy
gtggtggtgccttctggaca

SEQ ID NO: 19715 - DNA, 20 bp, Artificial Sequence
  Artificial sequence related to HLA knockouts in cell therapy
tggtggtgccttctggacag

SEQ ID NO: 19716 - DNA, 20 bp, Artificial Sequence
  Artificial sequence related to HLA knockouts in cell therapy
ggtggtgccttctggacagg

SEQ ID NO: 19717 - DNA, 20 bp, Artificial Sequence
  Artificial sequence related to HLA knockouts in cell therapy
gtggtgccttctggacagga

SEQ ID NO: 19718 - DNA, 20 bp, Artificial Sequence
  Artificial sequence related to HLA knockouts in cell therapy
tggtgccttctggacaggag

SEQ ID NO: 19719 - DNA, 20 bp, Artificial Sequence
  Artificial sequence related to HLA knockouts in cell therapy
ggtgccttctggacaggagc

SEQ ID NO: 19720 - DNA, 20 bp, Artificial Sequence
  Artificial sequence related to HLA knockouts in cell therapy
gtgccttctggacaggagca

SEQ ID NO: 19721 - DNA, 20 bp, Artificial Sequence
  Artificial sequence related to HLA knockouts in cell therapy
tgccttctggacaggagcag

SEQ ID NO: 19722 - DNA, 20 bp, Artificial Sequence
  Artificial sequence related to HLA knockouts in cell therapy
gccttctggacaggagcaga

SEQ ID NO: 19723 - DNA, 20 bp, Artificial Sequence
  Artificial sequence related to HLA knockouts in cell therapy
ccttctggacaggagcagag

SEQ ID NO: 19724 - DNA, 20 bp, Artificial Sequence
  Artificial sequence related to HLA knockouts in cell therapy
ggagcagagatacacctgcc

SEQ ID NO: 19725 - DNA, 20 bp, Artificial Sequence
  Artificial sequence related to HLA knockouts in cell therapy
cacctgccatgtgcagcatg

SEQ ID NO: 19726 - DNA, 20 bp, Artificial Sequence
  Artificial sequence related to HLA knockouts in cell therapy
cctgccatgtgcagcatgag

SEQ ID NO: 19727 - DNA, 20 bp, Artificial Sequence
  Artificial sequence related to HLA knockouts in cell therapy
ctgccatgtgcagcatgagg

SEQ ID NO: 19728 - DNA, 20 bp, Artificial Sequence
  Artificial sequence related to HLA knockouts in cell therapy
tgccatgtgcagcatgaggg

SEQ ID NO: 19729 - DNA, 20 bp, Artificial Sequence
  Artificial sequence related to HLA knockouts in cell therapy
gccatgtgcagcatgagggt

SEQ ID NO: 19730 - DNA, 20 bp, Artificial Sequence
  Artificial sequence related to HLA knockouts in cell therapy
gtgcagcatgagggtttgcc

SEQ ID NO: 19731 - DNA, 20 bp, Artificial Sequence
  Artificial sequence related to HLA knockouts in cell therapy
tgcagcatgagggtttgccc

SEQ ID NO: 19732 - DNA, 20 bp, Artificial Sequence
  Artificial sequence related to HLA knockouts in cell therapy
gcagcatgagggtttgccca

SEQ ID NO: 19733 - DNA, 20 bp, Artificial Sequence
  Artificial sequence related to HLA knockouts in cell therapy
gcatgagggtttgcccaagc

SEQ ID NO: 19734 - DNA, 20 bp, Artificial Sequence
  Artificial sequence related to HLA knockouts in cell therapy
catgagggtttgcccaagcc

SEQ ID NO: 19735 - DNA, 20 bp, Artificial Sequence
  Artificial sequence related to HLA knockouts in cell therapy
atgagggtttgcccaagccc

SEQ ID NO: 19736 - DNA, 20 bp, Artificial Sequence
  Artificial sequence related to HLA knockouts in cell therapy
tgagggtttgcccaagcccc

SEQ ID NO: 19737 - DNA, 20 bp, Artificial Sequence
  Artificial sequence related to HLA knockouts in cell therapy
gagggtttgcccaagcccct

SEQ ID NO: 19738 - DNA, 20 bp, Artificial Sequence
  Artificial sequence related to HLA knockouts in cell therapy
agggtttgcccaagcccctc

SEQ ID NO: 19739 - DNA, 20 bp, Artificial Sequence
  Artificial sequence related to HLA knockouts in cell therapy
gggtttgcccaagcccctca

SEQ ID NO: 19740 - DNA, 20 bp, Artificial Sequence
  Artificial sequence related to HLA knockouts in cell therapy
ggtttgcccaagcccctcac

SEQ ID NO: 19741 - DNA, 20 bp, Artificial Sequence
  Artificial sequence related to HLA knockouts in cell therapy
gtttgcccaagcccctcacc

SEQ ID NO: 19742 - DNA, 20 bp, Artificial Sequence
  Artificial sequence related to HLA knockouts in cell therapy
tttgcccaagcccctcaccc

SEQ ID NO: 19743 - DNA, 20 bp, Artificial Sequence
  Artificial sequence related to HLA knockouts in cell therapy
ttgcccaagcccctcaccct

SEQ ID NO: 19744 - DNA, 20 bp, Artificial Sequence
  Artificial sequence related to HLA knockouts in cell therapy
tgcccaagcccctcaccctg

SEQ ID NO: 19745 - DNA, 20 bp, Artificial Sequence
  Artificial sequence related to HLA knockouts in cell therapy
gcccaagcccctcaccctga

SEQ ID NO: 19746 - DNA, 20 bp, Artificial Sequence
  Artificial sequence related to HLA knockouts in cell therapy
cccaagcccctcaccctgag

SEQ ID NO: 19747 - DNA, 20 bp, Artificial Sequence
  Artificial sequence related to HLA knockouts in cell therapy
ccaagcccctcaccctgaga

SEQ ID NO: 19748 - DNA, 20 bp, Artificial Sequence
  Artificial sequence related to HLA knockouts in cell therapy
caagcccctcaccctgagat

SEQ ID NO: 19749 - DNA, 20 bp, Artificial Sequence
  Artificial sequence related to HLA knockouts in cell therapy
aagcccctcaccctgagatg

SEQ ID NO: 19750 - DNA, 20 bp, Artificial Sequence
  Artificial sequence related to HLA knockouts in cell therapy
agcccctcaccctgagatgg

SEQ ID NO: 19751 - DNA, 20 bp, Artificial Sequence
  Artificial sequence related to HLA knockouts in cell therapy
gcccctcaccctgagatggg

SEQ ID NO: 19752 - DNA, 20 bp, Artificial Sequence
  Artificial sequence related to HLA knockouts in cell therapy
cccctcaccctgagatggga

SEQ ID NO: 19753 - DNA, 20 bp, Artificial Sequence
  Artificial sequence related to HLA knockouts in cell therapy
ccctcaccctgagatgggag

SEQ ID NO: 19754 - DNA, 20 bp, Artificial Sequence
  Artificial sequence related to HLA knockouts in cell therapy
cctcaccctgagatgggagc

SEQ ID NO: 19755 - DNA, 20 bp, Artificial Sequence
  Artificial sequence related to HLA knockouts in cell therapy
ctcaccctgagatgggagcc

SEQ ID NO: 19756 - DNA, 20 bp, Artificial Sequence
  Artificial sequence related to HLA knockouts in cell therapy
tcaccctgagatgggagccg

SEQ ID NO: 19757 - DNA, 20 bp, Artificial Sequence
  Artificial sequence related to HLA knockouts in cell therapy
caccctgagatgggagccgt

SEQ ID NO: 19758 - DNA, 20 bp, Artificial Sequence
  Artificial sequence related to HLA knockouts in cell therapy
accctgagatgggagccgtc

SEQ ID NO: 19759 - DNA, 20 bp, Artificial Sequence
  Artificial sequence related to HLA knockouts in cell therapy
ccctgagatgggagccgtct

SEQ ID NO: 19760 - DNA, 20 bp, Artificial Sequence
  Artificial sequence related to HLA knockouts in cell therapy
cctgagatgggagccgtctt

SEQ ID NO: 19761 - DNA, 20 bp, Artificial Sequence
  Artificial sequence related to HLA knockouts in cell therapy
ctgagatgggagccgtcttc

SEQ ID NO: 19762 - DNA, 20 bp, Artificial Sequence
  Artificial sequence related to HLA knockouts in cell therapy
tgagatgggagccgtcttcc

SEQ ID NO: 19763 - DNA, 20 bp, Artificial Sequence
  Artificial sequence related to HLA knockouts in cell therapy
gagatgggagccgtcttccc

SEQ ID NO: 19764 - DNA, 20 bp, Artificial Sequence
  Artificial sequence related to HLA knockouts in cell therapy
agatgggagccgtcttccca

SEQ ID NO: 19765 - DNA, 20 bp, Artificial Sequence
  Artificial sequence related to HLA knockouts in cell therapy
gatgggagccgtcttcccag

SEQ ID NO: 19766 - DNA, 20 bp, Artificial Sequence
  Artificial sequence related to HLA knockouts in cell therapy
atgggagccgtcttcccagc

SEQ ID NO: 19767 - DNA, 20 bp, Artificial Sequence
  Artificial sequence related to HLA knockouts in cell therapy
tgggagccgtcttcccagcc

SEQ ID NO: 19768 - DNA, 20 bp, Artificial Sequence
  Artificial sequence related to HLA knockouts in cell therapy
gggagccgtcttcccagccc

SEQ ID NO: 19769 - DNA, 20 bp, Artificial Sequence
  Artificial sequence related to HLA knockouts in cell therapy
ggagccgtcttcccagccca

SEQ ID NO: 19770 - DNA, 20 bp, Artificial Sequence
  Artificial sequence related to HLA knockouts in cell therapy
gagccgtcttcccagcccac

SEQ ID NO: 19771 - DNA, 20 bp, Artificial Sequence
  Artificial sequence related to HLA knockouts in cell therapy
agccgtcttcccagcccacc

SEQ ID NO: 19772 - DNA, 20 bp, Artificial Sequence
  Artificial sequence related to HLA knockouts in cell therapy
gccgtcttcccagcccacca

SEQ ID NO: 19773 - DNA, 20 bp, Artificial Sequence
  Artificial sequence related to HLA knockouts in cell therapy
ccgtcttcccagcccaccat

SEQ ID NO: 19774 - DNA, 20 bp, Artificial Sequence
  Artificial sequence related to HLA knockouts in cell therapy
cgtcttcccagcccaccatc

SEQ ID NO: 19775 - DNA, 20 bp, Artificial Sequence
  Artificial sequence related to HLA knockouts in cell therapy
gtcttcccagcccaccatcc

SEQ ID NO: 19776 - DNA, 20 bp, Artificial Sequence
  Artificial sequence related to HLA knockouts in cell therapy
tcttcccagcccaccatccc

SEQ ID NO: 19777 - DNA, 20 bp, Artificial Sequence
  Artificial sequence related to HLA knockouts in cell therapy
cttcccagcccaccatcccc

SEQ ID NO: 19778 - DNA, 20 bp, Artificial Sequence
  Artificial sequence related to HLA knockouts in cell therapy
ttcccagcccaccatcccca

SEQ ID NO: 19779 - DNA, 20 bp, Artificial Sequence
  Artificial sequence related to HLA knockouts in cell therapy
tcccagcccaccatccccat

SEQ ID NO: 19780 - DNA, 20 bp, Artificial Sequence
  Artificial sequence related to HLA knockouts in cell therapy
cccagcccaccatccccatc

SEQ ID NO: 19781 - DNA, 20 bp, Artificial Sequence
  Artificial sequence related to HLA knockouts in cell therapy
ccagcccaccatccccatcg

SEQ ID NO: 19782 - DNA, 20 bp, Artificial Sequence
  Artificial sequence related to HLA knockouts in cell therapy
cagcccaccatccccatcgt

SEQ ID NO: 19783 - DNA, 20 bp, Artificial Sequence
  Artificial sequence related to HLA knockouts in cell therapy
agcccaccatccccatcgtg

SEQ ID NO: 19784 - DNA, 20 bp, Artificial Sequence
  Artificial sequence related to HLA knockouts in cell therapy
gcccaccatccccatcgtgg

SEQ ID NO: 19785 - DNA, 20 bp, Artificial Sequence
  Artificial sequence related to HLA knockouts in cell therapy
cccaccatccccatcgtggg

SEQ ID NO: 19786 - DNA, 20 bp, Artificial Sequence
  Artificial sequence related to HLA knockouts in cell therapy
ccaccatccccatcgtgggc

SEQ ID NO: 19787 - DNA, 20 bp, Artificial Sequence
  Artificial sequence related to HLA knockouts in cell therapy
caccatccccatcgtgggca

SEQ ID NO: 19788 - DNA, 20 bp, Artificial Sequence
  Artificial sequence related to HLA knockouts in cell therapy
accatccccatcgtgggcat

SEQ ID NO: 19789 - DNA, 20 bp, Artificial Sequence
  Artificial sequence related to HLA knockouts in cell therapy
ccatccccatcgtgggcatc

SEQ ID NO: 19790 - DNA, 20 bp, Artificial Sequence
  Artificial sequence related to HLA knockouts in cell therapy
catccccatcgtgggcatca

SEQ ID NO: 19791 - DNA, 20 bp, Artificial Sequence
  Artificial sequence related to HLA knockouts in cell therapy
ccccatcgtgggcatcattg

SEQ ID NO: 19792 - DNA, 20 bp, Artificial Sequence
  Artificial sequence related to HLA knockouts in cell therapy
cccatcgtgggcatcattgc

SEQ ID NO: 19793 - DNA, 20 bp, Artificial Sequence
  Artificial sequence related to HLA knockouts in cell therapy
tcgtgggcatcattgctggc

SEQ ID NO: 19794 - DNA, 20 bp, Artificial Sequence
  Artificial sequence related to HLA knockouts in cell therapy
cgtgggcatcattgctggcc

SEQ ID NO: 19795 - DNA, 20 bp, Artificial Sequence
  Artificial sequence related to HLA knockouts in cell therapy
gtgggcatcattgctggcct

SEQ ID NO: 19796 - DNA, 20 bp, Artificial Sequence
  Artificial sequence related to HLA knockouts in cell therapy
tgggcatcattgctggcctg

SEQ ID NO: 19797 - DNA, 20 bp, Artificial Sequence
  Artificial sequence related to HLA knockouts in cell therapy
gggcatcattgctggcctgg

SEQ ID NO: 19798 - DNA, 20 bp, Artificial Sequence
  Artificial sequence related to HLA knockouts in cell therapy
ggcatcattgctggcctggt

SEQ ID NO: 19799 - DNA, 20 bp, Artificial Sequence
  Artificial sequence related to HLA knockouts in cell therapy
gctggcctggttctctttgg

SEQ ID NO: 19800 - DNA, 20 bp, Artificial Sequence
  Artificial sequence related to HLA knockouts in cell therapy
ggcctggttctctttggagc

SEQ ID NO: 19801 - DNA, 20 bp, Artificial Sequence
  Artificial sequence related to HLA knockouts in cell therapy
ggagctgtgatcactggagc

SEQ ID NO: 19802 - DNA, 20 bp, Artificial Sequence
  Artificial sequence related to HLA knockouts in cell therapy
gatcactggagctgtggtcg

SEQ ID NO: 19803 - DNA, 20 bp, Artificial Sequence
  Artificial sequence related to HLA knockouts in cell therapy
atcactggagctgtggtcgc

SEQ ID NO: 19804 - DNA, 20 bp, Artificial Sequence
  Artificial sequence related to HLA knockouts in cell therapy
tcactggagctgtggtcgct

SEQ ID NO: 19805 - DNA, 20 bp, Artificial Sequence
  Artificial sequence related to HLA knockouts in cell therapy
cactggagctgtggtcgctg

SEQ ID NO: 19806 - DNA, 20 bp, Artificial Sequence
  Artificial sequence related to HLA knockouts in cell therapy
actggagctgtggtcgctgc

SEQ ID NO: 19807 - DNA, 20 bp, Artificial Sequence
  Artificial sequence related to HLA knockouts in cell therapy
ctggagctgtggtcgctgct

SEQ ID NO: 19808 - DNA, 20 bp, Artificial Sequence
  Artificial sequence related to HLA knockouts in cell therapy
tggagctgtggtcgctgctg

SEQ ID NO: 19809 - DNA, 20 bp, Artificial Sequence
  Artificial sequence related to HLA knockouts in cell therapy
ggagctgtggtcgctgctgt

SEQ ID NO: 19810 - DNA, 20 bp, Artificial Sequence
  Artificial sequence related to HLA knockouts in cell therapy
gagctgtggtcgctgctgtg

SEQ ID NO: 19811 - DNA, 20 bp, Artificial Sequence
  Artificial sequence related to HLA knockouts in cell therapy
agctgtggtcgctgctgtga

SEQ ID NO: 19812 - DNA, 20 bp, Artificial Sequence
  Artificial sequence related to HLA knockouts in cell therapy
gctgtggtcgctgctgtgat

SEQ ID NO: 19813 - DNA, 20 bp, Artificial Sequence
  Artificial sequence related to HLA knockouts in cell therapy
ctgtggtcgctgctgtgatg

SEQ ID NO: 19814 - DNA, 20 bp, Artificial Sequence
  Artificial sequence related to HLA knockouts in cell therapy
gtggtcgctgctgtgatgtg

SEQ ID NO: 19815 - DNA, 20 bp, Artificial Sequence
  Artificial sequence related to HLA knockouts in cell therapy
tggtcgctgctgtgatgtgg

SEQ ID NO: 19816 - DNA, 20 bp, Artificial Sequence
  Artificial sequence related to HLA knockouts in cell therapy
ggtcgctgctgtgatgtgga

SEQ ID NO: 19817 - DNA, 20 bp, Artificial Sequence
  Artificial sequence related to HLA knockouts in cell therapy
gtcgctgctgtgatgtggag

SEQ ID NO: 19818 - DNA, 20 bp, Artificial Sequence
  Artificial sequence related to HLA knockouts in cell therapy
tcgctgctgtgatgtggagg

SEQ ID NO: 19819 - DNA, 20 bp, Artificial Sequence
  Artificial sequence related to HLA knockouts in cell therapy
cgctgctgtgatgtggagga

SEQ ID NO: 19820 - DNA, 20 bp, Artificial Sequence
  Artificial sequence related to HLA knockouts in cell therapy
gctgctgtgatgtggaggag

SEQ ID NO: 19821 - DNA, 20 bp, Artificial Sequence
  Artificial sequence related to HLA knockouts in cell therapy
ctgctgtgatgtggaggagg

SEQ ID NO: 19822 - DNA, 20 bp, Artificial Sequence
  Artificial sequence related to HLA knockouts in cell therapy
gtggaggaggaagagctcag

SEQ ID NO: 19823 - DNA, 20 bp, Artificial Sequence
  Artificial sequence related to HLA knockouts in cell therapy
aggagggagctactctcagg

SEQ ID NO: 19824 - DNA, 20 bp, Artificial Sequence
  Artificial sequence related to HLA knockouts in cell therapy
ggagggagctactctcaggc

SEQ ID NO: 19825 - DNA, 20 bp, Artificial Sequence
  Artificial sequence related to HLA knockouts in cell therapy
gagggagctactctcaggct

SEQ ID NO: 19826 - DNA, 20 bp, Artificial Sequence
  Artificial sequence related to HLA knockouts in cell therapy
agggagctactctcaggctg

SEQ ID NO: 19827 - DNA, 20 bp, Artificial Sequence
  Artificial sequence related to HLA knockouts in cell therapy
gggagctactctcaggctgc

SEQ ID NO: 19828 - DNA, 20 bp, Artificial Sequence
  Artificial sequence related to HLA knockouts in cell therapy
ggagctactctcaggctgca

SEQ ID NO: 19829 - DNA, 20 bp, Artificial Sequence
  Artificial sequence related to HLA knockouts in cell therapy
gctactctcaggctgcaagc

SEQ ID NO: 19830 - DNA, 20 bp, Artificial Sequence
  Artificial sequence related to HLA knockouts in cell therapy
ctctcaggctgcaagcagtg

SEQ ID NO: 19831 - DNA, 20 bp, Artificial Sequence
  Artificial sequence related to HLA knockouts in cell therapy
ctcaggctgcaagcagtgac

SEQ ID NO: 19832 - DNA, 20 bp, Artificial Sequence
  Artificial sequence related to HLA knockouts in cell therapy
caggctgcaagcagtgacag

SEQ ID NO: 19833 - DNA, 20 bp, Artificial Sequence
  Artificial sequence related to HLA knockouts in cell therapy
ggctgcaagcagtgacagtg

SEQ ID NO: 19834 - DNA, 20 bp, Artificial Sequence
  Artificial sequence related to HLA knockouts in cell therapy
gctgcaagcagtgacagtgc

SEQ ID NO: 19835 - DNA, 20 bp, Artificial Sequence
  Artificial sequence related to HLA knockouts in cell therapy
ctgcaagcagtgacagtgcc

SEQ ID NO: 19836 - DNA, 20 bp, Artificial Sequence
  Artificial sequence related to HLA knockouts in cell therapy
tgcaagcagtgacagtgccc

SEQ ID NO: 19837 - DNA, 20 bp, Artificial Sequence
  Artificial sequence related to HLA knockouts in cell therapy
gcaagcagtgacagtgccca

SEQ ID NO: 19838 - DNA, 20 bp, Artificial Sequence
  Artificial sequence related to HLA knockouts in cell therapy
caagcagtgacagtgcccag

SEQ ID NO: 19839 - DNA, 20 bp, Artificial Sequence
  Artificial sequence related to HLA knockouts in cell therapy
aagcagtgacagtgcccagg

SEQ ID NO: 19840 - DNA, 20 bp, Artificial Sequence
  Artificial sequence related to HLA knockouts in cell therapy
agcagtgacagtgcccaggg

SEQ ID NO: 19841 - DNA, 20 bp, Artificial Sequence
  Artificial sequence related to HLA knockouts in cell therapy
gcagtgacagtgcccagggc

SEQ ID NO: 19842 - DNA, 20 bp, Artificial Sequence
  Artificial sequence related to HLA knockouts in cell therapy
cagtgacagtgcccagggct

SEQ ID NO: 19843 - DNA, 20 bp, Artificial Sequence
  Artificial sequence related to HLA knockouts in cell therapy
agtgacagtgcccagggctc

SEQ ID NO: 19844 - DNA, 20 bp, Artificial Sequence
  Artificial sequence related to HLA knockouts in cell therapy
gtgacagtgcccagggctct

SEQ ID NO: 19845 - DNA, 20 bp, Artificial Sequence
  Artificial sequence related to HLA knockouts in cell therapy
tgacagtgcccagggctctg

SEQ ID NO: 19846 - DNA, 20 bp, Artificial Sequence
  Artificial sequence related to HLA knockouts in cell therapy
gacagtgcccagggctctga

SEQ ID NO: 19847 - DNA, 20 bp, Artificial Sequence
  Artificial sequence related to HLA knockouts in cell therapy
acagtgcccagggctctgat

SEQ ID NO: 19848 - DNA, 20 bp, Artificial Sequence
  Artificial sequence related to HLA knockouts in cell therapy
cagtgcccagggctctgatg

SEQ ID NO: 19849 - DNA, 20 bp, Artificial Sequence
  Artificial sequence related to HLA knockouts in cell therapy
agtgcccagggctctgatgt

SEQ ID NO: 19850 - DNA, 20 bp, Artificial Sequence
  Artificial sequence related to HLA knockouts in cell therapy
gtgcccagggctctgatgtg

SEQ ID NO: 19851 - DNA, 20 bp, Artificial Sequence
  Artificial sequence related to HLA knockouts in cell therapy
tgcccagggctctgatgtgt

SEQ ID NO: 19852 - DNA, 20 bp, Artificial Sequence
  Artificial sequence related to HLA knockouts in cell therapy
gcccagggctctgatgtgtc

SEQ ID NO: 19853 - DNA, 20 bp, Artificial Sequence
  Artificial sequence related to HLA knockouts in cell therapy
cccagggctctgatgtgtct

SEQ ID NO: 19854 - DNA, 20 bp, Artificial Sequence
  Artificial sequence related to HLA knockouts in cell therapy
ccagggctctgatgtgtctc

SEQ ID NO: 19855 - DNA, 20 bp, Artificial Sequence
  Artificial sequence related to HLA knockouts in cell therapy
gagacagctgccttgtgtgg

SEQ ID NO: 19856 - DNA, 20 bp, Artificial Sequence
  Artificial sequence related to HLA knockouts in cell therapy
agacagctgccttgtgtggg

SEQ ID NO: 19857 - DNA, 20 bp, Artificial Sequence
  Artificial sequence related to HLA knockouts in cell therapy
gacagctgccttgtgtggga

SEQ ID NO: 19858 - DNA, 20 bp, Artificial Sequence
  Artificial sequence related to HLA knockouts in cell therapy
acagctgccttgtgtgggac

SEQ ID NO: 19859 - DNA, 20 bp, Artificial Sequence
  Artificial sequence related to HLA knockouts in cell therapy
cagctgccttgtgtgggact

SEQ ID NO: 19860 - DNA, 20 bp, Artificial Sequence
  Artificial sequence related to HLA knockouts in cell therapy
agctgccttgtgtgggactg

SEQ ID NO: 19861 - DNA, 20 bp, Artificial Sequence
  Artificial sequence related to HLA knockouts in cell therapy
gctgccttgtgtgggactga

SEQ ID NO: 19862 - DNA, 20 bp, Artificial Sequence
  Artificial sequence related to HLA knockouts in cell therapy
ctgccttgtgtgggactgag

SEQ ID NO: 19863 - DNA, 20 bp, Artificial Sequence
  Artificial sequence related to HLA knockouts in cell therapy
gccttgtgtgggactgagag

SEQ ID NO: 19864 - DNA, 20 bp, Artificial Sequence
  Artificial sequence related to HLA knockouts in cell therapy
ccttgtgtgggactgagagg

SEQ ID NO: 19865 - DNA, 20 bp, Artificial Sequence
  Artificial sequence related to HLA knockouts in cell therapy
cttgtgtgggactgagaggc

SEQ ID NO: 19866 - DNA, 20 bp, Artificial Sequence
  Artificial sequence related to HLA knockouts in cell therapy
gtgtgggactgagaggcaag

SEQ ID NO: 19867 - DNA, 20 bp, Artificial Sequence
  Artificial sequence related to HLA knockouts in cell therapy
gtgggactgagaggcaagag

SEQ ID NO: 19868 - DNA, 20 bp, Artificial Sequence
  Artificial sequence related to HLA knockouts in cell therapy
ggcaagagttgttcctgccc

SEQ ID NO: 19869 - DNA, 20 bp, Artificial Sequence
  Artificial sequence related to HLA knockouts in cell therapy
gagttgttcctgcccttccc

SEQ ID NO: 19870 - DNA, 20 bp, Artificial Sequence
  Artificial sequence related to HLA knockouts in cell therapy
cctgcccttccctttgtgac

SEQ ID NO: 19871 - DNA, 20 bp, Artificial Sequence
  Artificial sequence related to HLA knockouts in cell therapy
ggcacctgcatgtgtctgtg

SEQ ID NO: 19872 - DNA, 20 bp, Artificial Sequence
  Artificial sequence related to HLA knockouts in cell therapy
atgtgaggaggtggggagac

SEQ ID NO: 19873 - DNA, 20 bp, Artificial Sequence
  Artificial sequence related to HLA knockouts in cell therapy
tgtgaggaggtggggagacc

SEQ ID NO: 19874 - DNA, 20 bp, Artificial Sequence
  Artificial sequence related to HLA knockouts in cell therapy
gtgaggaggtggggagacca

SEQ ID NO: 19875 - DNA, 20 bp, Artificial Sequence
  Artificial sequence related to HLA knockouts in cell therapy
tgaggaggtggggagaccac

SEQ ID NO: 19876 - DNA, 20 bp, Artificial Sequence
  Artificial sequence related to HLA knockouts in cell therapy
gaggaggtggggagaccacc

SEQ ID NO: 19877 - DNA, 20 bp, Artificial Sequence
  Artificial sequence related to HLA knockouts in cell therapy
aggaggtggggagaccaccc

SEQ ID NO: 19878 - DNA, 20 bp, Artificial Sequence
  Artificial sequence related to HLA knockouts in cell therapy
ggaggtggggagaccacccc

SEQ ID NO: 19879 - DNA, 20 bp, Artificial Sequence
  Artificial sequence related to HLA knockouts in cell therapy
gaggtggggagaccacccca

SEQ ID NO: 19880 - DNA, 20 bp, Artificial Sequence
  Artificial sequence related to HLA knockouts in cell therapy
aggtggggagaccaccccac

SEQ ID NO: 19881 - DNA, 20 bp, Artificial Sequence
  Artificial sequence related to HLA knockouts in cell therapy
ggtggggagaccaccccacc

SEQ ID NO: 19882 - DNA, 20 bp, Artificial Sequence
  Artificial sequence related to HLA knockouts in cell therapy
gtggggagaccaccccaccc

SEQ ID NO: 19883 - DNA, 20 bp, Artificial Sequence
  Artificial sequence related to HLA knockouts in cell therapy
tggggagaccaccccacccc

SEQ ID NO: 19884 - DNA, 20 bp, Artificial Sequence
  Artificial sequence related to HLA knockouts in cell therapy
ggggagaccaccccaccccc

SEQ ID NO: 19885 - DNA, 20 bp, Artificial Sequence
  Artificial sequence related to HLA knockouts in cell therapy
gggagaccaccccaccccca

SEQ ID NO: 19886 - DNA, 20 bp, Artificial Sequence
  Artificial sequence related to HLA knockouts in cell therapy
ggagaccaccccacccccat

SEQ ID NO: 19887 - DNA, 20 bp, Artificial Sequence
  Artificial sequence related to HLA knockouts in cell therapy
gagaccaccccacccccatg

SEQ ID NO: 19888 - DNA, 20 bp, Artificial Sequence
  Artificial sequence related to HLA knockouts in cell therapy
agaccaccccacccccatgt

SEQ ID NO: 19889 - DNA, 20 bp, Artificial Sequence
  Artificial sequence related to HLA knockouts in cell therapy
gaccaccccacccccatgtc

SEQ ID NO: 19890 - DNA, 20 bp, Artificial Sequence
  Artificial sequence related to HLA knockouts in cell therapy
accaccccacccccatgtcc

SEQ ID NO: 19891 - DNA, 20 bp, Artificial Sequence
  Artificial sequence related to HLA knockouts in cell therapy
ccaccccacccccatgtcca

SEQ ID NO: 19892 - DNA, 20 bp, Artificial Sequence
  Artificial sequence related to HLA knockouts in cell therapy
caccccacccccatgtccac

SEQ ID NO: 19893 - DNA, 20 bp, Artificial Sequence
  Artificial sequence related to HLA knockouts in cell therapy
accccacccccatgtccacc

SEQ ID NO: 19894 - DNA, 20 bp, Artificial Sequence
  Artificial sequence related to HLA knockouts in cell therapy
ccccacccccatgtccacca

SEQ ID NO: 19895 - DNA, 20 bp, Artificial Sequence
  Artificial sequence related to HLA knockouts in cell therapy
cccacccccatgtccaccat

SEQ ID NO: 19896 - DNA, 20 bp, Artificial Sequence
  Artificial sequence related to HLA knockouts in cell therapy
ccacccccatgtccaccatg

SEQ ID NO: 19897 - DNA, 20 bp, Artificial Sequence
  Artificial sequence related to HLA knockouts in cell therapy
cacccccatgtccaccatga

SEQ ID NO: 19898 - DNA, 20 bp, Artificial Sequence
  Artificial sequence related to HLA knockouts in cell therapy
acccccatgtccaccatgac

SEQ ID NO: 19899 - DNA, 20 bp, Artificial Sequence
  Artificial sequence related to HLA knockouts in cell therapy
cccccatgtccaccatgacc

SEQ ID NO: 19900 - DNA, 20 bp, Artificial Sequence
  Artificial sequence related to HLA knockouts in cell therapy
ccccatgtccaccatgaccc

SEQ ID NO: 19901 - DNA, 20 bp, Artificial Sequence
  Artificial sequence related to HLA knockouts in cell therapy
cccatgtccaccatgaccct

SEQ ID NO: 19902 - DNA, 20 bp, Artificial Sequence
  Artificial sequence related to HLA knockouts in cell therapy
ccatgtccaccatgaccctc

SEQ ID NO: 19903 - DNA, 20 bp, Artificial Sequence
  Artificial sequence related to HLA knockouts in cell therapy
gtccaccatgaccctcttcc

SEQ ID NO: 19904 - DNA, 20 bp, Artificial Sequence
  Artificial sequence related to HLA knockouts in cell therapy
tccaccatgaccctcttccc

SEQ ID NO: 19905 - DNA, 20 bp, Artificial Sequence
  Artificial sequence related to HLA knockouts in cell therapy
ccaccatgaccctcttccca

SEQ ID NO: 19906 - DNA, 20 bp, Artificial Sequence
  Artificial sequence related to HLA knockouts in cell therapy
caccatgaccctcttcccac

SEQ ID NO: 19907 - DNA, 20 bp, Artificial Sequence
  Artificial sequence related to HLA knockouts in cell therapy
accatgaccctcttcccacg

SEQ ID NO: 19908 - DNA, 20 bp, Artificial Sequence
  Artificial sequence related to HLA knockouts in cell therapy
ccatgaccctcttcccacgc

SEQ ID NO: 19909 - DNA, 20 bp, Artificial Sequence
  Artificial sequence related to HLA knockouts in cell therapy
catgaccctcttcccacgct

SEQ ID NO: 19910 - DNA, 20 bp, Artificial Sequence
  Artificial sequence related to HLA knockouts in cell therapy
atgaccctcttcccacgctg

SEQ ID NO: 19911 - DNA, 20 bp, Artificial Sequence
  Artificial sequence related to HLA knockouts in cell therapy
tgaccctcttcccacgctga

SEQ ID NO: 19912 - DNA, 20 bp, Artificial Sequence
  Artificial sequence related to HLA knockouts in cell therapy
gaccctcttcccacgctgac

SEQ ID NO: 19913 - DNA, 20 bp, Artificial Sequence
  Artificial sequence related to HLA knockouts in cell therapy
accctcttcccacgctgacc

SEQ ID NO: 19914 - DNA, 20 bp, Artificial Sequence
  Artificial sequence related to HLA knockouts in cell therapy
ccctcttcccacgctgacct

SEQ ID NO: 19915 - DNA, 20 bp, Artificial Sequence
  Artificial sequence related to HLA knockouts in cell therapy
cctcttcccacgctgacctg

SEQ ID NO: 19916 - DNA, 20 bp, Artificial Sequence
  Artificial sequence related to HLA knockouts in cell therapy
ctcttcccacgctgacctgt

SEQ ID NO: 19917 - DNA, 20 bp, Artificial Sequence
  Artificial sequence related to HLA knockouts in cell therapy
tcttcccacgctgacctgtg

SEQ ID NO: 19918 - DNA, 20 bp, Artificial Sequence
  Artificial sequence related to HLA knockouts in cell therapy
cttcccacgctgacctgtgc

SEQ ID NO: 19919 - DNA, 20 bp, Artificial Sequence
  Artificial sequence related to HLA knockouts in cell therapy
ttcccacgctgacctgtgct

SEQ ID NO: 19920 - DNA, 20 bp, Artificial Sequence
  Artificial sequence related to HLA knockouts in cell therapy
tcccacgctgacctgtgctc

SEQ ID NO: 19921 - DNA, 20 bp, Artificial Sequence
  Artificial sequence related to HLA knockouts in cell therapy
cccacgctgacctgtgctcc

SEQ ID NO: 19922 - DNA, 20 bp, Artificial Sequence
  Artificial sequence related to HLA knockouts in cell therapy
ccacgctgacctgtgctccc

SEQ ID NO: 19923 - DNA, 20 bp, Artificial Sequence
  Artificial sequence related to HLA knockouts in cell therapy
cacgctgacctgtgctccct

SEQ ID NO: 19924 - DNA, 20 bp, Artificial Sequence
  Artificial sequence related to HLA knockouts in cell therapy
acgctgacctgtgctccctc

SEQ ID NO: 19925 - DNA, 20 bp, Artificial Sequence
  Artificial sequence related to HLA knockouts in cell therapy
cgctgacctgtgctccctcc

SEQ ID NO: 19926 - DNA, 20 bp, Artificial Sequence
  Artificial sequence related to HLA knockouts in cell therapy
gctgacctgtgctccctccc

SEQ ID NO: 19927 - DNA, 20 bp, Artificial Sequence
  Artificial sequence related to HLA knockouts in cell therapy
ctgacctgtgctccctcccc

SEQ ID NO: 19928 - DNA, 20 bp, Artificial Sequence
  Artificial sequence related to HLA knockouts in cell therapy
tgacctgtgctccctcccca

SEQ ID NO: 19929 - DNA, 20 bp, Artificial Sequence
  Artificial sequence related to HLA knockouts in cell therapy
gacctgtgctccctccccaa

SEQ ID NO: 19930 - DNA, 20 bp, Artificial Sequence
  Artificial sequence related to HLA knockouts in cell therapy
acctgtgctccctccccaat

SEQ ID NO: 19931 - DNA, 20 bp, Artificial Sequence
  Artificial sequence related to HLA knockouts in cell therapy
cctgtgctccctccccaatc

SEQ ID NO: 19932 - DNA, 20 bp, Artificial Sequence
  Artificial sequence related to HLA knockouts in cell therapy
ctgtgctccctccccaatca

SEQ ID NO: 19933 - DNA, 20 bp, Artificial Sequence
  Artificial sequence related to HLA knockouts in cell therapy
gtgctccctccccaatcatc

SEQ ID NO: 19934 - DNA, 20 bp, Artificial Sequence
  Artificial sequence related to HLA knockouts in cell therapy
tcctgttccagagaggtggg

SEQ ID NO: 19935 - DNA, 20 bp, Artificial Sequence
  Artificial sequence related to HLA knockouts in cell therapy
cctgttccagagaggtgggg

SEQ ID NO: 19936 - DNA, 20 bp, Artificial Sequence
  Artificial sequence related to HLA knockouts in cell therapy
ctgttccagagaggtggggc

SEQ ID NO: 19937 - DNA, 20 bp, Artificial Sequence
  Artificial sequence related to HLA knockouts in cell therapy
tgttccagagaggtggggct

SEQ ID NO: 19938 - DNA, 20 bp, Artificial Sequence
  Artificial sequence related to HLA knockouts in cell therapy
gttccagagaggtggggctg

SEQ ID NO: 19939 - DNA, 20 bp, Artificial Sequence
  Artificial sequence related to HLA knockouts in cell therapy
ttccagagaggtggggctga

SEQ ID NO: 19940 - DNA, 20 bp, Artificial Sequence
  Artificial sequence related to HLA knockouts in cell therapy
tccagagaggtggggctgag

SEQ ID NO: 19941 - DNA, 20 bp, Artificial Sequence
  Artificial sequence related to HLA knockouts in cell therapy
ccagagaggtggggctgagg

SEQ ID NO: 19942 - DNA, 20 bp, Artificial Sequence
  Artificial sequence related to HLA knockouts in cell therapy
cagagaggtggggctgaggt

SEQ ID NO: 19943 - DNA, 20 bp, Artificial Sequence
  Artificial sequence related to HLA knockouts in cell therapy
agagaggtggggctgaggtg

SEQ ID NO: 19944 - DNA, 20 bp, Artificial Sequence
  Artificial sequence related to HLA knockouts in cell therapy
gagaggtggggctgaggtgt

SEQ ID NO: 19945 - DNA, 20 bp, Artificial Sequence
  Artificial sequence related to HLA knockouts in cell therapy
agaggtggggctgaggtgtc

SEQ ID NO: 19946 - DNA, 20 bp, Artificial Sequence
  Artificial sequence related to HLA knockouts in cell therapy
gaggtggggctgaggtgtct

SEQ ID NO: 19947 - DNA, 20 bp, Artificial Sequence
  Artificial sequence related to HLA knockouts in cell therapy
aggtggggctgaggtgtctc

SEQ ID NO: 19948 - DNA, 20 bp, Artificial Sequence
  Artificial sequence related to HLA knockouts in cell therapy
ggtggggctgaggtgtctcc

SEQ ID NO: 19949 - DNA, 20 bp, Artificial Sequence
  Artificial sequence related to HLA knockouts in cell therapy
gtggggctgaggtgtctcca

SEQ ID NO: 19950 - DNA, 20 bp, Artificial Sequence
  Artificial sequence related to HLA knockouts in cell therapy
tggggctgaggtgtctccat

SEQ ID NO: 19951 - DNA, 20 bp, Artificial Sequence
  Artificial sequence related to HLA knockouts in cell therapy
ggggctgaggtgtctccatc

SEQ ID NO: 19952 - DNA, 20 bp, Artificial Sequence
  Artificial sequence related to HLA knockouts in cell therapy
gggctgaggtgtctccatct

SEQ ID NO: 19953 - DNA, 20 bp, Artificial Sequence
  Artificial sequence related to HLA knockouts in cell therapy
ggctgaggtgtctccatctc

SEQ ID NO: 19954 - DNA, 21 bp, Artificial Sequence
  Artificial sequence related to HLA knockouts in cell therapy
cagaagcagaggggtcagggc

SEQ ID NO: 19955 - DNA, 21 bp, Artificial Sequence
  Artificial sequence related to HLA knockouts in cell therapy
agaagcagaggggtcagggcg

SEQ ID NO: 19956 - DNA, 21 bp, Artificial Sequence
  Artificial sequence related to HLA knockouts in cell therapy
gaagcagaggggtcagggcga

SEQ ID NO: 19957 - DNA, 21 bp, Artificial Sequence
  Artificial sequence related to HLA knockouts in cell therapy
aagcagaggggtcagggcgaa

SEQ ID NO: 19958 - DNA, 21 bp, Artificial Sequence
  Artificial sequence related to HLA knockouts in cell therapy
agcagaggggtcagggcgaag

SEQ ID NO: 19959 - DNA, 21 bp, Artificial Sequence
  Artificial sequence related to HLA knockouts in cell therapy
gcagaggggtcagggcgaagt

SEQ ID NO: 19960 - DNA, 21 bp, Artificial Sequence
  Artificial sequence related to HLA knockouts in cell therapy
cagaggggtcagggcgaagtc

SEQ ID NO: 19961 - DNA, 21 bp, Artificial Sequence
  Artificial sequence related to HLA knockouts in cell therapy
agaggggtcagggcgaagtcc

SEQ ID NO: 19962 - DNA, 21 bp, Artificial Sequence
  Artificial sequence related to HLA knockouts in cell therapy
gaggggtcagggcgaagtccc

SEQ ID NO: 19963 - DNA, 21 bp, Artificial Sequence
  Artificial sequence related to HLA knockouts in cell therapy
aggggtcagggcgaagtccca

SEQ ID NO: 19964 - DNA, 21 bp, Artificial Sequence
  Artificial sequence related to HLA knockouts in cell therapy
ggggtcagggcgaagtcccag

SEQ ID NO: 19965 - DNA, 21 bp, Artificial Sequence
  Artificial sequence related to HLA knockouts in cell therapy
gggtcagggcgaagtcccagg

SEQ ID NO: 19966 - DNA, 21 bp, Artificial Sequence
  Artificial sequence related to HLA knockouts in cell therapy
ggtcagggcgaagtcccaggg

SEQ ID NO: 19967 - DNA, 21 bp, Artificial Sequence
  Artificial sequence related to HLA knockouts in cell therapy
gtcagggcgaagtcccagggc

SEQ ID NO: 19968 - DNA, 21 bp, Artificial Sequence
  Artificial sequence related to HLA knockouts in cell therapy
tcagggcgaagtcccagggcc

SEQ ID NO: 19969 - DNA, 21 bp, Artificial Sequence
  Artificial sequence related to HLA knockouts in cell therapy
cagggcgaagtcccagggccc

SEQ ID NO: 19970 - DNA, 21 bp, Artificial Sequence
  Artificial sequence related to HLA knockouts in cell therapy
agggcgaagtcccagggcccc

SEQ ID NO: 19971 - DNA, 21 bp, Artificial Sequence
  Artificial sequence related to HLA knockouts in cell therapy
gggcgaagtcccagggcccca

SEQ ID NO: 19972 - DNA, 21 bp, Artificial Sequence
  Artificial sequence related to HLA knockouts in cell therapy
ggcgaagtcccagggccccag

SEQ ID NO: 19973 - DNA, 21 bp, Artificial Sequence
  Artificial sequence related to HLA knockouts in cell therapy
gcgaagtcccagggccccagg

SEQ ID NO: 19974 - DNA, 21 bp, Artificial Sequence
  Artificial sequence related to HLA knockouts in cell therapy
cgaagtcccagggccccaggc

SEQ ID NO: 19975 - DNA, 21 bp, Artificial Sequence
  Artificial sequence related to HLA knockouts in cell therapy
gaagtcccagggccccaggcg

SEQ ID NO: 19976 - DNA, 21 bp, Artificial Sequence
  Artificial sequence related to HLA knockouts in cell therapy
aagtcccagggccccaggcgt

SEQ ID NO: 19977 - DNA, 21 bp, Artificial Sequence
  Artificial sequence related to HLA knockouts in cell therapy
agtcccagggccccaggcgtg

SEQ ID NO: 19978 - DNA, 21 bp, Artificial Sequence
  Artificial sequence related to HLA knockouts in cell therapy
gtcccagggccccaggcgtgg

SEQ ID NO: 19979 - DNA, 21 bp, Artificial Sequence
  Artificial sequence related to HLA knockouts in cell therapy
tcccagggccccaggcgtggc

SEQ ID NO: 19980 - DNA, 21 bp, Artificial Sequence
  Artificial sequence related to HLA knockouts in cell therapy
cccagggccccaggcgtggct

SEQ ID NO: 19981 - DNA, 21 bp, Artificial Sequence
  Artificial sequence related to HLA knockouts in cell therapy
ccagggccccaggcgtggctc

SEQ ID NO: 19982 - DNA, 21 bp, Artificial Sequence
  Artificial sequence related to HLA knockouts in cell therapy
cagggccccaggcgtggctct

SEQ ID NO: 19983 - DNA, 21 bp, Artificial Sequence
  Artificial sequence related to HLA knockouts in cell therapy
agggccccaggcgtggctctc

SEQ ID NO: 19984 - DNA, 21 bp, Artificial Sequence
  Artificial sequence related to HLA knockouts in cell therapy
gggccccaggcgtggctctca

SEQ ID NO: 19985 - DNA, 21 bp, Artificial Sequence
  Artificial sequence related to HLA knockouts in cell therapy
ggccccaggcgtggctctcag

SEQ ID NO: 19986 - DNA, 21 bp, Artificial Sequence
  Artificial sequence related to HLA knockouts in cell therapy
gccccaggcgtggctctcagg

SEQ ID NO: 19987 - DNA, 21 bp, Artificial Sequence
  Artificial sequence related to HLA knockouts in cell therapy
ccccaggcgtggctctcaggg

SEQ ID NO: 19988 - DNA, 21 bp, Artificial Sequence
  Artificial sequence related to HLA knockouts in cell therapy
cccaggcgtggctctcagggt

SEQ ID NO: 19989 - DNA, 21 bp, Artificial Sequence
  Artificial sequence related to HLA knockouts in cell therapy
ccaggcgtggctctcagggtc

SEQ ID NO: 19990 - DNA, 21 bp, Artificial Sequence
  Artificial sequence related to HLA knockouts in cell therapy
caggcgtggctctcagggtct

SEQ ID NO: 19991 - DNA, 21 bp, Artificial Sequence
  Artificial sequence related to HLA knockouts in cell therapy
aggcgtggctctcagggtctc

SEQ ID NO: 19992 - DNA, 21 bp, Artificial Sequence
  Artificial sequence related to HLA knockouts in cell therapy
ggcgtggctctcagggtctca

SEQ ID NO: 19993 - DNA, 21 bp, Artificial Sequence
  Artificial sequence related to HLA knockouts in cell therapy
gcgtggctctcagggtctcag

SEQ ID NO: 19994 - DNA, 21 bp, Artificial Sequence
  Artificial sequence related to HLA knockouts in cell therapy
cgtggctctcagggtctcagg

SEQ ID NO: 19995 - DNA, 21 bp, Artificial Sequence
  Artificial sequence related to HLA knockouts in cell therapy
gtggctctcagggtctcaggc

SEQ ID NO: 19996 - DNA, 21 bp, Artificial Sequence
  Artificial sequence related to HLA knockouts in cell therapy
tggctctcagggtctcaggcc

SEQ ID NO: 19997 - DNA, 21 bp, Artificial Sequence
  Artificial sequence related to HLA knockouts in cell therapy
ggctctcagggtctcaggccc

SEQ ID NO: 19998 - DNA, 21 bp, Artificial Sequence
  Artificial sequence related to HLA knockouts in cell therapy
gctctcagggtctcaggcccc

SEQ ID NO: 19999 - DNA, 21 bp, Artificial Sequence
  Artificial sequence related to HLA knockouts in cell therapy
ctctcagggtctcaggccccg

SEQ ID NO: 20000 - DNA, 21 bp, Artificial Sequence
  Artificial sequence related to HLA knockouts in cell therapy
tctcagggtctcaggccccga

SEQ ID NO: 20001 - DNA, 21 bp, Artificial Sequence
  Artificial sequence related to HLA knockouts in cell therapy
ctcagggtctcaggccccgaa

SEQ ID NO: 20002 - DNA, 21 bp, Artificial Sequence
  Artificial sequence related to HLA knockouts in cell therapy
tcagggtctcaggccccgaag

SEQ ID NO: 20003 - DNA, 21 bp, Artificial Sequence
  Artificial sequence related to HLA knockouts in cell therapy
cagggtctcaggccccgaagg

SEQ ID NO: 20004 - DNA, 21 bp, Artificial Sequence
  Artificial sequence related to HLA knockouts in cell therapy
agggtctcaggccccgaaggc

SEQ ID NO: 20005 - DNA, 21 bp, Artificial Sequence
  Artificial sequence related to HLA knockouts in cell therapy
gggtctcaggccccgaaggcg

SEQ ID NO: 20006 - DNA, 21 bp, Artificial Sequence
  Artificial sequence related to HLA knockouts in cell therapy
ggtctcaggccccgaaggcgg

SEQ ID NO: 20007 - DNA, 21 bp, Artificial Sequence
  Artificial sequence related to HLA knockouts in cell therapy
gtctcaggccccgaaggcggt

SEQ ID NO: 20008 - DNA, 21 bp, Artificial Sequence
  Artificial sequence related to HLA knockouts in cell therapy
tctcaggccccgaaggcggtg

SEQ ID NO: 20009 - DNA, 21 bp, Artificial Sequence
  Artificial sequence related to HLA knockouts in cell therapy
ctcaggccccgaaggcggtgt

SEQ ID NO: 20010 - DNA, 21 bp, Artificial Sequence
  Artificial sequence related to HLA knockouts in cell therapy
tcaggccccgaaggcggtgta

SEQ ID NO: 20011 - DNA, 21 bp, Artificial Sequence
  Artificial sequence related to HLA knockouts in cell therapy
caggccccgaaggcggtgtat

SEQ ID NO: 20012 - DNA, 21 bp, Artificial Sequence
  Artificial sequence related to HLA knockouts in cell therapy
aggccccgaaggcggtgtatg

SEQ ID NO: 20013 - DNA, 21 bp, Artificial Sequence
  Artificial sequence related to HLA knockouts in cell therapy
ggccccgaaggcggtgtatgg

SEQ ID NO: 20014 - DNA, 21 bp, Artificial Sequence
  Artificial sequence related to HLA knockouts in cell therapy
gccccgaaggcggtgtatgga

SEQ ID NO: 20015 - DNA, 21 bp, Artificial Sequence
  Artificial sequence related to HLA knockouts in cell therapy
ccccgaaggcggtgtatggat

SEQ ID NO: 20016 - DNA, 21 bp, Artificial Sequence
  Artificial sequence related to HLA knockouts in cell therapy
ggcggtgtatggattggggag

SEQ ID NO: 20017 - DNA, 21 bp, Artificial Sequence
  Artificial sequence related to HLA knockouts in cell therapy
atggattggggagtcccagcc

SEQ ID NO: 20018 - DNA, 21 bp, Artificial Sequence
  Artificial sequence related to HLA knockouts in cell therapy
tggattggggagtcccagcct

SEQ ID NO: 20019 - DNA, 21 bp, Artificial Sequence
  Artificial sequence related to HLA knockouts in cell therapy
ggattggggagtcccagcctt

SEQ ID NO: 20020 - DNA, 21 bp, Artificial Sequence
  Artificial sequence related to HLA knockouts in cell therapy
gattggggagtcccagccttg

SEQ ID NO: 20021 - DNA, 21 bp, Artificial Sequence
  Artificial sequence related to HLA knockouts in cell therapy
attggggagtcccagccttgg

SEQ ID NO: 20022 - DNA, 21 bp, Artificial Sequence
  Artificial sequence related to HLA knockouts in cell therapy
ttggggagtcccagccttggg

SEQ ID NO: 20023 - DNA, 21 bp, Artificial Sequence
  Artificial sequence related to HLA knockouts in cell therapy
tggggagtcccagccttgggg

SEQ ID NO: 20024 - DNA, 21 bp, Artificial Sequence
  Artificial sequence related to HLA knockouts in cell therapy
ggggagtcccagccttgggga

SEQ ID NO: 20025 - DNA, 21 bp, Artificial Sequence
  Artificial sequence related to HLA knockouts in cell therapy
gggagtcccagccttggggat

SEQ ID NO: 20026 - DNA, 21 bp, Artificial Sequence
  Artificial sequence related to HLA knockouts in cell therapy
ggagtcccagccttggggatt

SEQ ID NO: 20027 - DNA, 21 bp, Artificial Sequence
  Artificial sequence related to HLA knockouts in cell therapy
gagtcccagccttggggattc

SEQ ID NO: 20028 - DNA, 21 bp, Artificial Sequence
  Artificial sequence related to HLA knockouts in cell therapy
agtcccagccttggggattcc

SEQ ID NO: 20029 - DNA, 21 bp, Artificial Sequence
  Artificial sequence related to HLA knockouts in cell therapy
gtcccagccttggggattccc

SEQ ID NO: 20030 - DNA, 21 bp, Artificial Sequence
  Artificial sequence related to HLA knockouts in cell therapy
tcccagccttggggattcccc

SEQ ID NO: 20031 - DNA, 21 bp, Artificial Sequence
  Artificial sequence related to HLA knockouts in cell therapy
cccagccttggggattcccca

SEQ ID NO: 20032 - DNA, 21 bp, Artificial Sequence
  Artificial sequence related to HLA knockouts in cell therapy
ccagccttggggattccccaa

SEQ ID NO: 20033 - DNA, 21 bp, Artificial Sequence
  Artificial sequence related to HLA knockouts in cell therapy
cagccttggggattccccaac

SEQ ID NO: 20034 - DNA, 21 bp, Artificial Sequence
  Artificial sequence related to HLA knockouts in cell therapy
gccttggggattccccaactc

SEQ ID NO: 20035 - DNA, 21 bp, Artificial Sequence
  Artificial sequence related to HLA knockouts in cell therapy
ccttggggattccccaactcc

SEQ ID NO: 20036 - DNA, 21 bp, Artificial Sequence
  Artificial sequence related to HLA knockouts in cell therapy
cttggggattccccaactccg

SEQ ID NO: 20037 - DNA, 21 bp, Artificial Sequence
  Artificial sequence related to HLA knockouts in cell therapy
ttggggattccccaactccgc

SEQ ID NO: 20038 - DNA, 21 bp, Artificial Sequence
  Artificial sequence related to HLA knockouts in cell therapy
tggggattccccaactccgca

SEQ ID NO: 20039 - DNA, 21 bp, Artificial Sequence
  Artificial sequence related to HLA knockouts in cell therapy
ggggattccccaactccgcag

SEQ ID NO: 20040 - DNA, 21 bp, Artificial Sequence
  Artificial sequence related to HLA knockouts in cell therapy
gggattccccaactccgcagt

SEQ ID NO: 20041 - DNA, 21 bp, Artificial Sequence
  Artificial sequence related to HLA knockouts in cell therapy
tcctggatactcacgacgcgg

SEQ ID NO: 20042 - DNA, 21 bp, Artificial Sequence
  Artificial sequence related to HLA knockouts in cell therapy
cctggatactcacgacgcgga

SEQ ID NO: 20043 - DNA, 21 bp, Artificial Sequence
  Artificial sequence related to HLA knockouts in cell therapy
ctggatactcacgacgcggac

SEQ ID NO: 20044 - DNA, 21 bp, Artificial Sequence
  Artificial sequence related to HLA knockouts in cell therapy
tggatactcacgacgcggacc

SEQ ID NO: 20045 - DNA, 21 bp, Artificial Sequence
  Artificial sequence related to HLA knockouts in cell therapy
ggatactcacgacgcggaccc

SEQ ID NO: 20046 - DNA, 21 bp, Artificial Sequence
  Artificial sequence related to HLA knockouts in cell therapy
gatactcacgacgcggaccca

SEQ ID NO: 20047 - DNA, 21 bp, Artificial Sequence
  Artificial sequence related to HLA knockouts in cell therapy
atactcacgacgcggacccag

SEQ ID NO: 20048 - DNA, 21 bp, Artificial Sequence
  Artificial sequence related to HLA knockouts in cell therapy
tactcacgacgcggacccagt

SEQ ID NO: 20049 - DNA, 21 bp, Artificial Sequence
  Artificial sequence related to HLA knockouts in cell therapy
actcacgacgcggacccagtt

SEQ ID NO: 20050 - DNA, 21 bp, Artificial Sequence
  Artificial sequence related to HLA knockouts in cell therapy
ctcacgacgcggacccagttc

SEQ ID NO: 20051 - DNA, 21 bp, Artificial Sequence
  Artificial sequence related to HLA knockouts in cell therapy
tcacgacgcggacccagttct

SEQ ID NO: 20052 - DNA, 21 bp, Artificial Sequence
  Artificial sequence related to HLA knockouts in cell therapy
cacgacgcggacccagttctc

SEQ ID NO: 20053 - DNA, 21 bp, Artificial Sequence
  Artificial sequence related to HLA knockouts in cell therapy
acgacgcggacccagttctca

SEQ ID NO: 20054 - DNA, 21 bp, Artificial Sequence
  Artificial sequence related to HLA knockouts in cell therapy
cgacgcggacccagttctcac

SEQ ID NO: 20055 - DNA, 21 bp, Artificial Sequence
  Artificial sequence related to HLA knockouts in cell therapy
gacgcggacccagttctcact

SEQ ID NO: 20056 - DNA, 21 bp, Artificial Sequence
  Artificial sequence related to HLA knockouts in cell therapy
acgcggacccagttctcactc

SEQ ID NO: 20057 - DNA, 21 bp, Artificial Sequence
  Artificial sequence related to HLA knockouts in cell therapy
cgcggacccagttctcactcc

SEQ ID NO: 20058 - DNA, 21 bp, Artificial Sequence
  Artificial sequence related to HLA knockouts in cell therapy
gcggacccagttctcactccc

SEQ ID NO: 20059 - DNA, 21 bp, Artificial Sequence
  Artificial sequence related to HLA knockouts in cell therapy
cggacccagttctcactccca

SEQ ID NO: 20060 - DNA, 21 bp, Artificial Sequence
  Artificial sequence related to HLA knockouts in cell therapy
ctcactcccattgggtgtcgg

SEQ ID NO: 20061 - DNA, 21 bp, Artificial Sequence
  Artificial sequence related to HLA knockouts in cell therapy
tcactcccattgggtgtcggg

SEQ ID NO: 20062 - DNA, 21 bp, Artificial Sequence
  Artificial sequence related to HLA knockouts in cell therapy
cactcccattgggtgtcgggt

SEQ ID NO: 20063 - DNA, 21 bp, Artificial Sequence
  Artificial sequence related to HLA knockouts in cell therapy
cccattgggtgtcgggtttcc

SEQ ID NO: 20064 - DNA, 21 bp, Artificial Sequence
  Artificial sequence related to HLA knockouts in cell therapy
agccaatcagtgtcgtcgcgg

SEQ ID NO: 20065 - DNA, 21 bp, Artificial Sequence
  Artificial sequence related to HLA knockouts in cell therapy
gccaatcagtgtcgtcgcggt

SEQ ID NO: 20066 - DNA, 21 bp, Artificial Sequence
  Artificial sequence related to HLA knockouts in cell therapy
ccaatcagtgtcgtcgcggtc

SEQ ID NO: 20067 - DNA, 21 bp, Artificial Sequence
  Artificial sequence related to HLA knockouts in cell therapy
caatcagtgtcgtcgcggtcg

SEQ ID NO: 20068 - DNA, 21 bp, Artificial Sequence
  Artificial sequence related to HLA knockouts in cell therapy
aatcagtgtcgtcgcggtcgc

SEQ ID NO: 20069 - DNA, 21 bp, Artificial Sequence
  Artificial sequence related to HLA knockouts in cell therapy
atcagtgtcgtcgcggtcgcg

SEQ ID NO: 20070 - DNA, 21 bp, Artificial Sequence
  Artificial sequence related to HLA knockouts in cell therapy
tcagtgtcgtcgcggtcgcgg

SEQ ID NO: 20071 - DNA, 21 bp, Artificial Sequence
  Artificial sequence related to HLA knockouts in cell therapy
cagtgtcgtcgcggtcgcggt

SEQ ID NO: 20072 - DNA, 21 bp, Artificial Sequence
  Artificial sequence related to HLA knockouts in cell therapy
agtgtcgtcgcggtcgcggtt

SEQ ID NO: 20073 - DNA, 21 bp, Artificial Sequence
  Artificial sequence related to HLA knockouts in cell therapy
gtgtcgtcgcggtcgcggttc

SEQ ID NO: 20074 - DNA, 21 bp, Artificial Sequence
  Artificial sequence related to HLA knockouts in cell therapy
tgtcgtcgcggtcgcggttct

SEQ ID NO: 20075 - DNA, 21 bp, Artificial Sequence
  Artificial sequence related to HLA knockouts in cell therapy
gtcgtcgcggtcgcggttcta

SEQ ID NO: 20076 - DNA, 21 bp, Artificial Sequence
  Artificial sequence related to HLA knockouts in cell therapy
tcgtcgcggtcgcggttctaa

SEQ ID NO: 20077 - DNA, 21 bp, Artificial Sequence
  Artificial sequence related to HLA knockouts in cell therapy
cgtcgcggtcgcggttctaaa

SEQ ID NO: 20078 - DNA, 21 bp, Artificial Sequence
  Artificial sequence related to HLA knockouts in cell therapy
gtcgcggtcgcggttctaaag

SEQ ID NO: 20079 - DNA, 21 bp, Artificial Sequence
  Artificial sequence related to HLA knockouts in cell therapy
cgcggtcgcggttctaaagtc

SEQ ID NO: 20080 - DNA, 21 bp, Artificial Sequence
  Artificial sequence related to HLA knockouts in cell therapy
gcggtcgcggttctaaagtcc

SEQ ID NO: 20081 - DNA, 21 bp, Artificial Sequence
  Artificial sequence related to HLA knockouts in cell therapy
cggtcgcggttctaaagtccg

SEQ ID NO: 20082 - DNA, 21 bp, Artificial Sequence
  Artificial sequence related to HLA knockouts in cell therapy
ggtcgcggttctaaagtccgc

SEQ ID NO: 20083 - DNA, 21 bp, Artificial Sequence
  Artificial sequence related to HLA knockouts in cell therapy
cgcggttctaaagtccgcacg

SEQ ID NO: 20084 - DNA, 21 bp, Artificial Sequence
  Artificial sequence related to HLA knockouts in cell therapy
gcggttctaaagtccgcacgc

SEQ ID NO: 20085 - DNA, 21 bp, Artificial Sequence
  Artificial sequence related to HLA knockouts in cell therapy
ctaaagtccgcacgcacccac

SEQ ID NO: 20086 - DNA, 21 bp, Artificial Sequence
  Artificial sequence related to HLA knockouts in cell therapy
taaagtccgcacgcacccacc

SEQ ID NO: 20087 - DNA, 21 bp, Artificial Sequence
  Artificial sequence related to HLA knockouts in cell therapy
aaagtccgcacgcacccaccg

SEQ ID NO: 20088 - DNA, 21 bp, Artificial Sequence
  Artificial sequence related to HLA knockouts in cell therapy
aagtccgcacgcacccaccgg

SEQ ID NO: 20089 - DNA, 21 bp, Artificial Sequence
  Artificial sequence related to HLA knockouts in cell therapy
agtccgcacgcacccaccggg

SEQ ID NO: 20090 - DNA, 21 bp, Artificial Sequence
  Artificial sequence related to HLA knockouts in cell therapy
gtccgcacgcacccaccggga

SEQ ID NO: 20091 - DNA, 21 bp, Artificial Sequence
  Artificial sequence related to HLA knockouts in cell therapy
tccgcacgcacccaccgggac

SEQ ID NO: 20092 - DNA, 21 bp, Artificial Sequence
  Artificial sequence related to HLA knockouts in cell therapy
ccgcacgcacccaccgggact

SEQ ID NO: 20093 - DNA, 21 bp, Artificial Sequence
  Artificial sequence related to HLA knockouts in cell therapy
cgcacgcacccaccgggactc

SEQ ID NO: 20094 - DNA, 21 bp, Artificial Sequence
  Artificial sequence related to HLA knockouts in cell therapy
gcacgcacccaccgggactca

SEQ ID NO: 20095 - DNA, 21 bp, Artificial Sequence
  Artificial sequence related to HLA knockouts in cell therapy
cacgcacccaccgggactcag

SEQ ID NO: 20096 - DNA, 21 bp, Artificial Sequence
  Artificial sequence related to HLA knockouts in cell therapy
acgcacccaccgggactcaga

SEQ ID NO: 20097 - DNA, 21 bp, Artificial Sequence
  Artificial sequence related to HLA knockouts in cell therapy
cgcacccaccgggactcagat

SEQ ID NO: 20098 - DNA, 21 bp, Artificial Sequence
  Artificial sequence related to HLA knockouts in cell therapy
gcacccaccgggactcagatt

SEQ ID NO: 20099 - DNA, 21 bp, Artificial Sequence
  Artificial sequence related to HLA knockouts in cell therapy
cacccaccgggactcagattc

SEQ ID NO: 20100 - DNA, 21 bp, Artificial Sequence
  Artificial sequence related to HLA knockouts in cell therapy
cccaccgggactcagattctc

SEQ ID NO: 20101 - DNA, 21 bp, Artificial Sequence
  Artificial sequence related to HLA knockouts in cell therapy
ccaccgggactcagattctcc

SEQ ID NO: 20102 - DNA, 21 bp, Artificial Sequence
  Artificial sequence related to HLA knockouts in cell therapy
caccgggactcagattctccc

SEQ ID NO: 20103 - DNA, 21 bp, Artificial Sequence
  Artificial sequence related to HLA knockouts in cell therapy
accgggactcagattctcccc

SEQ ID NO: 20104 - DNA, 21 bp, Artificial Sequence
  Artificial sequence related to HLA knockouts in cell therapy
ccgggactcagattctcccca

SEQ ID NO: 20105 - DNA, 21 bp, Artificial Sequence
  Artificial sequence related to HLA knockouts in cell therapy
cgggactcagattctccccag

SEQ ID NO: 20106 - DNA, 21 bp, Artificial Sequence
  Artificial sequence related to HLA knockouts in cell therapy
ctcagattctccccagacgcc

SEQ ID NO: 20107 - DNA, 21 bp, Artificial Sequence
  Artificial sequence related to HLA knockouts in cell therapy
tcagattctccccagacgccg

SEQ ID NO: 20108 - DNA, 21 bp, Artificial Sequence
  Artificial sequence related to HLA knockouts in cell therapy
cagattctccccagacgccga

SEQ ID NO: 20109 - DNA, 21 bp, Artificial Sequence
  Artificial sequence related to HLA knockouts in cell therapy
agattctccccagacgccgag

SEQ ID NO: 20110 - DNA, 21 bp, Artificial Sequence
  Artificial sequence related to HLA knockouts in cell therapy
gattctccccagacgccgagg

SEQ ID NO: 20111 - DNA, 21 bp, Artificial Sequence
  Artificial sequence related to HLA knockouts in cell therapy
attctccccagacgccgagga

SEQ ID NO: 20112 - DNA, 21 bp, Artificial Sequence
  Artificial sequence related to HLA knockouts in cell therapy
ttctccccagacgccgaggat

SEQ ID NO: 20113 - DNA, 21 bp, Artificial Sequence
  Artificial sequence related to HLA knockouts in cell therapy
tctccccagacgccgaggatg

SEQ ID NO: 20114 - DNA, 21 bp, Artificial Sequence
  Artificial sequence related to HLA knockouts in cell therapy
ctccccagacgccgaggatgg

SEQ ID NO: 20115 - DNA, 21 bp, Artificial Sequence
  Artificial sequence related to HLA knockouts in cell therapy
tccccagacgccgaggatggc

SEQ ID NO: 20116 - DNA, 21 bp, Artificial Sequence
  Artificial sequence related to HLA knockouts in cell therapy
ccccagacgccgaggatggcc

SEQ ID NO: 20117 - DNA, 21 bp, Artificial Sequence
  Artificial sequence related to HLA knockouts in cell therapy
cccagacgccgaggatggccg

SEQ ID NO: 20118 - DNA, 21 bp, Artificial Sequence
  Artificial sequence related to HLA knockouts in cell therapy
ccagacgccgaggatggccgt

SEQ ID NO: 20119 - DNA, 21 bp, Artificial Sequence
  Artificial sequence related to HLA knockouts in cell therapy
cagacgccgaggatggccgtc

SEQ ID NO: 20120 - DNA, 21 bp, Artificial Sequence
  Artificial sequence related to HLA knockouts in cell therapy
agacgccgaggatggccgtca

SEQ ID NO: 20121 - DNA, 21 bp, Artificial Sequence
  Artificial sequence related to HLA knockouts in cell therapy
gacgccgaggatggccgtcat

SEQ ID NO: 20122 - DNA, 21 bp, Artificial Sequence
  Artificial sequence related to HLA knockouts in cell therapy
acgccgaggatggccgtcatg

SEQ ID NO: 20123 - DNA, 21 bp, Artificial Sequence
  Artificial sequence related to HLA knockouts in cell therapy
cgccgaggatggccgtcatgg

SEQ ID NO: 20124 - DNA, 21 bp, Artificial Sequence
  Artificial sequence related to HLA knockouts in cell therapy
gccgaggatggccgtcatggc

SEQ ID NO: 20125 - DNA, 21 bp, Artificial Sequence
  Artificial sequence related to HLA knockouts in cell therapy
ccgaggatggccgtcatggcg

SEQ ID NO: 20126 - DNA, 21 bp, Artificial Sequence
  Artificial sequence related to HLA knockouts in cell therapy
cgaggatggccgtcatggcgc

SEQ ID NO: 20127 - DNA, 21 bp, Artificial Sequence
  Artificial sequence related to HLA knockouts in cell therapy
gaggatggccgtcatggcgcc

SEQ ID NO: 20128 - DNA, 21 bp, Artificial Sequence
  Artificial sequence related to HLA knockouts in cell therapy
aggatggccgtcatggcgccc

SEQ ID NO: 20129 - DNA, 21 bp, Artificial Sequence
  Artificial sequence related to HLA knockouts in cell therapy
ggatggccgtcatggcgcccc

SEQ ID NO: 20130 - DNA, 21 bp, Artificial Sequence
  Artificial sequence related to HLA knockouts in cell therapy
gatggccgtcatggcgccccg

SEQ ID NO: 20131 - DNA, 21 bp, Artificial Sequence
  Artificial sequence related to HLA knockouts in cell therapy
atggccgtcatggcgccccga

SEQ ID NO: 20132 - DNA, 21 bp, Artificial Sequence
  Artificial sequence related to HLA knockouts in cell therapy
tggccgtcatggcgccccgaa

SEQ ID NO: 20133 - DNA, 21 bp, Artificial Sequence
  Artificial sequence related to HLA knockouts in cell therapy
ggccgtcatggcgccccgaac

SEQ ID NO: 20134 - DNA, 21 bp, Artificial Sequence
  Artificial sequence related to HLA knockouts in cell therapy
gccgtcatggcgccccgaacc

SEQ ID NO: 20135 - DNA, 21 bp, Artificial Sequence
  Artificial sequence related to HLA knockouts in cell therapy
ccgtcatggcgccccgaaccc

SEQ ID NO: 20136 - DNA, 21 bp, Artificial Sequence
  Artificial sequence related to HLA knockouts in cell therapy
cgtcatggcgccccgaaccct

SEQ ID NO: 20137 - DNA, 21 bp, Artificial Sequence
  Artificial sequence related to HLA knockouts in cell therapy
gtcatggcgccccgaaccctc

SEQ ID NO: 20138 - DNA, 21 bp, Artificial Sequence
  Artificial sequence related to HLA knockouts in cell therapy
tcatggcgccccgaaccctcg

SEQ ID NO: 20139 - DNA, 21 bp, Artificial Sequence
  Artificial sequence related to HLA knockouts in cell therapy
catggcgccccgaaccctcgt

SEQ ID NO: 20140 - DNA, 21 bp, Artificial Sequence
  Artificial sequence related to HLA knockouts in cell therapy
atggcgccccgaaccctcgtc

SEQ ID NO: 20141 - DNA, 21 bp, Artificial Sequence
  Artificial sequence related to HLA knockouts in cell therapy
tggcgccccgaaccctcgtcc

SEQ ID NO: 20142 - DNA, 21 bp, Artificial Sequence
  Artificial sequence related to HLA knockouts in cell therapy
ggcgccccgaaccctcgtcct

SEQ ID NO: 20143 - DNA, 21 bp, Artificial Sequence
  Artificial sequence related to HLA knockouts in cell therapy
gcgccccgaaccctcgtcctg

SEQ ID NO: 20144 - DNA, 21 bp, Artificial Sequence
  Artificial sequence related to HLA knockouts in cell therapy
cgccccgaaccctcgtcctgc

SEQ ID NO: 20145 - DNA, 21 bp, Artificial Sequence
  Artificial sequence related to HLA knockouts in cell therapy
gccccgaaccctcgtcctgct

SEQ ID NO: 20146 - DNA, 21 bp, Artificial Sequence
  Artificial sequence related to HLA knockouts in cell therapy
ccccgaaccctcgtcctgcta

SEQ ID NO: 20147 - DNA, 21 bp, Artificial Sequence
  Artificial sequence related to HLA knockouts in cell therapy
cccgaaccctcgtcctgctac

SEQ ID NO: 20148 - DNA, 21 bp, Artificial Sequence
  Artificial sequence related to HLA knockouts in cell therapy
ccgaaccctcgtcctgctact

SEQ ID NO: 20149 - DNA, 21 bp, Artificial Sequence
  Artificial sequence related to HLA knockouts in cell therapy
cgaaccctcgtcctgctactc

SEQ ID NO: 20150 - DNA, 21 bp, Artificial Sequence
  Artificial sequence related to HLA knockouts in cell therapy
accctcgtcctgctactctcg

SEQ ID NO: 20151 - DNA, 21 bp, Artificial Sequence
  Artificial sequence related to HLA knockouts in cell therapy
ccctcgtcctgctactctcgg

SEQ ID NO: 20152 - DNA, 21 bp, Artificial Sequence
  Artificial sequence related to HLA knockouts in cell therapy
cctcgtcctgctactctcggg

SEQ ID NO: 20153 - DNA, 21 bp, Artificial Sequence
  Artificial sequence related to HLA knockouts in cell therapy
ctcgtcctgctactctcgggg

SEQ ID NO: 20154 - DNA, 21 bp, Artificial Sequence
  Artificial sequence related to HLA knockouts in cell therapy
tcgtcctgctactctcggggg

SEQ ID NO: 20155 - DNA, 21 bp, Artificial Sequence
  Artificial sequence related to HLA knockouts in cell therapy
cgtcctgctactctcgggggc

SEQ ID NO: 20156 - DNA, 21 bp, Artificial Sequence
  Artificial sequence related to HLA knockouts in cell therapy
gtcctgctactctcgggggct

SEQ ID NO: 20157 - DNA, 21 bp, Artificial Sequence
  Artificial sequence related to HLA knockouts in cell therapy
tcctgctactctcgggggctc

SEQ ID NO: 20158 - DNA, 21 bp, Artificial Sequence
  Artificial sequence related to HLA knockouts in cell therapy
cctgctactctcgggggctct

SEQ ID NO: 20159 - DNA, 21 bp, Artificial Sequence
  Artificial sequence related to HLA knockouts in cell therapy
ctgctactctcgggggctctg

SEQ ID NO: 20160 - DNA, 21 bp, Artificial Sequence
  Artificial sequence related to HLA knockouts in cell therapy
tgctactctcgggggctctgg

SEQ ID NO: 20161 - DNA, 21 bp, Artificial Sequence
  Artificial sequence related to HLA knockouts in cell therapy
gctactctcgggggctctggc

SEQ ID NO: 20162 - DNA, 21 bp, Artificial Sequence
  Artificial sequence related to HLA knockouts in cell therapy
ctactctcgggggctctggcc

SEQ ID NO: 20163 - DNA, 21 bp, Artificial Sequence
  Artificial sequence related to HLA knockouts in cell therapy
tactctcgggggctctggccc

SEQ ID NO: 20164 - DNA, 21 bp, Artificial Sequence
  Artificial sequence related to HLA knockouts in cell therapy
actctcgggggctctggccct

SEQ ID NO: 20165 - DNA, 21 bp, Artificial Sequence
  Artificial sequence related to HLA knockouts in cell therapy
ctctcgggggctctggccctg

SEQ ID NO: 20166 - DNA, 21 bp, Artificial Sequence
  Artificial sequence related to HLA knockouts in cell therapy
tctcgggggctctggccctga

SEQ ID NO: 20167 - DNA, 21 bp, Artificial Sequence
  Artificial sequence related to HLA knockouts in cell therapy
ctcgggggctctggccctgac

SEQ ID NO: 20168 - DNA, 21 bp, Artificial Sequence
  Artificial sequence related to HLA knockouts in cell therapy
tcgggggctctggccctgacc

SEQ ID NO: 20169 - DNA, 21 bp, Artificial Sequence
  Artificial sequence related to HLA knockouts in cell therapy
cgggggctctggccctgaccc

SEQ ID NO: 20170 - DNA, 21 bp, Artificial Sequence
  Artificial sequence related to HLA knockouts in cell therapy
gggggctctggccctgaccca

SEQ ID NO: 20171 - DNA, 21 bp, Artificial Sequence
  Artificial sequence related to HLA knockouts in cell therapy
ggggctctggccctgacccag

SEQ ID NO: 20172 - DNA, 21 bp, Artificial Sequence
  Artificial sequence related to HLA knockouts in cell therapy
gggctctggccctgacccaga

SEQ ID NO: 20173 - DNA, 21 bp, Artificial Sequence
  Artificial sequence related to HLA knockouts in cell therapy
ggctctggccctgacccagac

SEQ ID NO: 20174 - DNA, 21 bp, Artificial Sequence
  Artificial sequence related to HLA knockouts in cell therapy
gctctggccctgacccagacc

SEQ ID NO: 20175 - DNA, 21 bp, Artificial Sequence
  Artificial sequence related to HLA knockouts in cell therapy
ctctggccctgacccagacct

SEQ ID NO: 20176 - DNA, 21 bp, Artificial Sequence
  Artificial sequence related to HLA knockouts in cell therapy
tctggccctgacccagacctg

SEQ ID NO: 20177 - DNA, 21 bp, Artificial Sequence
  Artificial sequence related to HLA knockouts in cell therapy
ctggccctgacccagacctgg

SEQ ID NO: 20178 - DNA, 21 bp, Artificial Sequence
  Artificial sequence related to HLA knockouts in cell therapy
tggccctgacccagacctggg

SEQ ID NO: 20179 - DNA, 21 bp, Artificial Sequence
  Artificial sequence related to HLA knockouts in cell therapy
ggccctgacccagacctgggc

SEQ ID NO: 20180 - DNA, 21 bp, Artificial Sequence
  Artificial sequence related to HLA knockouts in cell therapy
gccctgacccagacctgggcg

SEQ ID NO: 20181 - DNA, 21 bp, Artificial Sequence
  Artificial sequence related to HLA knockouts in cell therapy
ccctgacccagacctgggcgg

SEQ ID NO: 20182 - DNA, 21 bp, Artificial Sequence
  Artificial sequence related to HLA knockouts in cell therapy
cctgacccagacctgggcggg

SEQ ID NO: 20183 - DNA, 21 bp, Artificial Sequence
  Artificial sequence related to HLA knockouts in cell therapy
ctgacccagacctgggcgggc

SEQ ID NO: 20184 - DNA, 21 bp, Artificial Sequence
  Artificial sequence related to HLA knockouts in cell therapy
tgacccagacctgggcgggct

SEQ ID NO: 20185 - DNA, 21 bp, Artificial Sequence
  Artificial sequence related to HLA knockouts in cell therapy
gacccagacctgggcgggctc

SEQ ID NO: 20186 - DNA, 21 bp, Artificial Sequence
  Artificial sequence related to HLA knockouts in cell therapy
acccagacctgggcgggctct

SEQ ID NO: 20187 - DNA, 21 bp, Artificial Sequence
  Artificial sequence related to HLA knockouts in cell therapy
cccagacctgggcgggctctc

SEQ ID NO: 20188 - DNA, 21 bp, Artificial Sequence
  Artificial sequence related to HLA knockouts in cell therapy
ccagacctgggcgggctctca

SEQ ID NO: 20189 - DNA, 21 bp, Artificial Sequence
  Artificial sequence related to HLA knockouts in cell therapy
cagacctgggcgggctctcac

SEQ ID NO: 20190 - DNA, 21 bp, Artificial Sequence
  Artificial sequence related to HLA knockouts in cell therapy
agacctgggcgggctctcact

SEQ ID NO: 20191 - DNA, 21 bp, Artificial Sequence
  Artificial sequence related to HLA knockouts in cell therapy
gacctgggcgggctctcactc

SEQ ID NO: 20192 - DNA, 21 bp, Artificial Sequence
  Artificial sequence related to HLA knockouts in cell therapy
acctgggcgggctctcactcc

SEQ ID NO: 20193 - DNA, 21 bp, Artificial Sequence
  Artificial sequence related to HLA knockouts in cell therapy
cctgggcgggctctcactcca

SEQ ID NO: 20194 - DNA, 21 bp, Artificial Sequence
  Artificial sequence related to HLA knockouts in cell therapy
ctgggcgggctctcactccat

SEQ ID NO: 20195 - DNA, 21 bp, Artificial Sequence
  Artificial sequence related to HLA knockouts in cell therapy
tgggcgggctctcactccatg

SEQ ID NO: 20196 - DNA, 21 bp, Artificial Sequence
  Artificial sequence related to HLA knockouts in cell therapy
gggcgggctctcactccatga

SEQ ID NO: 20197 - DNA, 21 bp, Artificial Sequence
  Artificial sequence related to HLA knockouts in cell therapy
ggcgggctctcactccatgag

SEQ ID NO: 20198 - DNA, 21 bp, Artificial Sequence
  Artificial sequence related to HLA knockouts in cell therapy
gcgggctctcactccatgagg

SEQ ID NO: 20199 - DNA, 21 bp, Artificial Sequence
  Artificial sequence related to HLA knockouts in cell therapy
cgggctctcactccatgaggt

SEQ ID NO: 20200 - DNA, 21 bp, Artificial Sequence
  Artificial sequence related to HLA knockouts in cell therapy
tcttcacatccgtgtcccggc

SEQ ID NO: 20201 - DNA, 21 bp, Artificial Sequence
  Artificial sequence related to HLA knockouts in cell therapy
cttcacatccgtgtcccggcc

SEQ ID NO: 20202 - DNA, 21 bp, Artificial Sequence
  Artificial sequence related to HLA knockouts in cell therapy
ttcacatccgtgtcccggccc

SEQ ID NO: 20203 - DNA, 21 bp, Artificial Sequence
  Artificial sequence related to HLA knockouts in cell therapy
tcacatccgtgtcccggcccg

SEQ ID NO: 20204 - DNA, 21 bp, Artificial Sequence
  Artificial sequence related to HLA knockouts in cell therapy
cacatccgtgtcccggcccgg

SEQ ID NO: 20205 - DNA, 21 bp, Artificial Sequence
  Artificial sequence related to HLA knockouts in cell therapy
acatccgtgtcccggcccggc

SEQ ID NO: 20206 - DNA, 21 bp, Artificial Sequence
  Artificial sequence related to HLA knockouts in cell therapy
catccgtgtcccggcccggcc

SEQ ID NO: 20207 - DNA, 21 bp, Artificial Sequence
  Artificial sequence related to HLA knockouts in cell therapy
atccgtgtcccggcccggccg

SEQ ID NO: 20208 - DNA, 21 bp, Artificial Sequence
  Artificial sequence related to HLA knockouts in cell therapy
tccgtgtcccggcccggccgc

SEQ ID NO: 20209 - DNA, 21 bp, Artificial Sequence
  Artificial sequence related to HLA knockouts in cell therapy
ccgtgtcccggcccggccgcg

SEQ ID NO: 20210 - DNA, 21 bp, Artificial Sequence
  Artificial sequence related to HLA knockouts in cell therapy
cgtgtcccggcccggccgcgg

SEQ ID NO: 20211 - DNA, 21 bp, Artificial Sequence
  Artificial sequence related to HLA knockouts in cell therapy
gtgtcccggcccggccgcggg

SEQ ID NO: 20212 - DNA, 21 bp, Artificial Sequence
  Artificial sequence related to HLA knockouts in cell therapy
tgtcccggcccggccgcgggg

SEQ ID NO: 20213 - DNA, 21 bp, Artificial Sequence
  Artificial sequence related to HLA knockouts in cell therapy
gtcccggcccggccgcgggga

SEQ ID NO: 20214 - DNA, 21 bp, Artificial Sequence
  Artificial sequence related to HLA knockouts in cell therapy
tcccggcccggccgcggggag

SEQ ID NO: 20215 - DNA, 21 bp, Artificial Sequence
  Artificial sequence related to HLA knockouts in cell therapy
cccggcccggccgcggggagc

SEQ ID NO: 20216 - DNA, 21 bp, Artificial Sequence
  Artificial sequence related to HLA knockouts in cell therapy
ccggcccggccgcggggagcc

SEQ ID NO: 20217 - DNA, 21 bp, Artificial Sequence
  Artificial sequence related to HLA knockouts in cell therapy
cggcccggccgcggggagccc

SEQ ID NO: 20218 - DNA, 21 bp, Artificial Sequence
  Artificial sequence related to HLA knockouts in cell therapy
ggcccggccgcggggagcccc

SEQ ID NO: 20219 - DNA, 21 bp, Artificial Sequence
  Artificial sequence related to HLA knockouts in cell therapy
gcccggccgcggggagccccg

SEQ ID NO: 20220 - DNA, 21 bp, Artificial Sequence
  Artificial sequence related to HLA knockouts in cell therapy
cccggccgcggggagccccgc

SEQ ID NO: 20221 - DNA, 21 bp, Artificial Sequence
  Artificial sequence related to HLA knockouts in cell therapy
ccggccgcggggagccccgct

SEQ ID NO: 20222 - DNA, 21 bp, Artificial Sequence
  Artificial sequence related to HLA knockouts in cell therapy
cggccgcggggagccccgctt

SEQ ID NO: 20223 - DNA, 21 bp, Artificial Sequence
  Artificial sequence related to HLA knockouts in cell therapy
ggccgcggggagccccgcttc

SEQ ID NO: 20224 - DNA, 21 bp, Artificial Sequence
  Artificial sequence related to HLA knockouts in cell therapy
gccgcggggagccccgcttca

SEQ ID NO: 20225 - DNA, 21 bp, Artificial Sequence
  Artificial sequence related to HLA knockouts in cell therapy
ccgcggggagccccgcttcat

SEQ ID NO: 20226 - DNA, 21 bp, Artificial Sequence
  Artificial sequence related to HLA knockouts in cell therapy
cgcggggagccccgcttcatc

SEQ ID NO: 20227 - DNA, 21 bp, Artificial Sequence
  Artificial sequence related to HLA knockouts in cell therapy
gcggggagccccgcttcatcg

SEQ ID NO: 20228 - DNA, 21 bp, Artificial Sequence
  Artificial sequence related to HLA knockouts in cell therapy
cggggagccccgcttcatcgc

SEQ ID NO: 20229 - DNA, 21 bp, Artificial Sequence
  Artificial sequence related to HLA knockouts in cell therapy
ggggagccccgcttcatcgca

SEQ ID NO: 20230 - DNA, 21 bp, Artificial Sequence
  Artificial sequence related to HLA knockouts in cell therapy
gggagccccgcttcatcgcag

SEQ ID NO: 20231 - DNA, 21 bp, Artificial Sequence
  Artificial sequence related to HLA knockouts in cell therapy
ggagccccgcttcatcgcagt

SEQ ID NO: 20232 - DNA, 21 bp, Artificial Sequence
  Artificial sequence related to HLA knockouts in cell therapy
gagccccgcttcatcgcagtg

SEQ ID NO: 20233 - DNA, 21 bp, Artificial Sequence
  Artificial sequence related to HLA knockouts in cell therapy
agccccgcttcatcgcagtgg

SEQ ID NO: 20234 - DNA, 21 bp, Artificial Sequence
  Artificial sequence related to HLA knockouts in cell therapy
gccccgcttcatcgcagtggg

SEQ ID NO: 20235 - DNA, 21 bp, Artificial Sequence
  Artificial sequence related to HLA knockouts in cell therapy
ccccgcttcatcgcagtgggc

SEQ ID NO: 20236 - DNA, 21 bp, Artificial Sequence
  Artificial sequence related to HLA knockouts in cell therapy
cccgcttcatcgcagtgggct

SEQ ID NO: 20237 - DNA, 21 bp, Artificial Sequence
  Artificial sequence related to HLA knockouts in cell therapy
ccgcttcatcgcagtgggcta

SEQ ID NO: 20238 - DNA, 21 bp, Artificial Sequence
  Artificial sequence related to HLA knockouts in cell therapy
cgcttcatcgcagtgggctac

SEQ ID NO: 20239 - DNA, 21 bp, Artificial Sequence
  Artificial sequence related to HLA knockouts in cell therapy
gcttcatcgcagtgggctacg

SEQ ID NO: 20240 - DNA, 21 bp, Artificial Sequence
  Artificial sequence related to HLA knockouts in cell therapy
tcatcgcagtgggctacgtgg

SEQ ID NO: 20241 - DNA, 21 bp, Artificial Sequence
  Artificial sequence related to HLA knockouts in cell therapy
catcgcagtgggctacgtgga

SEQ ID NO: 20242 - DNA, 21 bp, Artificial Sequence
  Artificial sequence related to HLA knockouts in cell therapy
atcgcagtgggctacgtggac

SEQ ID NO: 20243 - DNA, 21 bp, Artificial Sequence
  Artificial sequence related to HLA knockouts in cell therapy
tcgcagtgggctacgtggacg

SEQ ID NO: 20244 - DNA, 21 bp, Artificial Sequence
  Artificial sequence related to HLA knockouts in cell therapy
cgcagtgggctacgtggacga

SEQ ID NO: 20245 - DNA, 21 bp, Artificial Sequence
  Artificial sequence related to HLA knockouts in cell therapy
gcagtgggctacgtggacgac

SEQ ID NO: 20246 - DNA, 21 bp, Artificial Sequence
  Artificial sequence related to HLA knockouts in cell therapy
cagtgggctacgtggacgaca

SEQ ID NO: 20247 - DNA, 21 bp, Artificial Sequence
  Artificial sequence related to HLA knockouts in cell therapy
agtgggctacgtggacgacac

SEQ ID NO: 20248 - DNA, 21 bp, Artificial Sequence
  Artificial sequence related to HLA knockouts in cell therapy
gtgggctacgtggacgacacg

SEQ ID NO: 20249 - DNA, 21 bp, Artificial Sequence
  Artificial sequence related to HLA knockouts in cell therapy
tgggctacgtggacgacacgc

SEQ ID NO: 20250 - DNA, 21 bp, Artificial Sequence
  Artificial sequence related to HLA knockouts in cell therapy
gggctacgtggacgacacgca

SEQ ID NO: 20251 - DNA, 21 bp, Artificial Sequence
  Artificial sequence related to HLA knockouts in cell therapy
ggctacgtggacgacacgcag

SEQ ID NO: 20252 - DNA, 21 bp, Artificial Sequence
  Artificial sequence related to HLA knockouts in cell therapy
gctacgtggacgacacgcagt

SEQ ID NO: 20253 - DNA, 21 bp, Artificial Sequence
  Artificial sequence related to HLA knockouts in cell therapy
acgtggacgacacgcagttcg

SEQ ID NO: 20254 - DNA, 21 bp, Artificial Sequence
  Artificial sequence related to HLA knockouts in cell therapy
cgtggacgacacgcagttcgt

SEQ ID NO: 20255 - DNA, 21 bp, Artificial Sequence
  Artificial sequence related to HLA knockouts in cell therapy
gtggacgacacgcagttcgtg

SEQ ID NO: 20256 - DNA, 21 bp, Artificial Sequence
  Artificial sequence related to HLA knockouts in cell therapy
tggacgacacgcagttcgtgc

SEQ ID NO: 20257 - DNA, 21 bp, Artificial Sequence
  Artificial sequence related to HLA knockouts in cell therapy
ggacgacacgcagttcgtgcg

SEQ ID NO: 20258 - DNA, 21 bp, Artificial Sequence
  Artificial sequence related to HLA knockouts in cell therapy
gacgacacgcagttcgtgcgg

SEQ ID NO: 20259 - DNA, 21 bp, Artificial Sequence
  Artificial sequence related to HLA knockouts in cell therapy
acgacacgcagttcgtgcggt

SEQ ID NO: 20260 - DNA, 21 bp, Artificial Sequence
  Artificial sequence related to HLA knockouts in cell therapy
cgacacgcagttcgtgcggtt

SEQ ID NO: 20261 - DNA, 21 bp, Artificial Sequence
  Artificial sequence related to HLA knockouts in cell therapy
gacacgcagttcgtgcggttc

SEQ ID NO: 20262 - DNA, 21 bp, Artificial Sequence
  Artificial sequence related to HLA knockouts in cell therapy
acacgcagttcgtgcggttcg

SEQ ID NO: 20263 - DNA, 21 bp, Artificial Sequence
  Artificial sequence related to HLA knockouts in cell therapy
cacgcagttcgtgcggttcga

SEQ ID NO: 20264 - DNA, 21 bp, Artificial Sequence
  Artificial sequence related to HLA knockouts in cell therapy
acgcagttcgtgcggttcgac

SEQ ID NO: 20265 - DNA, 21 bp, Artificial Sequence
  Artificial sequence related to HLA knockouts in cell therapy
cgcagttcgtgcggttcgaca

SEQ ID NO: 20266 - DNA, 21 bp, Artificial Sequence
  Artificial sequence related to HLA knockouts in cell therapy
gcagttcgtgcggttcgacag

SEQ ID NO: 20267 - DNA, 21 bp, Artificial Sequence
  Artificial sequence related to HLA knockouts in cell therapy
cagttcgtgcggttcgacagc

SEQ ID NO: 20268 - DNA, 21 bp, Artificial Sequence
  Artificial sequence related to HLA knockouts in cell therapy
agttcgtgcggttcgacagcg

SEQ ID NO: 20269 - DNA, 21 bp, Artificial Sequence
  Artificial sequence related to HLA knockouts in cell therapy
gttcgtgcggttcgacagcga

SEQ ID NO: 20270 - DNA, 21 bp, Artificial Sequence
  Artificial sequence related to HLA knockouts in cell therapy
ttcgtgcggttcgacagcgac

SEQ ID NO: 20271 - DNA, 21 bp, Artificial Sequence
  Artificial sequence related to HLA knockouts in cell therapy
tcgtgcggttcgacagcgacg

SEQ ID NO: 20272 - DNA, 21 bp, Artificial Sequence
  Artificial sequence related to HLA knockouts in cell therapy
cgtgcggttcgacagcgacgc

SEQ ID NO: 20273 - DNA, 21 bp, Artificial Sequence
  Artificial sequence related to HLA knockouts in cell therapy
gtgcggttcgacagcgacgcc

SEQ ID NO: 20274 - DNA, 21 bp, Artificial Sequence
  Artificial sequence related to HLA knockouts in cell therapy
tgcggttcgacagcgacgccg

SEQ ID NO: 20275 - DNA, 21 bp, Artificial Sequence
  Artificial sequence related to HLA knockouts in cell therapy
gcggttcgacagcgacgccgc

SEQ ID NO: 20276 - DNA, 21 bp, Artificial Sequence
  Artificial sequence related to HLA knockouts in cell therapy
cggttcgacagcgacgccgcg

SEQ ID NO: 20277 - DNA, 21 bp, Artificial Sequence
  Artificial sequence related to HLA knockouts in cell therapy
ggttcgacagcgacgccgcga

SEQ ID NO: 20278 - DNA, 21 bp, Artificial Sequence
  Artificial sequence related to HLA knockouts in cell therapy
gttcgacagcgacgccgcgag

SEQ ID NO: 20279 - DNA, 21 bp, Artificial Sequence
  Artificial sequence related to HLA knockouts in cell therapy
ttcgacagcgacgccgcgagc

SEQ ID NO: 20280 - DNA, 21 bp, Artificial Sequence
  Artificial sequence related to HLA knockouts in cell therapy
tcgacagcgacgccgcgagcc

SEQ ID NO: 20281 - DNA, 21 bp, Artificial Sequence
  Artificial sequence related to HLA knockouts in cell therapy
cgacagcgacgccgcgagcca

SEQ ID NO: 20282 - DNA, 21 bp, Artificial Sequence
  Artificial sequence related to HLA knockouts in cell therapy
gacagcgacgccgcgagccag

SEQ ID NO: 20283 - DNA, 21 bp, Artificial Sequence
  Artificial sequence related to HLA knockouts in cell therapy
acagcgacgccgcgagccaga

SEQ ID NO: 20284 - DNA, 21 bp, Artificial Sequence
  Artificial sequence related to HLA knockouts in cell therapy
cagcgacgccgcgagccagag

SEQ ID NO: 20285 - DNA, 21 bp, Artificial Sequence
  Artificial sequence related to HLA knockouts in cell therapy
agcgacgccgcgagccagagg

SEQ ID NO: 20286 - DNA, 21 bp, Artificial Sequence
  Artificial sequence related to HLA knockouts in cell therapy
gcgacgccgcgagccagagga

SEQ ID NO: 20287 - DNA, 21 bp, Artificial Sequence
  Artificial sequence related to HLA knockouts in cell therapy
cgacgccgcgagccagaggat

SEQ ID NO: 20288 - DNA, 21 bp, Artificial Sequence
  Artificial sequence related to HLA knockouts in cell therapy
gacgccgcgagccagaggatg

SEQ ID NO: 20289 - DNA, 21 bp, Artificial Sequence
  Artificial sequence related to HLA knockouts in cell therapy
acgccgcgagccagaggatgg

SEQ ID NO: 20290 - DNA, 21 bp, Artificial Sequence
  Artificial sequence related to HLA knockouts in cell therapy
cgccgcgagccagaggatgga

SEQ ID NO: 20291 - DNA, 21 bp, Artificial Sequence
  Artificial sequence related to HLA knockouts in cell therapy
gccgcgagccagaggatggag

SEQ ID NO: 20292 - DNA, 21 bp, Artificial Sequence
  Artificial sequence related to HLA knockouts in cell therapy
ccgcgagccagaggatggagc

SEQ ID NO: 20293 - DNA, 21 bp, Artificial Sequence
  Artificial sequence related to HLA knockouts in cell therapy
cgcgagccagaggatggagcc

SEQ ID NO: 20294 - DNA, 21 bp, Artificial Sequence
  Artificial sequence related to HLA knockouts in cell therapy
gcgagccagaggatggagccg

SEQ ID NO: 20295 - DNA, 21 bp, Artificial Sequence
  Artificial sequence related to HLA knockouts in cell therapy
cgagccagaggatggagccgc

SEQ ID NO: 20296 - DNA, 21 bp, Artificial Sequence
  Artificial sequence related to HLA knockouts in cell therapy
gagccagaggatggagccgcg

SEQ ID NO: 20297 - DNA, 21 bp, Artificial Sequence
  Artificial sequence related to HLA knockouts in cell therapy
agccagaggatggagccgcgg

SEQ ID NO: 20298 - DNA, 21 bp, Artificial Sequence
  Artificial sequence related to HLA knockouts in cell therapy
gccagaggatggagccgcggg

SEQ ID NO: 20299 - DNA, 21 bp, Artificial Sequence
  Artificial sequence related to HLA knockouts in cell therapy
ccagaggatggagccgcgggc

SEQ ID NO: 20300 - DNA, 21 bp, Artificial Sequence
  Artificial sequence related to HLA knockouts in cell therapy
cagaggatggagccgcgggcg

SEQ ID NO: 20301 - DNA, 21 bp, Artificial Sequence
  Artificial sequence related to HLA knockouts in cell therapy
agaggatggagccgcgggcgc

SEQ ID NO: 20302 - DNA, 21 bp, Artificial Sequence
  Artificial sequence related to HLA knockouts in cell therapy
gaggatggagccgcgggcgcc

SEQ ID NO: 20303 - DNA, 21 bp, Artificial Sequence
  Artificial sequence related to HLA knockouts in cell therapy
aggatggagccgcgggcgccg

SEQ ID NO: 20304 - DNA, 21 bp, Artificial Sequence
  Artificial sequence related to HLA knockouts in cell therapy
ggatggagccgcgggcgccgt

SEQ ID NO: 20305 - DNA, 21 bp, Artificial Sequence
  Artificial sequence related to HLA knockouts in cell therapy
gatggagccgcgggcgccgtg

SEQ ID NO: 20306 - DNA, 21 bp, Artificial Sequence
  Artificial sequence related to HLA knockouts in cell therapy
atggagccgcgggcgccgtgg

SEQ ID NO: 20307 - DNA, 21 bp, Artificial Sequence
  Artificial sequence related to HLA knockouts in cell therapy
tggagccgcgggcgccgtgga

SEQ ID NO: 20308 - DNA, 21 bp, Artificial Sequence
  Artificial sequence related to HLA knockouts in cell therapy
ggagccgcgggcgccgtggat

SEQ ID NO: 20309 - DNA, 21 bp, Artificial Sequence
  Artificial sequence related to HLA knockouts in cell therapy
gagccgcgggcgccgtggata

SEQ ID NO: 20310 - DNA, 21 bp, Artificial Sequence
  Artificial sequence related to HLA knockouts in cell therapy
agccgcgggcgccgtggatag

SEQ ID NO: 20311 - DNA, 21 bp, Artificial Sequence
  Artificial sequence related to HLA knockouts in cell therapy
gccgcgggcgccgtggataga

SEQ ID NO: 20312 - DNA, 21 bp, Artificial Sequence
  Artificial sequence related to HLA knockouts in cell therapy
ccgcgggcgccgtggatagag

SEQ ID NO: 20313 - DNA, 21 bp, Artificial Sequence
  Artificial sequence related to HLA knockouts in cell therapy
cgcgggcgccgtggatagagc

SEQ ID NO: 20314 - DNA, 21 bp, Artificial Sequence
  Artificial sequence related to HLA knockouts in cell therapy
gcgggcgccgtggatagagca

SEQ ID NO: 20315 - DNA, 21 bp, Artificial Sequence
  Artificial sequence related to HLA knockouts in cell therapy
cgggcgccgtggatagagcag

SEQ ID NO: 20316 - DNA, 21 bp, Artificial Sequence
  Artificial sequence related to HLA knockouts in cell therapy
gggcgccgtggatagagcagg

SEQ ID NO: 20317 - DNA, 21 bp, Artificial Sequence
  Artificial sequence related to HLA knockouts in cell therapy
ggcgccgtggatagagcagga

SEQ ID NO: 20318 - DNA, 21 bp, Artificial Sequence
  Artificial sequence related to HLA knockouts in cell therapy
gcgccgtggatagagcaggag

SEQ ID NO: 20319 - DNA, 21 bp, Artificial Sequence
  Artificial sequence related to HLA knockouts in cell therapy
cgccgtggatagagcaggagg

SEQ ID NO: 20320 - DNA, 21 bp, Artificial Sequence
  Artificial sequence related to HLA knockouts in cell therapy
gccgtggatagagcaggaggg

SEQ ID NO: 20321 - DNA, 21 bp, Artificial Sequence
  Artificial sequence related to HLA knockouts in cell therapy
ccgtggatagagcaggagggt

SEQ ID NO: 20322 - DNA, 21 bp, Artificial Sequence
  Artificial sequence related to HLA knockouts in cell therapy
cgtggatagagcaggagggtc

SEQ ID NO: 20323 - DNA, 21 bp, Artificial Sequence
  Artificial sequence related to HLA knockouts in cell therapy
gtggatagagcaggagggtcc

SEQ ID NO: 20324 - DNA, 21 bp, Artificial Sequence
  Artificial sequence related to HLA knockouts in cell therapy
tggatagagcaggagggtccg

SEQ ID NO: 20325 - DNA, 21 bp, Artificial Sequence
  Artificial sequence related to HLA knockouts in cell therapy
ggatagagcaggagggtccgg

SEQ ID NO: 20326 - DNA, 21 bp, Artificial Sequence
  Artificial sequence related to HLA knockouts in cell therapy
gatagagcaggagggtccgga

SEQ ID NO: 20327 - DNA, 21 bp, Artificial Sequence
  Artificial sequence related to HLA knockouts in cell therapy
atagagcaggagggtccggag

SEQ ID NO: 20328 - DNA, 21 bp, Artificial Sequence
  Artificial sequence related to HLA knockouts in cell therapy
tagagcaggagggtccggagt

SEQ ID NO: 20329 - DNA, 21 bp, Artificial Sequence
  Artificial sequence related to HLA knockouts in cell therapy
agagcaggagggtccggagta

SEQ ID NO: 20330 - DNA, 21 bp, Artificial Sequence
  Artificial sequence related to HLA knockouts in cell therapy
gagcaggagggtccggagtat

SEQ ID NO: 20331 - DNA, 21 bp, Artificial Sequence
  Artificial sequence related to HLA knockouts in cell therapy
gcaggagggtccggagtattg

SEQ ID NO: 20332 - DNA, 21 bp, Artificial Sequence
  Artificial sequence related to HLA knockouts in cell therapy
caggagggtccggagtattgg

SEQ ID NO: 20333 - DNA, 21 bp, Artificial Sequence
  Artificial sequence related to HLA knockouts in cell therapy
aggagggtccggagtattggg

SEQ ID NO: 20334 - DNA, 21 bp, Artificial Sequence
  Artificial sequence related to HLA knockouts in cell therapy
ggagggtccggagtattggga

SEQ ID NO: 20335 - DNA, 21 bp, Artificial Sequence
  Artificial sequence related to HLA knockouts in cell therapy
gagggtccggagtattgggac

SEQ ID NO: 20336 - DNA, 21 bp, Artificial Sequence
  Artificial sequence related to HLA knockouts in cell therapy
agggtccggagtattgggacg

SEQ ID NO: 20337 - DNA, 21 bp, Artificial Sequence
  Artificial sequence related to HLA knockouts in cell therapy
gggtccggagtattgggacgg

SEQ ID NO: 20338 - DNA, 21 bp, Artificial Sequence
  Artificial sequence related to HLA knockouts in cell therapy
ggtccggagtattgggacggg

SEQ ID NO: 20339 - DNA, 21 bp, Artificial Sequence
  Artificial sequence related to HLA knockouts in cell therapy
gtccggagtattgggacgggg

SEQ ID NO: 20340 - DNA, 21 bp, Artificial Sequence
  Artificial sequence related to HLA knockouts in cell therapy
tccggagtattgggacgggga

SEQ ID NO: 20341 - DNA, 21 bp, Artificial Sequence
  Artificial sequence related to HLA knockouts in cell therapy
ccggagtattgggacggggag

SEQ ID NO: 20342 - DNA, 21 bp, Artificial Sequence
  Artificial sequence related to HLA knockouts in cell therapy
cggagtattgggacggggaga

SEQ ID NO: 20343 - DNA, 21 bp, Artificial Sequence
  Artificial sequence related to HLA knockouts in cell therapy
ggagtattgggacggggagac

SEQ ID NO: 20344 - DNA, 21 bp, Artificial Sequence
  Artificial sequence related to HLA knockouts in cell therapy
gtattgggacggggagacacg

SEQ ID NO: 20345 - DNA, 21 bp, Artificial Sequence
  Artificial sequence related to HLA knockouts in cell therapy
tattgggacggggagacacgg

SEQ ID NO: 20346 - DNA, 21 bp, Artificial Sequence
  Artificial sequence related to HLA knockouts in cell therapy
attgggacggggagacacgga

SEQ ID NO: 20347 - DNA, 21 bp, Artificial Sequence
  Artificial sequence related to HLA knockouts in cell therapy
ttgggacggggagacacggaa

SEQ ID NO: 20348 - DNA, 21 bp, Artificial Sequence
  Artificial sequence related to HLA knockouts in cell therapy
tgggacggggagacacggaaa

SEQ ID NO: 20349 - DNA, 21 bp, Artificial Sequence
  Artificial sequence related to HLA knockouts in cell therapy
gggacggggagacacggaaag

SEQ ID NO: 20350 - DNA, 21 bp, Artificial Sequence
  Artificial sequence related to HLA knockouts in cell therapy
ggacggggagacacggaaagt

SEQ ID NO: 20351 - DNA, 21 bp, Artificial Sequence
  Artificial sequence related to HLA knockouts in cell therapy
gacggggagacacggaaagtg

SEQ ID NO: 20352 - DNA, 21 bp, Artificial Sequence
  Artificial sequence related to HLA knockouts in cell therapy
aggcccactcacagactcacc

SEQ ID NO: 20353 - DNA, 21 bp, Artificial Sequence
  Artificial sequence related to HLA knockouts in cell therapy
ggcccactcacagactcaccg

SEQ ID NO: 20354 - DNA, 21 bp, Artificial Sequence
  Artificial sequence related to HLA knockouts in cell therapy
gcccactcacagactcaccga

SEQ ID NO: 20355 - DNA, 21 bp, Artificial Sequence
  Artificial sequence related to HLA knockouts in cell therapy
cccactcacagactcaccgag

SEQ ID NO: 20356 - DNA, 21 bp, Artificial Sequence
  Artificial sequence related to HLA knockouts in cell therapy
cacagactcaccgagtggacc

SEQ ID NO: 20357 - DNA, 21 bp, Artificial Sequence
  Artificial sequence related to HLA knockouts in cell therapy
cagactcaccgagtggacctg

SEQ ID NO: 20358 - DNA, 21 bp, Artificial Sequence
  Artificial sequence related to HLA knockouts in cell therapy
agactcaccgagtggacctgg

SEQ ID NO: 20359 - DNA, 21 bp, Artificial Sequence
  Artificial sequence related to HLA knockouts in cell therapy
gactcaccgagtggacctggg

SEQ ID NO: 20360 - DNA, 21 bp, Artificial Sequence
  Artificial sequence related to HLA knockouts in cell therapy
actcaccgagtggacctgggg

SEQ ID NO: 20361 - DNA, 21 bp, Artificial Sequence
  Artificial sequence related to HLA knockouts in cell therapy
ctcaccgagtggacctgggga

SEQ ID NO: 20362 - DNA, 21 bp, Artificial Sequence
  Artificial sequence related to HLA knockouts in cell therapy
tcaccgagtggacctggggac

SEQ ID NO: 20363 - DNA, 21 bp, Artificial Sequence
  Artificial sequence related to HLA knockouts in cell therapy
caccgagtggacctggggacc

SEQ ID NO: 20364 - DNA, 21 bp, Artificial Sequence
  Artificial sequence related to HLA knockouts in cell therapy
accgagtggacctggggaccc

SEQ ID NO: 20365 - DNA, 21 bp, Artificial Sequence
  Artificial sequence related to HLA knockouts in cell therapy
ccgagtggacctggggaccct

SEQ ID NO: 20366 - DNA, 21 bp, Artificial Sequence
  Artificial sequence related to HLA knockouts in cell therapy
cgagtggacctggggaccctg

SEQ ID NO: 20367 - DNA, 21 bp, Artificial Sequence
  Artificial sequence related to HLA knockouts in cell therapy
gagtggacctggggaccctgc

SEQ ID NO: 20368 - DNA, 21 bp, Artificial Sequence
  Artificial sequence related to HLA knockouts in cell therapy
agtggacctggggaccctgcg

SEQ ID NO: 20369 - DNA, 21 bp, Artificial Sequence
  Artificial sequence related to HLA knockouts in cell therapy
gtggacctggggaccctgcgc

SEQ ID NO: 20370 - DNA, 21 bp, Artificial Sequence
  Artificial sequence related to HLA knockouts in cell therapy
tggacctggggaccctgcgcg

SEQ ID NO: 20371 - DNA, 21 bp, Artificial Sequence
  Artificial sequence related to HLA knockouts in cell therapy
ggacctggggaccctgcgcgg

SEQ ID NO: 20372 - DNA, 21 bp, Artificial Sequence
  Artificial sequence related to HLA knockouts in cell therapy
gacctggggaccctgcgcggc

SEQ ID NO: 20373 - DNA, 21 bp, Artificial Sequence
  Artificial sequence related to HLA knockouts in cell therapy
acctggggaccctgcgcggct

SEQ ID NO: 20374 - DNA, 21 bp, Artificial Sequence
  Artificial sequence related to HLA knockouts in cell therapy
cctggggaccctgcgcggcta

SEQ ID NO: 20375 - DNA, 21 bp, Artificial Sequence
  Artificial sequence related to HLA knockouts in cell therapy
ctggggaccctgcgcggctac

SEQ ID NO: 20376 - DNA, 21 bp, Artificial Sequence
  Artificial sequence related to HLA knockouts in cell therapy
tggggaccctgcgcggctact

SEQ ID NO: 20377 - DNA, 21 bp, Artificial Sequence
  Artificial sequence related to HLA knockouts in cell therapy
ggggaccctgcgcggctacta

SEQ ID NO: 20378 - DNA, 21 bp, Artificial Sequence
  Artificial sequence related to HLA knockouts in cell therapy
gggaccctgcgcggctactac

SEQ ID NO: 20379 - DNA, 21 bp, Artificial Sequence
  Artificial sequence related to HLA knockouts in cell therapy
ggaccctgcgcggctactaca

SEQ ID NO: 20380 - DNA, 21 bp, Artificial Sequence
  Artificial sequence related to HLA knockouts in cell therapy
gaccctgcgcggctactacaa

SEQ ID NO: 20381 - DNA, 21 bp, Artificial Sequence
  Artificial sequence related to HLA knockouts in cell therapy
accctgcgcggctactacaac

SEQ ID NO: 20382 - DNA, 21 bp, Artificial Sequence
  Artificial sequence related to HLA knockouts in cell therapy
ccctgcgcggctactacaacc

SEQ ID NO: 20383 - DNA, 21 bp, Artificial Sequence
  Artificial sequence related to HLA knockouts in cell therapy
cctgcgcggctactacaacca

SEQ ID NO: 20384 - DNA, 21 bp, Artificial Sequence
  Artificial sequence related to HLA knockouts in cell therapy
ctgcgcggctactacaaccag

SEQ ID NO: 20385 - DNA, 21 bp, Artificial Sequence
  Artificial sequence related to HLA knockouts in cell therapy
gcgcggctactacaaccagag

SEQ ID NO: 20386 - DNA, 21 bp, Artificial Sequence
  Artificial sequence related to HLA knockouts in cell therapy
cgcggctactacaaccagagc

SEQ ID NO: 20387 - DNA, 21 bp, Artificial Sequence
  Artificial sequence related to HLA knockouts in cell therapy
gcggctactacaaccagagcg

SEQ ID NO: 20388 - DNA, 21 bp, Artificial Sequence
  Artificial sequence related to HLA knockouts in cell therapy
actacaaccagagcgaggccg

SEQ ID NO: 20389 - DNA, 21 bp, Artificial Sequence
  Artificial sequence related to HLA knockouts in cell therapy
ctacaaccagagcgaggccgg

SEQ ID NO: 20390 - DNA, 21 bp, Artificial Sequence
  Artificial sequence related to HLA knockouts in cell therapy
tacaaccagagcgaggccggt

SEQ ID NO: 20391 - DNA, 21 bp, Artificial Sequence
  Artificial sequence related to HLA knockouts in cell therapy
acaaccagagcgaggccggtt

SEQ ID NO: 20392 - DNA, 21 bp, Artificial Sequence
  Artificial sequence related to HLA knockouts in cell therapy
caaccagagcgaggccggttc

SEQ ID NO: 20393 - DNA, 21 bp, Artificial Sequence
  Artificial sequence related to HLA knockouts in cell therapy
aaccagagcgaggccggttct

SEQ ID NO: 20394 - DNA, 21 bp, Artificial Sequence
  Artificial sequence related to HLA knockouts in cell therapy
accagagcgaggccggttctc

SEQ ID NO: 20395 - DNA, 21 bp, Artificial Sequence
  Artificial sequence related to HLA knockouts in cell therapy
ccagagcgaggccggttctca

SEQ ID NO: 20396 - DNA, 21 bp, Artificial Sequence
  Artificial sequence related to HLA knockouts in cell therapy
cagagcgaggccggttctcac

SEQ ID NO: 20397 - DNA, 21 bp, Artificial Sequence
  Artificial sequence related to HLA knockouts in cell therapy
agagcgaggccggttctcaca

SEQ ID NO: 20398 - DNA, 21 bp, Artificial Sequence
  Artificial sequence related to HLA knockouts in cell therapy
gagcgaggccggttctcacac

SEQ ID NO: 20399 - DNA, 21 bp, Artificial Sequence
  Artificial sequence related to HLA knockouts in cell therapy
agcgaggccggttctcacacc

SEQ ID NO: 20400 - DNA, 21 bp, Artificial Sequence
  Artificial sequence related to HLA knockouts in cell therapy
gcgaggccggttctcacaccg

SEQ ID NO: 20401 - DNA, 21 bp, Artificial Sequence
  Artificial sequence related to HLA knockouts in cell therapy
cgaggccggttctcacaccgt

SEQ ID NO: 20402 - DNA, 21 bp, Artificial Sequence
  Artificial sequence related to HLA knockouts in cell therapy
gaggccggttctcacaccgtc

SEQ ID NO: 20403 - DNA, 21 bp, Artificial Sequence
  Artificial sequence related to HLA knockouts in cell therapy
aggccggttctcacaccgtcc

SEQ ID NO: 20404 - DNA, 21 bp, Artificial Sequence
  Artificial sequence related to HLA knockouts in cell therapy
ggccggttctcacaccgtcca

SEQ ID NO: 20405 - DNA, 21 bp, Artificial Sequence
  Artificial sequence related to HLA knockouts in cell therapy
gccggttctcacaccgtccag

SEQ ID NO: 20406 - DNA, 21 bp, Artificial Sequence
  Artificial sequence related to HLA knockouts in cell therapy
ccggttctcacaccgtccaga

SEQ ID NO: 20407 - DNA, 21 bp, Artificial Sequence
  Artificial sequence related to HLA knockouts in cell therapy
cggttctcacaccgtccagag

SEQ ID NO: 20408 - DNA, 21 bp, Artificial Sequence
  Artificial sequence related to HLA knockouts in cell therapy
ggttctcacaccgtccagagg

SEQ ID NO: 20409 - DNA, 21 bp, Artificial Sequence
  Artificial sequence related to HLA knockouts in cell therapy
ggatgtatggctgcgacgtgg

SEQ ID NO: 20410 - DNA, 21 bp, Artificial Sequence
  Artificial sequence related to HLA knockouts in cell therapy
gatgtatggctgcgacgtggg

SEQ ID NO: 20411 - DNA, 21 bp, Artificial Sequence
  Artificial sequence related to HLA knockouts in cell therapy
atgtatggctgcgacgtgggg

SEQ ID NO: 20412 - DNA, 21 bp, Artificial Sequence
  Artificial sequence related to HLA knockouts in cell therapy
tgtatggctgcgacgtggggt

SEQ ID NO: 20413 - DNA, 21 bp, Artificial Sequence
  Artificial sequence related to HLA knockouts in cell therapy
gtatggctgcgacgtggggtc

SEQ ID NO: 20414 - DNA, 21 bp, Artificial Sequence
  Artificial sequence related to HLA knockouts in cell therapy
tatggctgcgacgtggggtcg

SEQ ID NO: 20415 - DNA, 21 bp, Artificial Sequence
  Artificial sequence related to HLA knockouts in cell therapy
atggctgcgacgtggggtcgg

SEQ ID NO: 20416 - DNA, 21 bp, Artificial Sequence
  Artificial sequence related to HLA knockouts in cell therapy
tggctgcgacgtggggtcgga

SEQ ID NO: 20417 - DNA, 21 bp, Artificial Sequence
  Artificial sequence related to HLA knockouts in cell therapy
ggctgcgacgtggggtcggac

SEQ ID NO: 20418 - DNA, 21 bp, Artificial Sequence
  Artificial sequence related to HLA knockouts in cell therapy
gctgcgacgtggggtcggact

SEQ ID NO: 20419 - DNA, 21 bp, Artificial Sequence
  Artificial sequence related to HLA knockouts in cell therapy
ctgcgacgtggggtcggactg

SEQ ID NO: 20420 - DNA, 21 bp, Artificial Sequence
  Artificial sequence related to HLA knockouts in cell therapy
tgcgacgtggggtcggactgg

SEQ ID NO: 20421 - DNA, 21 bp, Artificial Sequence
  Artificial sequence related to HLA knockouts in cell therapy
gcgacgtggggtcggactggc

SEQ ID NO: 20422 - DNA, 21 bp, Artificial Sequence
  Artificial sequence related to HLA knockouts in cell therapy
cgacgtggggtcggactggcg

SEQ ID NO: 20423 - DNA, 21 bp, Artificial Sequence
  Artificial sequence related to HLA knockouts in cell therapy
gacgtggggtcggactggcgc

SEQ ID NO: 20424 - DNA, 21 bp, Artificial Sequence
  Artificial sequence related to HLA knockouts in cell therapy
acgtggggtcggactggcgct

SEQ ID NO: 20425 - DNA, 21 bp, Artificial Sequence
  Artificial sequence related to HLA knockouts in cell therapy
cgtggggtcggactggcgctt

SEQ ID NO: 20426 - DNA, 21 bp, Artificial Sequence
  Artificial sequence related to HLA knockouts in cell therapy
gtggggtcggactggcgcttc

SEQ ID NO: 20427 - DNA, 21 bp, Artificial Sequence
  Artificial sequence related to HLA knockouts in cell therapy
tggggtcggactggcgcttcc

SEQ ID NO: 20428 - DNA, 21 bp, Artificial Sequence
  Artificial sequence related to HLA knockouts in cell therapy
ggggtcggactggcgcttcct

SEQ ID NO: 20429 - DNA, 21 bp, Artificial Sequence
  Artificial sequence related to HLA knockouts in cell therapy
gggtcggactggcgcttcctc

SEQ ID NO: 20430 - DNA, 21 bp, Artificial Sequence
  Artificial sequence related to HLA knockouts in cell therapy
ggtcggactggcgcttcctcc

SEQ ID NO: 20431 - DNA, 21 bp, Artificial Sequence
  Artificial sequence related to HLA knockouts in cell therapy
gtcggactggcgcttcctccg

SEQ ID NO: 20432 - DNA, 21 bp, Artificial Sequence
  Artificial sequence related to HLA knockouts in cell therapy
tcggactggcgcttcctccgc

SEQ ID NO: 20433 - DNA, 21 bp, Artificial Sequence
  Artificial sequence related to HLA knockouts in cell therapy
cggactggcgcttcctccgcg

SEQ ID NO: 20434 - DNA, 21 bp, Artificial Sequence
  Artificial sequence related to HLA knockouts in cell therapy
ggactggcgcttcctccgcgg

SEQ ID NO: 20435 - DNA, 21 bp, Artificial Sequence
  Artificial sequence related to HLA knockouts in cell therapy
gactggcgcttcctccgcggg

SEQ ID NO: 20436 - DNA, 21 bp, Artificial Sequence
  Artificial sequence related to HLA knockouts in cell therapy
actggcgcttcctccgcgggt

SEQ ID NO: 20437 - DNA, 21 bp, Artificial Sequence
  Artificial sequence related to HLA knockouts in cell therapy
ctggcgcttcctccgcgggta

SEQ ID NO: 20438 - DNA, 21 bp, Artificial Sequence
  Artificial sequence related to HLA knockouts in cell therapy
tggcgcttcctccgcgggtac

SEQ ID NO: 20439 - DNA, 21 bp, Artificial Sequence
  Artificial sequence related to HLA knockouts in cell therapy
ggcgcttcctccgcgggtacc

SEQ ID NO: 20440 - DNA, 21 bp, Artificial Sequence
  Artificial sequence related to HLA knockouts in cell therapy
gcgcttcctccgcgggtacca

SEQ ID NO: 20441 - DNA, 21 bp, Artificial Sequence
  Artificial sequence related to HLA knockouts in cell therapy
cgcttcctccgcgggtaccac

SEQ ID NO: 20442 - DNA, 21 bp, Artificial Sequence
  Artificial sequence related to HLA knockouts in cell therapy
gcttcctccgcgggtaccacc

SEQ ID NO: 20443 - DNA, 21 bp, Artificial Sequence
  Artificial sequence related to HLA knockouts in cell therapy
cttcctccgcgggtaccacca

SEQ ID NO: 20444 - DNA, 21 bp, Artificial Sequence
  Artificial sequence related to HLA knockouts in cell therapy
ttcctccgcgggtaccaccag

SEQ ID NO: 20445 - DNA, 21 bp, Artificial Sequence
  Artificial sequence related to HLA knockouts in cell therapy
tcctccgcgggtaccaccagt

SEQ ID NO: 20446 - DNA, 21 bp, Artificial Sequence
  Artificial sequence related to HLA knockouts in cell therapy
cctccgcgggtaccaccagta

SEQ ID NO: 20447 - DNA, 21 bp, Artificial Sequence
  Artificial sequence related to HLA knockouts in cell therapy
ctccgcgggtaccaccagtac

SEQ ID NO: 20448 - DNA, 21 bp, Artificial Sequence
  Artificial sequence related to HLA knockouts in cell therapy
tccgcgggtaccaccagtacg

SEQ ID NO: 20449 - DNA, 21 bp, Artificial Sequence
  Artificial sequence related to HLA knockouts in cell therapy
ccgcgggtaccaccagtacgc

SEQ ID NO: 20450 - DNA, 21 bp, Artificial Sequence
  Artificial sequence related to HLA knockouts in cell therapy
cgcgggtaccaccagtacgcc

SEQ ID NO: 20451 - DNA, 21 bp, Artificial Sequence
  Artificial sequence related to HLA knockouts in cell therapy
gcgggtaccaccagtacgcct

SEQ ID NO: 20452 - DNA, 21 bp, Artificial Sequence
  Artificial sequence related to HLA knockouts in cell therapy
cgggtaccaccagtacgccta

SEQ ID NO: 20453 - DNA, 21 bp, Artificial Sequence
  Artificial sequence related to HLA knockouts in cell therapy
gggtaccaccagtacgcctac

SEQ ID NO: 20454 - DNA, 21 bp, Artificial Sequence
  Artificial sequence related to HLA knockouts in cell therapy
ggtaccaccagtacgcctacg

SEQ ID NO: 20455 - DNA, 21 bp, Artificial Sequence
  Artificial sequence related to HLA knockouts in cell therapy
accaccagtacgcctacgacg

SEQ ID NO: 20456 - DNA, 21 bp, Artificial Sequence
  Artificial sequence related to HLA knockouts in cell therapy
ccaccagtacgcctacgacgg

SEQ ID NO: 20457 - DNA, 21 bp, Artificial Sequence
  Artificial sequence related to HLA knockouts in cell therapy
caccagtacgcctacgacggc

SEQ ID NO: 20458 - DNA, 21 bp, Artificial Sequence
  Artificial sequence related to HLA knockouts in cell therapy
accagtacgcctacgacggca

SEQ ID NO: 20459 - DNA, 21 bp, Artificial Sequence
  Artificial sequence related to HLA knockouts in cell therapy
ccagtacgcctacgacggcaa

SEQ ID NO: 20460 - DNA, 21 bp, Artificial Sequence
  Artificial sequence related to HLA knockouts in cell therapy
cagtacgcctacgacggcaag

SEQ ID NO: 20461 - DNA, 21 bp, Artificial Sequence
  Artificial sequence related to HLA knockouts in cell therapy
agtacgcctacgacggcaagg

SEQ ID NO: 20462 - DNA, 21 bp, Artificial Sequence
  Artificial sequence related to HLA knockouts in cell therapy
gtacgcctacgacggcaagga

SEQ ID NO: 20463 - DNA, 21 bp, Artificial Sequence
  Artificial sequence related to HLA knockouts in cell therapy
tcgccctgaaagaggacctgc

SEQ ID NO: 20464 - DNA, 21 bp, Artificial Sequence
  Artificial sequence related to HLA knockouts in cell therapy
cgccctgaaagaggacctgcg

SEQ ID NO: 20465 - DNA, 21 bp, Artificial Sequence
  Artificial sequence related to HLA knockouts in cell therapy
gccctgaaagaggacctgcgc

SEQ ID NO: 20466 - DNA, 21 bp, Artificial Sequence
  Artificial sequence related to HLA knockouts in cell therapy
ccctgaaagaggacctgcgct

SEQ ID NO: 20467 - DNA, 21 bp, Artificial Sequence
  Artificial sequence related to HLA knockouts in cell therapy
cctgaaagaggacctgcgctc

SEQ ID NO: 20468 - DNA, 21 bp, Artificial Sequence
  Artificial sequence related to HLA knockouts in cell therapy
agaggacctgcgctcttggac

SEQ ID NO: 20469 - DNA, 21 bp, Artificial Sequence
  Artificial sequence related to HLA knockouts in cell therapy
gaggacctgcgctcttggacc

SEQ ID NO: 20470 - DNA, 21 bp, Artificial Sequence
  Artificial sequence related to HLA knockouts in cell therapy
aggacctgcgctcttggaccg

SEQ ID NO: 20471 - DNA, 21 bp, Artificial Sequence
  Artificial sequence related to HLA knockouts in cell therapy
ggacctgcgctcttggaccgc

SEQ ID NO: 20472 - DNA, 21 bp, Artificial Sequence
  Artificial sequence related to HLA knockouts in cell therapy
gacctgcgctcttggaccgcg

SEQ ID NO: 20473 - DNA, 21 bp, Artificial Sequence
  Artificial sequence related to HLA knockouts in cell therapy
acctgcgctcttggaccgcgg

SEQ ID NO: 20474 - DNA, 21 bp, Artificial Sequence
  Artificial sequence related to HLA knockouts in cell therapy
cctgcgctcttggaccgcggc

SEQ ID NO: 20475 - DNA, 21 bp, Artificial Sequence
  Artificial sequence related to HLA knockouts in cell therapy
ctgcgctcttggaccgcggcg

SEQ ID NO: 20476 - DNA, 21 bp, Artificial Sequence
  Artificial sequence related to HLA knockouts in cell therapy
tgcgctcttggaccgcggcgg

SEQ ID NO: 20477 - DNA, 21 bp, Artificial Sequence
  Artificial sequence related to HLA knockouts in cell therapy
gcgctcttggaccgcggcgga

SEQ ID NO: 20478 - DNA, 21 bp, Artificial Sequence
  Artificial sequence related to HLA knockouts in cell therapy
cgctcttggaccgcggcggac

SEQ ID NO: 20479 - DNA, 21 bp, Artificial Sequence
  Artificial sequence related to HLA knockouts in cell therapy
gctcttggaccgcggcggaca

SEQ ID NO: 20480 - DNA, 21 bp, Artificial Sequence
  Artificial sequence related to HLA knockouts in cell therapy
ctcttggaccgcggcggacat

SEQ ID NO: 20481 - DNA, 21 bp, Artificial Sequence
  Artificial sequence related to HLA knockouts in cell therapy
tcttggaccgcggcggacatg

SEQ ID NO: 20482 - DNA, 21 bp, Artificial Sequence
  Artificial sequence related to HLA knockouts in cell therapy
cttggaccgcggcggacatgg

SEQ ID NO: 20483 - DNA, 21 bp, Artificial Sequence
  Artificial sequence related to HLA knockouts in cell therapy
ttggaccgcggcggacatggc

SEQ ID NO: 20484 - DNA, 21 bp, Artificial Sequence
  Artificial sequence related to HLA knockouts in cell therapy
tggaccgcggcggacatggca

SEQ ID NO: 20485 - DNA, 21 bp, Artificial Sequence
  Artificial sequence related to HLA knockouts in cell therapy
ggaccgcggcggacatggcag

SEQ ID NO: 20486 - DNA, 21 bp, Artificial Sequence
  Artificial sequence related to HLA knockouts in cell therapy
gaccgcggcggacatggcagc

SEQ ID NO: 20487 - DNA, 21 bp, Artificial Sequence
  Artificial sequence related to HLA knockouts in cell therapy
accgcggcggacatggcagct

SEQ ID NO: 20488 - DNA, 21 bp, Artificial Sequence
  Artificial sequence related to HLA knockouts in cell therapy
ccgcggcggacatggcagctc

SEQ ID NO: 20489 - DNA, 21 bp, Artificial Sequence
  Artificial sequence related to HLA knockouts in cell therapy
cgcggcggacatggcagctca

SEQ ID NO: 20490 - DNA, 21 bp, Artificial Sequence
  Artificial sequence related to HLA knockouts in cell therapy
gcggcggacatggcagctcag

SEQ ID NO: 20491 - DNA, 21 bp, Artificial Sequence
  Artificial sequence related to HLA knockouts in cell therapy
cggcggacatggcagctcaga

SEQ ID NO: 20492 - DNA, 21 bp, Artificial Sequence
  Artificial sequence related to HLA knockouts in cell therapy
ggcggacatggcagctcagac

SEQ ID NO: 20493 - DNA, 21 bp, Artificial Sequence
  Artificial sequence related to HLA knockouts in cell therapy
gcggacatggcagctcagacc

SEQ ID NO: 20494 - DNA, 21 bp, Artificial Sequence
  Artificial sequence related to HLA knockouts in cell therapy
cggacatggcagctcagacca

SEQ ID NO: 20495 - DNA, 21 bp, Artificial Sequence
  Artificial sequence related to HLA knockouts in cell therapy
ggacatggcagctcagaccac

SEQ ID NO: 20496 - DNA, 21 bp, Artificial Sequence
  Artificial sequence related to HLA knockouts in cell therapy
gacatggcagctcagaccacc

SEQ ID NO: 20497 - DNA, 21 bp, Artificial Sequence
  Artificial sequence related to HLA knockouts in cell therapy
tggcagctcagaccaccaagc

SEQ ID NO: 20498 - DNA, 21 bp, Artificial Sequence
  Artificial sequence related to HLA knockouts in cell therapy
ggcagctcagaccaccaagca

SEQ ID NO: 20499 - DNA, 21 bp, Artificial Sequence
  Artificial sequence related to HLA knockouts in cell therapy
gcagctcagaccaccaagcac

SEQ ID NO: 20500 - DNA, 21 bp, Artificial Sequence
  Artificial sequence related to HLA knockouts in cell therapy
ccaccaagcacaagtgggagg

SEQ ID NO: 20501 - DNA, 21 bp, Artificial Sequence
  Artificial sequence related to HLA knockouts in cell therapy
caccaagcacaagtgggaggc

SEQ ID NO: 20502 - DNA, 21 bp, Artificial Sequence
  Artificial sequence related to HLA knockouts in cell therapy
accaagcacaagtgggaggcg

SEQ ID NO: 20503 - DNA, 21 bp, Artificial Sequence
  Artificial sequence related to HLA knockouts in cell therapy
ccaagcacaagtgggaggcgg

SEQ ID NO: 20504 - DNA, 21 bp, Artificial Sequence
  Artificial sequence related to HLA knockouts in cell therapy
caagcacaagtgggaggcggc

SEQ ID NO: 20505 - DNA, 21 bp, Artificial Sequence
  Artificial sequence related to HLA knockouts in cell therapy
aagcacaagtgggaggcggcc

SEQ ID NO: 20506 - DNA, 21 bp, Artificial Sequence
  Artificial sequence related to HLA knockouts in cell therapy
agcacaagtgggaggcggccc

SEQ ID NO: 20507 - DNA, 21 bp, Artificial Sequence
  Artificial sequence related to HLA knockouts in cell therapy
gcacaagtgggaggcggccca

SEQ ID NO: 20508 - DNA, 21 bp, Artificial Sequence
  Artificial sequence related to HLA knockouts in cell therapy
cacaagtgggaggcggcccat

SEQ ID NO: 20509 - DNA, 21 bp, Artificial Sequence
  Artificial sequence related to HLA knockouts in cell therapy
acaagtgggaggcggcccatg

SEQ ID NO: 20510 - DNA, 21 bp, Artificial Sequence
  Artificial sequence related to HLA knockouts in cell therapy
caagtgggaggcggcccatgt

SEQ ID NO: 20511 - DNA, 21 bp, Artificial Sequence
  Artificial sequence related to HLA knockouts in cell therapy
aagtgggaggcggcccatgtg

SEQ ID NO: 20512 - DNA, 21 bp, Artificial Sequence
  Artificial sequence related to HLA knockouts in cell therapy
agtgggaggcggcccatgtgg

SEQ ID NO: 20513 - DNA, 21 bp, Artificial Sequence
  Artificial sequence related to HLA knockouts in cell therapy
gtgggaggcggcccatgtggc

SEQ ID NO: 20514 - DNA, 21 bp, Artificial Sequence
  Artificial sequence related to HLA knockouts in cell therapy
tgggaggcggcccatgtggcg

SEQ ID NO: 20515 - DNA, 21 bp, Artificial Sequence
  Artificial sequence related to HLA knockouts in cell therapy
gggaggcggcccatgtggcgg

SEQ ID NO: 20516 - DNA, 21 bp, Artificial Sequence
  Artificial sequence related to HLA knockouts in cell therapy
ggaggcggcccatgtggcgga

SEQ ID NO: 20517 - DNA, 21 bp, Artificial Sequence
  Artificial sequence related to HLA knockouts in cell therapy
gaggcggcccatgtggcggag

SEQ ID NO: 20518 - DNA, 21 bp, Artificial Sequence
  Artificial sequence related to HLA knockouts in cell therapy
aggcggcccatgtggcggagc

SEQ ID NO: 20519 - DNA, 21 bp, Artificial Sequence
  Artificial sequence related to HLA knockouts in cell therapy
ggcggcccatgtggcggagca

SEQ ID NO: 20520 - DNA, 21 bp, Artificial Sequence
  Artificial sequence related to HLA knockouts in cell therapy
gcggcccatgtggcggagcag

SEQ ID NO: 20521 - DNA, 21 bp, Artificial Sequence
  Artificial sequence related to HLA knockouts in cell therapy
cggcccatgtggcggagcagt

SEQ ID NO: 20522 - DNA, 21 bp, Artificial Sequence
  Artificial sequence related to HLA knockouts in cell therapy
ggcccatgtggcggagcagtt

SEQ ID NO: 20523 - DNA, 21 bp, Artificial Sequence
  Artificial sequence related to HLA knockouts in cell therapy
gcccatgtggcggagcagttg

SEQ ID NO: 20524 - DNA, 21 bp, Artificial Sequence
  Artificial sequence related to HLA knockouts in cell therapy
cccatgtggcggagcagttga

SEQ ID NO: 20525 - DNA, 21 bp, Artificial Sequence
  Artificial sequence related to HLA knockouts in cell therapy
ccatgtggcggagcagttgag

SEQ ID NO: 20526 - DNA, 21 bp, Artificial Sequence
  Artificial sequence related to HLA knockouts in cell therapy
tgtggcggagcagttgagagc

SEQ ID NO: 20527 - DNA, 21 bp, Artificial Sequence
  Artificial sequence related to HLA knockouts in cell therapy
gtggcggagcagttgagagcc

SEQ ID NO: 20528 - DNA, 21 bp, Artificial Sequence
  Artificial sequence related to HLA knockouts in cell therapy
tggcggagcagttgagagcct

SEQ ID NO: 20529 - DNA, 21 bp, Artificial Sequence
  Artificial sequence related to HLA knockouts in cell therapy
ggcggagcagttgagagccta

SEQ ID NO: 20530 - DNA, 21 bp, Artificial Sequence
  Artificial sequence related to HLA knockouts in cell therapy
gcggagcagttgagagcctac

SEQ ID NO: 20531 - DNA, 21 bp, Artificial Sequence
  Artificial sequence related to HLA knockouts in cell therapy
cggagcagttgagagcctacc

SEQ ID NO: 20532 - DNA, 21 bp, Artificial Sequence
  Artificial sequence related to HLA knockouts in cell therapy
gttgagagcctacctggaggg

SEQ ID NO: 20533 - DNA, 21 bp, Artificial Sequence
  Artificial sequence related to HLA knockouts in cell therapy
ttgagagcctacctggagggc

SEQ ID NO: 20534 - DNA, 21 bp, Artificial Sequence
  Artificial sequence related to HLA knockouts in cell therapy
tgagagcctacctggagggca

SEQ ID NO: 20535 - DNA, 21 bp, Artificial Sequence
  Artificial sequence related to HLA knockouts in cell therapy
gagagcctacctggagggcac

SEQ ID NO: 20536 - DNA, 21 bp, Artificial Sequence
  Artificial sequence related to HLA knockouts in cell therapy
agagcctacctggagggcacg

SEQ ID NO: 20537 - DNA, 21 bp, Artificial Sequence
  Artificial sequence related to HLA knockouts in cell therapy
gagcctacctggagggcacgt

SEQ ID NO: 20538 - DNA, 21 bp, Artificial Sequence
  Artificial sequence related to HLA knockouts in cell therapy
agcctacctggagggcacgtg

SEQ ID NO: 20539 - DNA, 21 bp, Artificial Sequence
  Artificial sequence related to HLA knockouts in cell therapy
gcctacctggagggcacgtgc

SEQ ID NO: 20540 - DNA, 21 bp, Artificial Sequence
  Artificial sequence related to HLA knockouts in cell therapy
cctacctggagggcacgtgcg

SEQ ID NO: 20541 - DNA, 21 bp, Artificial Sequence
  Artificial sequence related to HLA knockouts in cell therapy
ctacctggagggcacgtgcgt

SEQ ID NO: 20542 - DNA, 21 bp, Artificial Sequence
  Artificial sequence related to HLA knockouts in cell therapy
tacctggagggcacgtgcgtg

SEQ ID NO: 20543 - DNA, 21 bp, Artificial Sequence
  Artificial sequence related to HLA knockouts in cell therapy
acctggagggcacgtgcgtgg

SEQ ID NO: 20544 - DNA, 21 bp, Artificial Sequence
  Artificial sequence related to HLA knockouts in cell therapy
cctggagggcacgtgcgtgga

SEQ ID NO: 20545 - DNA, 21 bp, Artificial Sequence
  Artificial sequence related to HLA knockouts in cell therapy
ctggagggcacgtgcgtggag

SEQ ID NO: 20546 - DNA, 21 bp, Artificial Sequence
  Artificial sequence related to HLA knockouts in cell therapy
tggagggcacgtgcgtggagt

SEQ ID NO: 20547 - DNA, 21 bp, Artificial Sequence
  Artificial sequence related to HLA knockouts in cell therapy
ggagggcacgtgcgtggagtg

SEQ ID NO: 20548 - DNA, 21 bp, Artificial Sequence
  Artificial sequence related to HLA knockouts in cell therapy
gagggcacgtgcgtggagtgg

SEQ ID NO: 20549 - DNA, 21 bp, Artificial Sequence
  Artificial sequence related to HLA knockouts in cell therapy
agggcacgtgcgtggagtggc

SEQ ID NO: 20550 - DNA, 21 bp, Artificial Sequence
  Artificial sequence related to HLA knockouts in cell therapy
gggcacgtgcgtggagtggct

SEQ ID NO: 20551 - DNA, 21 bp, Artificial Sequence
  Artificial sequence related to HLA knockouts in cell therapy
ggcacgtgcgtggagtggctc

SEQ ID NO: 20552 - DNA, 21 bp, Artificial Sequence
  Artificial sequence related to HLA knockouts in cell therapy
gcacgtgcgtggagtggctcc

SEQ ID NO: 20553 - DNA, 21 bp, Artificial Sequence
  Artificial sequence related to HLA knockouts in cell therapy
cacgtgcgtggagtggctccg

SEQ ID NO: 20554 - DNA, 21 bp, Artificial Sequence
  Artificial sequence related to HLA knockouts in cell therapy
acgtgcgtggagtggctccgc

SEQ ID NO: 20555 - DNA, 21 bp, Artificial Sequence
  Artificial sequence related to HLA knockouts in cell therapy
cgtgcgtggagtggctccgca

SEQ ID NO: 20556 - DNA, 21 bp, Artificial Sequence
  Artificial sequence related to HLA knockouts in cell therapy
gtgcgtggagtggctccgcag

SEQ ID NO: 20557 - DNA, 21 bp, Artificial Sequence
  Artificial sequence related to HLA knockouts in cell therapy
tgcgtggagtggctccgcaga

SEQ ID NO: 20558 - DNA, 21 bp, Artificial Sequence
  Artificial sequence related to HLA knockouts in cell therapy
gcgtggagtggctccgcagat

SEQ ID NO: 20559 - DNA, 21 bp, Artificial Sequence
  Artificial sequence related to HLA knockouts in cell therapy
cgtggagtggctccgcagata

SEQ ID NO: 20560 - DNA, 21 bp, Artificial Sequence
  Artificial sequence related to HLA knockouts in cell therapy
gtggagtggctccgcagatac

SEQ ID NO: 20561 - DNA, 21 bp, Artificial Sequence
  Artificial sequence related to HLA knockouts in cell therapy
tggagtggctccgcagatacc

SEQ ID NO: 20562 - DNA, 21 bp, Artificial Sequence
  Artificial sequence related to HLA knockouts in cell therapy
ggagtggctccgcagatacct

SEQ ID NO: 20563 - DNA, 21 bp, Artificial Sequence
  Artificial sequence related to HLA knockouts in cell therapy
gagtggctccgcagatacctg

SEQ ID NO: 20564 - DNA, 21 bp, Artificial Sequence
  Artificial sequence related to HLA knockouts in cell therapy
agtggctccgcagatacctgg

SEQ ID NO: 20565 - DNA, 21 bp, Artificial Sequence
  Artificial sequence related to HLA knockouts in cell therapy
gtggctccgcagatacctgga

SEQ ID NO: 20566 - DNA, 21 bp, Artificial Sequence
  Artificial sequence related to HLA knockouts in cell therapy
tggctccgcagatacctggag

SEQ ID NO: 20567 - DNA, 21 bp, Artificial Sequence
  Artificial sequence related to HLA knockouts in cell therapy
ggctccgcagatacctggaga

SEQ ID NO: 20568 - DNA, 21 bp, Artificial Sequence
  Artificial sequence related to HLA knockouts in cell therapy
ccgcagatacctggagaacgg

SEQ ID NO: 20569 - DNA, 21 bp, Artificial Sequence
  Artificial sequence related to HLA knockouts in cell therapy
cgcagatacctggagaacggg

SEQ ID NO: 20570 - DNA, 21 bp, Artificial Sequence
  Artificial sequence related to HLA knockouts in cell therapy
cctggagaacgggaaggagac

SEQ ID NO: 20571 - DNA, 21 bp, Artificial Sequence
  Artificial sequence related to HLA knockouts in cell therapy
ctggagaacgggaaggagacg

SEQ ID NO: 20572 - DNA, 21 bp, Artificial Sequence
  Artificial sequence related to HLA knockouts in cell therapy
tggagaacgggaaggagacgc

SEQ ID NO: 20573 - DNA, 21 bp, Artificial Sequence
  Artificial sequence related to HLA knockouts in cell therapy
ggagaacgggaaggagacgct

SEQ ID NO: 20574 - DNA, 21 bp, Artificial Sequence
  Artificial sequence related to HLA knockouts in cell therapy
gagaacgggaaggagacgctg

SEQ ID NO: 20575 - DNA, 21 bp, Artificial Sequence
  Artificial sequence related to HLA knockouts in cell therapy
agaacgggaaggagacgctgc

SEQ ID NO: 20576 - DNA, 21 bp, Artificial Sequence
  Artificial sequence related to HLA knockouts in cell therapy
gaacgggaaggagacgctgca

SEQ ID NO: 20577 - DNA, 21 bp, Artificial Sequence
  Artificial sequence related to HLA knockouts in cell therapy
aacgggaaggagacgctgcag

SEQ ID NO: 20578 - DNA, 21 bp, Artificial Sequence
  Artificial sequence related to HLA knockouts in cell therapy
acgggaaggagacgctgcagc

SEQ ID NO: 20579 - DNA, 21 bp, Artificial Sequence
  Artificial sequence related to HLA knockouts in cell therapy
cgggaaggagacgctgcagcg

SEQ ID NO: 20580 - DNA, 21 bp, Artificial Sequence
  Artificial sequence related to HLA knockouts in cell therapy
gggaaggagacgctgcagcgc

SEQ ID NO: 20581 - DNA, 21 bp, Artificial Sequence
  Artificial sequence related to HLA knockouts in cell therapy
ggaaggagacgctgcagcgca

SEQ ID NO: 20582 - DNA, 21 bp, Artificial Sequence
  Artificial sequence related to HLA knockouts in cell therapy
gaaggagacgctgcagcgcac

SEQ ID NO: 20583 - DNA, 21 bp, Artificial Sequence
  Artificial sequence related to HLA knockouts in cell therapy
aaggagacgctgcagcgcacg

SEQ ID NO: 20584 - DNA, 21 bp, Artificial Sequence
  Artificial sequence related to HLA knockouts in cell therapy
aggagacgctgcagcgcacgg

SEQ ID NO: 20585 - DNA, 21 bp, Artificial Sequence
  Artificial sequence related to HLA knockouts in cell therapy
ggagacgctgcagcgcacgga

SEQ ID NO: 20586 - DNA, 21 bp, Artificial Sequence
  Artificial sequence related to HLA knockouts in cell therapy
gagacgctgcagcgcacggac

SEQ ID NO: 20587 - DNA, 21 bp, Artificial Sequence
  Artificial sequence related to HLA knockouts in cell therapy
agacgctgcagcgcacggacg

SEQ ID NO: 20588 - DNA, 21 bp, Artificial Sequence
  Artificial sequence related to HLA knockouts in cell therapy
gacgctgcagcgcacggacgc

SEQ ID NO: 20589 - DNA, 21 bp, Artificial Sequence
  Artificial sequence related to HLA knockouts in cell therapy
acgctgcagcgcacggacgcc

SEQ ID NO: 20590 - DNA, 21 bp, Artificial Sequence
  Artificial sequence related to HLA knockouts in cell therapy
cgctgcagcgcacggacgccc

SEQ ID NO: 20591 - DNA, 21 bp, Artificial Sequence
  Artificial sequence related to HLA knockouts in cell therapy
gctgcagcgcacggacgcccc

SEQ ID NO: 20592 - DNA, 21 bp, Artificial Sequence
  Artificial sequence related to HLA knockouts in cell therapy
ctgcagcgcacggacgccccc

SEQ ID NO: 20593 - DNA, 21 bp, Artificial Sequence
  Artificial sequence related to HLA knockouts in cell therapy
tgcagcgcacggacgccccca

SEQ ID NO: 20594 - DNA, 21 bp, Artificial Sequence
  Artificial sequence related to HLA knockouts in cell therapy
gcagcgcacggacgcccccaa

SEQ ID NO: 20595 - DNA, 21 bp, Artificial Sequence
  Artificial sequence related to HLA knockouts in cell therapy
cagcgcacggacgcccccaaa

SEQ ID NO: 20596 - DNA, 21 bp, Artificial Sequence
  Artificial sequence related to HLA knockouts in cell therapy
agcgcacggacgcccccaaaa

SEQ ID NO: 20597 - DNA, 21 bp, Artificial Sequence
  Artificial sequence related to HLA knockouts in cell therapy
gcgcacggacgcccccaaaac

SEQ ID NO: 20598 - DNA, 21 bp, Artificial Sequence
  Artificial sequence related to HLA knockouts in cell therapy
cgcacggacgcccccaaaacg

SEQ ID NO: 20599 - DNA, 21 bp, Artificial Sequence
  Artificial sequence related to HLA knockouts in cell therapy
gcacggacgcccccaaaacgc

SEQ ID NO: 20600 - DNA, 21 bp, Artificial Sequence
  Artificial sequence related to HLA knockouts in cell therapy
cacggacgcccccaaaacgca

SEQ ID NO: 20601 - DNA, 21 bp, Artificial Sequence
  Artificial sequence related to HLA knockouts in cell therapy
acggacgcccccaaaacgcat

SEQ ID NO: 20602 - DNA, 21 bp, Artificial Sequence
  Artificial sequence related to HLA knockouts in cell therapy
cggacgcccccaaaacgcata

SEQ ID NO: 20603 - DNA, 21 bp, Artificial Sequence
  Artificial sequence related to HLA knockouts in cell therapy
ctcaccacgctgtctctgacc

SEQ ID NO: 20604 - DNA, 21 bp, Artificial Sequence
  Artificial sequence related to HLA knockouts in cell therapy
gaccatgaagccaccctgagg

SEQ ID NO: 20605 - DNA, 21 bp, Artificial Sequence
  Artificial sequence related to HLA knockouts in cell therapy
ccatgaagccaccctgaggtg

SEQ ID NO: 20606 - DNA, 21 bp, Artificial Sequence
  Artificial sequence related to HLA knockouts in cell therapy
catgaagccaccctgaggtgc

SEQ ID NO: 20607 - DNA, 21 bp, Artificial Sequence
  Artificial sequence related to HLA knockouts in cell therapy
tgaagccaccctgaggtgctg

SEQ ID NO: 20608 - DNA, 21 bp, Artificial Sequence
  Artificial sequence related to HLA knockouts in cell therapy
gaagccaccctgaggtgctgg

SEQ ID NO: 20609 - DNA, 21 bp, Artificial Sequence
  Artificial sequence related to HLA knockouts in cell therapy
aagccaccctgaggtgctggg

SEQ ID NO: 20610 - DNA, 21 bp, Artificial Sequence
  Artificial sequence related to HLA knockouts in cell therapy
agccaccctgaggtgctgggc

SEQ ID NO: 20611 - DNA, 21 bp, Artificial Sequence
  Artificial sequence related to HLA knockouts in cell therapy
gccaccctgaggtgctgggcc

SEQ ID NO: 20612 - DNA, 21 bp, Artificial Sequence
  Artificial sequence related to HLA knockouts in cell therapy
ccaccctgaggtgctgggccc

SEQ ID NO: 20613 - DNA, 21 bp, Artificial Sequence
  Artificial sequence related to HLA knockouts in cell therapy
caccctgaggtgctgggccct

SEQ ID NO: 20614 - DNA, 21 bp, Artificial Sequence
  Artificial sequence related to HLA knockouts in cell therapy
accctgaggtgctgggccctg

SEQ ID NO: 20615 - DNA, 21 bp, Artificial Sequence
  Artificial sequence related to HLA knockouts in cell therapy
ccctgaggtgctgggccctga

SEQ ID NO: 20616 - DNA, 21 bp, Artificial Sequence
  Artificial sequence related to HLA knockouts in cell therapy
cctgaggtgctgggccctgag

SEQ ID NO: 20617 - DNA, 21 bp, Artificial Sequence
  Artificial sequence related to HLA knockouts in cell therapy
ctgaggtgctgggccctgagc

SEQ ID NO: 20618 - DNA, 21 bp, Artificial Sequence
  Artificial sequence related to HLA knockouts in cell therapy
tgaggtgctgggccctgagct

SEQ ID NO: 20619 - DNA, 21 bp, Artificial Sequence
  Artificial sequence related to HLA knockouts in cell therapy
gaggtgctgggccctgagctt

SEQ ID NO: 20620 - DNA, 21 bp, Artificial Sequence
  Artificial sequence related to HLA knockouts in cell therapy
aggtgctgggccctgagcttc

SEQ ID NO: 20621 - DNA, 21 bp, Artificial Sequence
  Artificial sequence related to HLA knockouts in cell therapy
ggtgctgggccctgagcttct

SEQ ID NO: 20622 - DNA, 21 bp, Artificial Sequence
  Artificial sequence related to HLA knockouts in cell therapy
gtgctgggccctgagcttcta

SEQ ID NO: 20623 - DNA, 21 bp, Artificial Sequence
  Artificial sequence related to HLA knockouts in cell therapy
tgctgggccctgagcttctac

SEQ ID NO: 20624 - DNA, 21 bp, Artificial Sequence
  Artificial sequence related to HLA knockouts in cell therapy
gctgggccctgagcttctacc

SEQ ID NO: 20625 - DNA, 21 bp, Artificial Sequence
  Artificial sequence related to HLA knockouts in cell therapy
ctgggccctgagcttctaccc

SEQ ID NO: 20626 - DNA, 21 bp, Artificial Sequence
  Artificial sequence related to HLA knockouts in cell therapy
tgggccctgagcttctaccct

SEQ ID NO: 20627 - DNA, 21 bp, Artificial Sequence
  Artificial sequence related to HLA knockouts in cell therapy
gggccctgagcttctaccctg

SEQ ID NO: 20628 - DNA, 21 bp, Artificial Sequence
  Artificial sequence related to HLA knockouts in cell therapy
ggccctgagcttctaccctgc

SEQ ID NO: 20629 - DNA, 21 bp, Artificial Sequence
  Artificial sequence related to HLA knockouts in cell therapy
gccctgagcttctaccctgcg

SEQ ID NO: 20630 - DNA, 21 bp, Artificial Sequence
  Artificial sequence related to HLA knockouts in cell therapy
ccctgagcttctaccctgcgg

SEQ ID NO: 20631 - DNA, 21 bp, Artificial Sequence
  Artificial sequence related to HLA knockouts in cell therapy
cctgagcttctaccctgcgga

SEQ ID NO: 20632 - DNA, 21 bp, Artificial Sequence
  Artificial sequence related to HLA knockouts in cell therapy
ctgagcttctaccctgcggag

SEQ ID NO: 20633 - DNA, 21 bp, Artificial Sequence
  Artificial sequence related to HLA knockouts in cell therapy
ccctgcggagatcacactgac

SEQ ID NO: 20634 - DNA, 21 bp, Artificial Sequence
  Artificial sequence related to HLA knockouts in cell therapy
cctgcggagatcacactgacc

SEQ ID NO: 20635 - DNA, 21 bp, Artificial Sequence
  Artificial sequence related to HLA knockouts in cell therapy
gcggagatcacactgacctgg

SEQ ID NO: 20636 - DNA, 21 bp, Artificial Sequence
  Artificial sequence related to HLA knockouts in cell therapy
cggagatcacactgacctggc

SEQ ID NO: 20637 - DNA, 21 bp, Artificial Sequence
  Artificial sequence related to HLA knockouts in cell therapy
gatcacactgacctggcagcg

SEQ ID NO: 20638 - DNA, 21 bp, Artificial Sequence
  Artificial sequence related to HLA knockouts in cell therapy
atcacactgacctggcagcgg

SEQ ID NO: 20639 - DNA, 21 bp, Artificial Sequence
  Artificial sequence related to HLA knockouts in cell therapy
tcacactgacctggcagcggg

SEQ ID NO: 20640 - DNA, 21 bp, Artificial Sequence
  Artificial sequence related to HLA knockouts in cell therapy
cacactgacctggcagcggga

SEQ ID NO: 20641 - DNA, 21 bp, Artificial Sequence
  Artificial sequence related to HLA knockouts in cell therapy
acactgacctggcagcgggat

SEQ ID NO: 20642 - DNA, 21 bp, Artificial Sequence
  Artificial sequence related to HLA knockouts in cell therapy
cactgacctggcagcgggatg

SEQ ID NO: 20643 - DNA, 21 bp, Artificial Sequence
  Artificial sequence related to HLA knockouts in cell therapy
actgacctggcagcgggatgg

SEQ ID NO: 20644 - DNA, 21 bp, Artificial Sequence
  Artificial sequence related to HLA knockouts in cell therapy
ctgacctggcagcgggatggg

SEQ ID NO: 20645 - DNA, 21 bp, Artificial Sequence
  Artificial sequence related to HLA knockouts in cell therapy
tgacctggcagcgggatgggg

SEQ ID NO: 20646 - DNA, 21 bp, Artificial Sequence
  Artificial sequence related to HLA knockouts in cell therapy
gacctggcagcgggatgggga

SEQ ID NO: 20647 - DNA, 21 bp, Artificial Sequence
  Artificial sequence related to HLA knockouts in cell therapy
acctggcagcgggatggggag

SEQ ID NO: 20648 - DNA, 21 bp, Artificial Sequence
  Artificial sequence related to HLA knockouts in cell therapy
cctggcagcgggatggggagg

SEQ ID NO: 20649 - DNA, 21 bp, Artificial Sequence
  Artificial sequence related to HLA knockouts in cell therapy
ctggcagcgggatggggagga

SEQ ID NO: 20650 - DNA, 21 bp, Artificial Sequence
  Artificial sequence related to HLA knockouts in cell therapy
tggcagcgggatggggaggac

SEQ ID NO: 20651 - DNA, 21 bp, Artificial Sequence
  Artificial sequence related to HLA knockouts in cell therapy
ggcagcgggatggggaggacc

SEQ ID NO: 20652 - DNA, 21 bp, Artificial Sequence
  Artificial sequence related to HLA knockouts in cell therapy
gcagcgggatggggaggacca

SEQ ID NO: 20653 - DNA, 21 bp, Artificial Sequence
  Artificial sequence related to HLA knockouts in cell therapy
cagcgggatggggaggaccag

SEQ ID NO: 20654 - DNA, 21 bp, Artificial Sequence
  Artificial sequence related to HLA knockouts in cell therapy
agcgggatggggaggaccaga

SEQ ID NO: 20655 - DNA, 21 bp, Artificial Sequence
  Artificial sequence related to HLA knockouts in cell therapy
gcgggatggggaggaccagac

SEQ ID NO: 20656 - DNA, 21 bp, Artificial Sequence
  Artificial sequence related to HLA knockouts in cell therapy
cgggatggggaggaccagacc

SEQ ID NO: 20657 - DNA, 21 bp, Artificial Sequence
  Artificial sequence related to HLA knockouts in cell therapy
gggatggggaggaccagaccc

SEQ ID NO: 20658 - DNA, 21 bp, Artificial Sequence
  Artificial sequence related to HLA knockouts in cell therapy
ggatggggaggaccagaccca

SEQ ID NO: 20659 - DNA, 21 bp, Artificial Sequence
  Artificial sequence related to HLA knockouts in cell therapy
gatggggaggaccagacccag

SEQ ID NO: 20660 - DNA, 21 bp, Artificial Sequence
  Artificial sequence related to HLA knockouts in cell therapy
atggggaggaccagacccagg

SEQ ID NO: 20661 - DNA, 21 bp, Artificial Sequence
  Artificial sequence related to HLA knockouts in cell therapy
tggggaggaccagacccagga

SEQ ID NO: 20662 - DNA, 21 bp, Artificial Sequence
  Artificial sequence related to HLA knockouts in cell therapy
ggggaggaccagacccaggac

SEQ ID NO: 20663 - DNA, 21 bp, Artificial Sequence
  Artificial sequence related to HLA knockouts in cell therapy
gggaggaccagacccaggaca

SEQ ID NO: 20664 - DNA, 21 bp, Artificial Sequence
  Artificial sequence related to HLA knockouts in cell therapy
ggaggaccagacccaggacac

SEQ ID NO: 20665 - DNA, 21 bp, Artificial Sequence
  Artificial sequence related to HLA knockouts in cell therapy
gaggaccagacccaggacacg

SEQ ID NO: 20666 - DNA, 21 bp, Artificial Sequence
  Artificial sequence related to HLA knockouts in cell therapy
aggaccagacccaggacacgg

SEQ ID NO: 20667 - DNA, 21 bp, Artificial Sequence
  Artificial sequence related to HLA knockouts in cell therapy
ggaccagacccaggacacgga

SEQ ID NO: 20668 - DNA, 21 bp, Artificial Sequence
  Artificial sequence related to HLA knockouts in cell therapy
gaccagacccaggacacggag

SEQ ID NO: 20669 - DNA, 21 bp, Artificial Sequence
  Artificial sequence related to HLA knockouts in cell therapy
accagacccaggacacggagc

SEQ ID NO: 20670 - DNA, 21 bp, Artificial Sequence
  Artificial sequence related to HLA knockouts in cell therapy
ccagacccaggacacggagct

SEQ ID NO: 20671 - DNA, 21 bp, Artificial Sequence
  Artificial sequence related to HLA knockouts in cell therapy
cagacccaggacacggagctc

SEQ ID NO: 20672 - DNA, 21 bp, Artificial Sequence
  Artificial sequence related to HLA knockouts in cell therapy
agacccaggacacggagctcg

SEQ ID NO: 20673 - DNA, 21 bp, Artificial Sequence
  Artificial sequence related to HLA knockouts in cell therapy
gacccaggacacggagctcgt

SEQ ID NO: 20674 - DNA, 21 bp, Artificial Sequence
  Artificial sequence related to HLA knockouts in cell therapy
acccaggacacggagctcgtg

SEQ ID NO: 20675 - DNA, 21 bp, Artificial Sequence
  Artificial sequence related to HLA knockouts in cell therapy
cccaggacacggagctcgtgg

SEQ ID NO: 20676 - DNA, 21 bp, Artificial Sequence
  Artificial sequence related to HLA knockouts in cell therapy
ccaggacacggagctcgtgga

SEQ ID NO: 20677 - DNA, 21 bp, Artificial Sequence
  Artificial sequence related to HLA knockouts in cell therapy
caggacacggagctcgtggag

SEQ ID NO: 20678 - DNA, 21 bp, Artificial Sequence
  Artificial sequence related to HLA knockouts in cell therapy
aggacacggagctcgtggaga

SEQ ID NO: 20679 - DNA, 21 bp, Artificial Sequence
  Artificial sequence related to HLA knockouts in cell therapy
ggacacggagctcgtggagac

SEQ ID NO: 20680 - DNA, 21 bp, Artificial Sequence
  Artificial sequence related to HLA knockouts in cell therapy
gacacggagctcgtggagacc

SEQ ID NO: 20681 - DNA, 21 bp, Artificial Sequence
  Artificial sequence related to HLA knockouts in cell therapy
acacggagctcgtggagacca

SEQ ID NO: 20682 - DNA, 21 bp, Artificial Sequence
  Artificial sequence related to HLA knockouts in cell therapy
cacggagctcgtggagaccag

SEQ ID NO: 20683 - DNA, 21 bp, Artificial Sequence
  Artificial sequence related to HLA knockouts in cell therapy
acggagctcgtggagaccagg

SEQ ID NO: 20684 - DNA, 21 bp, Artificial Sequence
  Artificial sequence related to HLA knockouts in cell therapy
cggagctcgtggagaccaggc

SEQ ID NO: 20685 - DNA, 21 bp, Artificial Sequence
  Artificial sequence related to HLA knockouts in cell therapy
ggagctcgtggagaccaggcc

SEQ ID NO: 20686 - DNA, 21 bp, Artificial Sequence
  Artificial sequence related to HLA knockouts in cell therapy
gagctcgtggagaccaggcct

SEQ ID NO: 20687 - DNA, 21 bp, Artificial Sequence
  Artificial sequence related to HLA knockouts in cell therapy
agctcgtggagaccaggcctg

SEQ ID NO: 20688 - DNA, 21 bp, Artificial Sequence
  Artificial sequence related to HLA knockouts in cell therapy
gctcgtggagaccaggcctgc

SEQ ID NO: 20689 - DNA, 21 bp, Artificial Sequence
  Artificial sequence related to HLA knockouts in cell therapy
ctcgtggagaccaggcctgca

SEQ ID NO: 20690 - DNA, 21 bp, Artificial Sequence
  Artificial sequence related to HLA knockouts in cell therapy
tcgtggagaccaggcctgcag

SEQ ID NO: 20691 - DNA, 21 bp, Artificial Sequence
  Artificial sequence related to HLA knockouts in cell therapy
cgtggagaccaggcctgcagg

SEQ ID NO: 20692 - DNA, 21 bp, Artificial Sequence
  Artificial sequence related to HLA knockouts in cell therapy
gtggagaccaggcctgcaggg

SEQ ID NO: 20693 - DNA, 21 bp, Artificial Sequence
  Artificial sequence related to HLA knockouts in cell therapy
tggagaccaggcctgcagggg

SEQ ID NO: 20694 - DNA, 21 bp, Artificial Sequence
  Artificial sequence related to HLA knockouts in cell therapy
ggagaccaggcctgcagggga

SEQ ID NO: 20695 - DNA, 21 bp, Artificial Sequence
  Artificial sequence related to HLA knockouts in cell therapy
gagaccaggcctgcaggggat

SEQ ID NO: 20696 - DNA, 21 bp, Artificial Sequence
  Artificial sequence related to HLA knockouts in cell therapy
agaccaggcctgcaggggatg

SEQ ID NO: 20697 - DNA, 21 bp, Artificial Sequence
  Artificial sequence related to HLA knockouts in cell therapy
gaccaggcctgcaggggatgg

SEQ ID NO: 20698 - DNA, 21 bp, Artificial Sequence
  Artificial sequence related to HLA knockouts in cell therapy
accaggcctgcaggggatgga

SEQ ID NO: 20699 - DNA, 21 bp, Artificial Sequence
  Artificial sequence related to HLA knockouts in cell therapy
ccaggcctgcaggggatggaa

SEQ ID NO: 20700 - DNA, 21 bp, Artificial Sequence
  Artificial sequence related to HLA knockouts in cell therapy
caggcctgcaggggatggaac

SEQ ID NO: 20701 - DNA, 21 bp, Artificial Sequence
  Artificial sequence related to HLA knockouts in cell therapy
aggcctgcaggggatggaacc

SEQ ID NO: 20702 - DNA, 21 bp, Artificial Sequence
  Artificial sequence related to HLA knockouts in cell therapy
ggcctgcaggggatggaacct

SEQ ID NO: 20703 - DNA, 21 bp, Artificial Sequence
  Artificial sequence related to HLA knockouts in cell therapy
gcctgcaggggatggaacctt

SEQ ID NO: 20704 - DNA, 21 bp, Artificial Sequence
  Artificial sequence related to HLA knockouts in cell therapy
cctgcaggggatggaaccttc

SEQ ID NO: 20705 - DNA, 21 bp, Artificial Sequence
  Artificial sequence related to HLA knockouts in cell therapy
ctgcaggggatggaaccttcc

SEQ ID NO: 20706 - DNA, 21 bp, Artificial Sequence
  Artificial sequence related to HLA knockouts in cell therapy
gcaggggatggaaccttccag

SEQ ID NO: 20707 - DNA, 21 bp, Artificial Sequence
  Artificial sequence related to HLA knockouts in cell therapy
ggaaccttccagaagtgggcg

SEQ ID NO: 20708 - DNA, 21 bp, Artificial Sequence
  Artificial sequence related to HLA knockouts in cell therapy
gaaccttccagaagtgggcgg

SEQ ID NO: 20709 - DNA, 21 bp, Artificial Sequence
  Artificial sequence related to HLA knockouts in cell therapy
aaccttccagaagtgggcggc

SEQ ID NO: 20710 - DNA, 21 bp, Artificial Sequence
  Artificial sequence related to HLA knockouts in cell therapy
accttccagaagtgggcggct

SEQ ID NO: 20711 - DNA, 21 bp, Artificial Sequence
  Artificial sequence related to HLA knockouts in cell therapy
ccttccagaagtgggcggctg

SEQ ID NO: 20712 - DNA, 21 bp, Artificial Sequence
  Artificial sequence related to HLA knockouts in cell therapy
cttccagaagtgggcggctgt

SEQ ID NO: 20713 - DNA, 21 bp, Artificial Sequence
  Artificial sequence related to HLA knockouts in cell therapy
ttccagaagtgggcggctgtg

SEQ ID NO: 20714 - DNA, 21 bp, Artificial Sequence
  Artificial sequence related to HLA knockouts in cell therapy
tccagaagtgggcggctgtgg

SEQ ID NO: 20715 - DNA, 21 bp, Artificial Sequence
  Artificial sequence related to HLA knockouts in cell therapy
ccagaagtgggcggctgtggt

SEQ ID NO: 20716 - DNA, 21 bp, Artificial Sequence
  Artificial sequence related to HLA knockouts in cell therapy
cagaagtgggcggctgtggtg

SEQ ID NO: 20717 - DNA, 21 bp, Artificial Sequence
  Artificial sequence related to HLA knockouts in cell therapy
agaagtgggcggctgtggtgg

SEQ ID NO: 20718 - DNA, 21 bp, Artificial Sequence
  Artificial sequence related to HLA knockouts in cell therapy
gaagtgggcggctgtggtggt

SEQ ID NO: 20719 - DNA, 21 bp, Artificial Sequence
  Artificial sequence related to HLA knockouts in cell therapy
aagtgggcggctgtggtggtg

SEQ ID NO: 20720 - DNA, 21 bp, Artificial Sequence
  Artificial sequence related to HLA knockouts in cell therapy
agtgggcggctgtggtggtgc

SEQ ID NO: 20721 - DNA, 21 bp, Artificial Sequence
  Artificial sequence related to HLA knockouts in cell therapy
gtgggcggctgtggtggtgcc

SEQ ID NO: 20722 - DNA, 21 bp, Artificial Sequence
  Artificial sequence related to HLA knockouts in cell therapy
tgggcggctgtggtggtgcct

SEQ ID NO: 20723 - DNA, 21 bp, Artificial Sequence
  Artificial sequence related to HLA knockouts in cell therapy
gggcggctgtggtggtgcctt

SEQ ID NO: 20724 - DNA, 21 bp, Artificial Sequence
  Artificial sequence related to HLA knockouts in cell therapy
ggcggctgtggtggtgccttc

SEQ ID NO: 20725 - DNA, 21 bp, Artificial Sequence
  Artificial sequence related to HLA knockouts in cell therapy
gcggctgtggtggtgccttct

SEQ ID NO: 20726 - DNA, 21 bp, Artificial Sequence
  Artificial sequence related to HLA knockouts in cell therapy
cggctgtggtggtgccttctg

SEQ ID NO: 20727 - DNA, 21 bp, Artificial Sequence
  Artificial sequence related to HLA knockouts in cell therapy
ggctgtggtggtgccttctgg

SEQ ID NO: 20728 - DNA, 21 bp, Artificial Sequence
  Artificial sequence related to HLA knockouts in cell therapy
gctgtggtggtgccttctgga

SEQ ID NO: 20729 - DNA, 21 bp, Artificial Sequence
  Artificial sequence related to HLA knockouts in cell therapy
ctgtggtggtgccttctggac

SEQ ID NO: 20730 - DNA, 21 bp, Artificial Sequence
  Artificial sequence related to HLA knockouts in cell therapy
gtggtggtgccttctggacag

SEQ ID NO: 20731 - DNA, 21 bp, Artificial Sequence
  Artificial sequence related to HLA knockouts in cell therapy
tggtggtgccttctggacagg

SEQ ID NO: 20732 - DNA, 21 bp, Artificial Sequence
  Artificial sequence related to HLA knockouts in cell therapy
ggtggtgccttctggacagga

SEQ ID NO: 20733 - DNA, 21 bp, Artificial Sequence
  Artificial sequence related to HLA knockouts in cell therapy
gtggtgccttctggacaggag

SEQ ID NO: 20734 - DNA, 21 bp, Artificial Sequence
  Artificial sequence related to HLA knockouts in cell therapy
tggtgccttctggacaggagc

SEQ ID NO: 20735 - DNA, 21 bp, Artificial Sequence
  Artificial sequence related to HLA knockouts in cell therapy
ggtgccttctggacaggagca

SEQ ID NO: 20736 - DNA, 21 bp, Artificial Sequence
  Artificial sequence related to HLA knockouts in cell therapy
gtgccttctggacaggagcag

SEQ ID NO: 20737 - DNA, 21 bp, Artificial Sequence
  Artificial sequence related to HLA knockouts in cell therapy
gccttctggacaggagcagag

SEQ ID NO: 20738 - DNA, 21 bp, Artificial Sequence
  Artificial sequence related to HLA knockouts in cell therapy
cctgccatgtgcagcatgagg

SEQ ID NO: 20739 - DNA, 21 bp, Artificial Sequence
  Artificial sequence related to HLA knockouts in cell therapy
ctgccatgtgcagcatgaggg

SEQ ID NO: 20740 - DNA, 21 bp, Artificial Sequence
  Artificial sequence related to HLA knockouts in cell therapy
gtgcagcatgagggtttgccc

SEQ ID NO: 20741 - DNA, 21 bp, Artificial Sequence
  Artificial sequence related to HLA knockouts in cell therapy
gcatgagggtttgcccaagcc

SEQ ID NO: 20742 - DNA, 21 bp, Artificial Sequence
  Artificial sequence related to HLA knockouts in cell therapy
catgagggtttgcccaagccc

SEQ ID NO: 20743 - DNA, 21 bp, Artificial Sequence
  Artificial sequence related to HLA knockouts in cell therapy
atgagggtttgcccaagcccc

SEQ ID NO: 20744 - DNA, 21 bp, Artificial Sequence
  Artificial sequence related to HLA knockouts in cell therapy
tgagggtttgcccaagcccct

SEQ ID NO: 20745 - DNA, 21 bp, Artificial Sequence
  Artificial sequence related to HLA knockouts in cell therapy
gagggtttgcccaagcccctc

SEQ ID NO: 20746 - DNA, 21 bp, Artificial Sequence
  Artificial sequence related to HLA knockouts in cell therapy
agggtttgcccaagcccctca

SEQ ID NO: 20747 - DNA, 21 bp, Artificial Sequence
  Artificial sequence related to HLA knockouts in cell therapy
gggtttgcccaagcccctcac

SEQ ID NO: 20748 - DNA, 21 bp, Artificial Sequence
  Artificial sequence related to HLA knockouts in cell therapy
ggtttgcccaagcccctcacc

SEQ ID NO: 20749 - DNA, 21 bp, Artificial Sequence
  Artificial sequence related to HLA knockouts in cell therapy
gtttgcccaagcccctcaccc

SEQ ID NO: 20750 - DNA, 21 bp, Artificial Sequence
  Artificial sequence related to HLA knockouts in cell therapy
tttgcccaagcccctcaccct

SEQ ID NO: 20751 - DNA, 21 bp, Artificial Sequence
  Artificial sequence related to HLA knockouts in cell therapy
ttgcccaagcccctcaccctg

SEQ ID NO: 20752 - DNA, 21 bp, Artificial Sequence
  Artificial sequence related to HLA knockouts in cell therapy
tgcccaagcccctcaccctga

SEQ ID NO: 20753 - DNA, 21 bp, Artificial Sequence
  Artificial sequence related to HLA knockouts in cell therapy
gcccaagcccctcaccctgag

SEQ ID NO: 20754 - DNA, 21 bp, Artificial Sequence
  Artificial sequence related to HLA knockouts in cell therapy
cccaagcccctcaccctgaga

SEQ ID NO: 20755 - DNA, 21 bp, Artificial Sequence
  Artificial sequence related to HLA knockouts in cell therapy
ccaagcccctcaccctgagat

SEQ ID NO: 20756 - DNA, 21 bp, Artificial Sequence
  Artificial sequence related to HLA knockouts in cell therapy
caagcccctcaccctgagatg

SEQ ID NO: 20757 - DNA, 21 bp, Artificial Sequence
  Artificial sequence related to HLA knockouts in cell therapy
aagcccctcaccctgagatgg

SEQ ID NO: 20758 - DNA, 21 bp, Artificial Sequence
  Artificial sequence related to HLA knockouts in cell therapy
agcccctcaccctgagatggg

SEQ ID NO: 20759 - DNA, 21 bp, Artificial Sequence
  Artificial sequence related to HLA knockouts in cell therapy
gcccctcaccctgagatggga

SEQ ID NO: 20760 - DNA, 21 bp, Artificial Sequence
  Artificial sequence related to HLA knockouts in cell therapy
cccctcaccctgagatgggag

SEQ ID NO: 20761 - DNA, 21 bp, Artificial Sequence
  Artificial sequence related to HLA knockouts in cell therapy
ccctcaccctgagatgggagc

SEQ ID NO: 20762 - DNA, 21 bp, Artificial Sequence
  Artificial sequence related to HLA knockouts in cell therapy
cctcaccctgagatgggagcc

SEQ ID NO: 20763 - DNA, 21 bp, Artificial Sequence
  Artificial sequence related to HLA knockouts in cell therapy
ctcaccctgagatgggagccg

SEQ ID NO: 20764 - DNA, 21 bp, Artificial Sequence
  Artificial sequence related to HLA knockouts in cell therapy
tcaccctgagatgggagccgt

SEQ ID NO: 20765 - DNA, 21 bp, Artificial Sequence
  Artificial sequence related to HLA knockouts in cell therapy
caccctgagatgggagccgtc

SEQ ID NO: 20766 - DNA, 21 bp, Artificial Sequence
  Artificial sequence related to HLA knockouts in cell therapy
accctgagatgggagccgtct

SEQ ID NO: 20767 - DNA, 21 bp, Artificial Sequence
  Artificial sequence related to HLA knockouts in cell therapy
ccctgagatgggagccgtctt

SEQ ID NO: 20768 - DNA, 21 bp, Artificial Sequence
  Artificial sequence related to HLA knockouts in cell therapy
cctgagatgggagccgtcttc

SEQ ID NO: 20769 - DNA, 21 bp, Artificial Sequence
  Artificial sequence related to HLA knockouts in cell therapy
ctgagatgggagccgtcttcc

SEQ ID NO: 20770 - DNA, 21 bp, Artificial Sequence
  Artificial sequence related to HLA knockouts in cell therapy
tgagatgggagccgtcttccc

SEQ ID NO: 20771 - DNA, 21 bp, Artificial Sequence
  Artificial sequence related to HLA knockouts in cell therapy
gagatgggagccgtcttccca

SEQ ID NO: 20772 - DNA, 21 bp, Artificial Sequence
  Artificial sequence related to HLA knockouts in cell therapy
agatgggagccgtcttcccag

SEQ ID NO: 20773 - DNA, 21 bp, Artificial Sequence
  Artificial sequence related to HLA knockouts in cell therapy
gatgggagccgtcttcccagc

SEQ ID NO: 20774 - DNA, 21 bp, Artificial Sequence
  Artificial sequence related to HLA knockouts in cell therapy
atgggagccgtcttcccagcc

SEQ ID NO: 20775 - DNA, 21 bp, Artificial Sequence
  Artificial sequence related to HLA knockouts in cell therapy
tgggagccgtcttcccagccc

SEQ ID NO: 20776 - DNA, 21 bp, Artificial Sequence
  Artificial sequence related to HLA knockouts in cell therapy
gggagccgtcttcccagccca

SEQ ID NO: 20777 - DNA, 21 bp, Artificial Sequence
  Artificial sequence related to HLA knockouts in cell therapy
ggagccgtcttcccagcccac

SEQ ID NO: 20778 - DNA, 21 bp, Artificial Sequence
  Artificial sequence related to HLA knockouts in cell therapy
gagccgtcttcccagcccacc

SEQ ID NO: 20779 - DNA, 21 bp, Artificial Sequence
  Artificial sequence related to HLA knockouts in cell therapy
agccgtcttcccagcccacca

SEQ ID NO: 20780 - DNA, 21 bp, Artificial Sequence
  Artificial sequence related to HLA knockouts in cell therapy
gccgtcttcccagcccaccat

SEQ ID NO: 20781 - DNA, 21 bp, Artificial Sequence
  Artificial sequence related to HLA knockouts in cell therapy
ccgtcttcccagcccaccatc

SEQ ID NO: 20782 - DNA, 21 bp, Artificial Sequence
  Artificial sequence related to HLA knockouts in cell therapy
cgtcttcccagcccaccatcc

SEQ ID NO: 20783 - DNA, 21 bp, Artificial Sequence
  Artificial sequence related to HLA knockouts in cell therapy
gtcttcccagcccaccatccc

SEQ ID NO: 20784 - DNA, 21 bp, Artificial Sequence
  Artificial sequence related to HLA knockouts in cell therapy
tcttcccagcccaccatcccc

SEQ ID NO: 20785 - DNA, 21 bp, Artificial Sequence
  Artificial sequence related to HLA knockouts in cell therapy
cttcccagcccaccatcccca

SEQ ID NO: 20786 - DNA, 21 bp, Artificial Sequence
  Artificial sequence related to HLA knockouts in cell therapy
ttcccagcccaccatccccat

SEQ ID NO: 20787 - DNA, 21 bp, Artificial Sequence
  Artificial sequence related to HLA knockouts in cell therapy
tcccagcccaccatccccatc

SEQ ID NO: 20788 - DNA, 21 bp, Artificial Sequence
  Artificial sequence related to HLA knockouts in cell therapy
cccagcccaccatccccatcg

SEQ ID NO: 20789 - DNA, 21 bp, Artificial Sequence
  Artificial sequence related to HLA knockouts in cell therapy
ccagcccaccatccccatcgt

SEQ ID NO: 20790 - DNA, 21 bp, Artificial Sequence
  Artificial sequence related to HLA knockouts in cell therapy
cagcccaccatccccatcgtg

SEQ ID NO: 20791 - DNA, 21 bp, Artificial Sequence
  Artificial sequence related to HLA knockouts in cell therapy
agcccaccatccccatcgtgg

SEQ ID NO: 20792 - DNA, 21 bp, Artificial Sequence
  Artificial sequence related to HLA knockouts in cell therapy
gcccaccatccccatcgtggg

SEQ ID NO: 20793 - DNA, 21 bp, Artificial Sequence
  Artificial sequence related to HLA knockouts in cell therapy
cccaccatccccatcgtgggc

SEQ ID NO: 20794 - DNA, 21 bp, Artificial Sequence
  Artificial sequence related to HLA knockouts in cell therapy
ccaccatccccatcgtgggca

SEQ ID NO: 20795 - DNA, 21 bp, Artificial Sequence
  Artificial sequence related to HLA knockouts in cell therapy
caccatccccatcgtgggcat

SEQ ID NO: 20796 - DNA, 21 bp, Artificial Sequence
  Artificial sequence related to HLA knockouts in cell therapy
accatccccatcgtgggcatc

SEQ ID NO: 20797 - DNA, 21 bp, Artificial Sequence
  Artificial sequence related to HLA knockouts in cell therapy
ccatccccatcgtgggcatca

SEQ ID NO: 20798 - DNA, 21 bp, Artificial Sequence
  Artificial sequence related to HLA knockouts in cell therapy
ccccatcgtgggcatcattgc

SEQ ID NO: 20799 - DNA, 21 bp, Artificial Sequence
  Artificial sequence related to HLA knockouts in cell therapy
tcgtgggcatcattgctggcc

SEQ ID NO: 20800 - DNA, 21 bp, Artificial Sequence
  Artificial sequence related to HLA knockouts in cell therapy
cgtgggcatcattgctggcct

SEQ ID NO: 20801 - DNA, 21 bp, Artificial Sequence
  Artificial sequence related to HLA knockouts in cell therapy
gtgggcatcattgctggcctg

SEQ ID NO: 20802 - DNA, 21 bp, Artificial Sequence
  Artificial sequence related to HLA knockouts in cell therapy
tgggcatcattgctggcctgg

SEQ ID NO: 20803 - DNA, 21 bp, Artificial Sequence
  Artificial sequence related to HLA knockouts in cell therapy
gggcatcattgctggcctggt

SEQ ID NO: 20804 - DNA, 21 bp, Artificial Sequence
  Artificial sequence related to HLA knockouts in cell therapy
gatcactggagctgtggtcgc

SEQ ID NO: 20805 - DNA, 21 bp, Artificial Sequence
  Artificial sequence related to HLA knockouts in cell therapy
tcactggagctgtggtcgctg

SEQ ID NO: 20806 - DNA, 21 bp, Artificial Sequence
  Artificial sequence related to HLA knockouts in cell therapy
cactggagctgtggtcgctgc

SEQ ID NO: 20807 - DNA, 21 bp, Artificial Sequence
  Artificial sequence related to HLA knockouts in cell therapy
actggagctgtggtcgctgct

SEQ ID NO: 20808 - DNA, 21 bp, Artificial Sequence
  Artificial sequence related to HLA knockouts in cell therapy
ctggagctgtggtcgctgctg

SEQ ID NO: 20809 - DNA, 21 bp, Artificial Sequence
  Artificial sequence related to HLA knockouts in cell therapy
tggagctgtggtcgctgctgt

SEQ ID NO: 20810 - DNA, 21 bp, Artificial Sequence
  Artificial sequence related to HLA knockouts in cell therapy
ggagctgtggtcgctgctgtg

SEQ ID NO: 20811 - DNA, 21 bp, Artificial Sequence
  Artificial sequence related to HLA knockouts in cell therapy
gagctgtggtcgctgctgtga

SEQ ID NO: 20812 - DNA, 21 bp, Artificial Sequence
  Artificial sequence related to HLA knockouts in cell therapy
gctgtggtcgctgctgtgatg

SEQ ID NO: 20813 - DNA, 21 bp, Artificial Sequence
  Artificial sequence related to HLA knockouts in cell therapy
gtggtcgctgctgtgatgtgg

SEQ ID NO: 20814 - DNA, 21 bp, Artificial Sequence
  Artificial sequence related to HLA knockouts in cell therapy
ggtcgctgctgtgatgtggag

SEQ ID NO: 20815 - DNA, 21 bp, Artificial Sequence
  Artificial sequence related to HLA knockouts in cell therapy
gtcgctgctgtgatgtggagg

SEQ ID NO: 20816 - DNA, 21 bp, Artificial Sequence
  Artificial sequence related to HLA knockouts in cell therapy
cgctgctgtgatgtggaggag

SEQ ID NO: 20817 - DNA, 21 bp, Artificial Sequence
  Artificial sequence related to HLA knockouts in cell therapy
gctgctgtgatgtggaggagg

SEQ ID NO: 20818 - DNA, 21 bp, Artificial Sequence
  Artificial sequence related to HLA knockouts in cell therapy
aggagggagctactctcaggc

SEQ ID NO: 20819 - DNA, 21 bp, Artificial Sequence
  Artificial sequence related to HLA knockouts in cell therapy
ggagggagctactctcaggct

SEQ ID NO: 20820 - DNA, 21 bp, Artificial Sequence
  Artificial sequence related to HLA knockouts in cell therapy
gagggagctactctcaggctg

SEQ ID NO: 20821 - DNA, 21 bp, Artificial Sequence
  Artificial sequence related to HLA knockouts in cell therapy
agggagctactctcaggctgc

SEQ ID NO: 20822 - DNA, 21 bp, Artificial Sequence
  Artificial sequence related to HLA knockouts in cell therapy
gggagctactctcaggctgca

SEQ ID NO: 20823 - DNA, 21 bp, Artificial Sequence
  Artificial sequence related to HLA knockouts in cell therapy
ggctgcaagcagtgacagtgc

SEQ ID NO: 20824 - DNA, 21 bp, Artificial Sequence
  Artificial sequence related to HLA knockouts in cell therapy
gctgcaagcagtgacagtgcc

SEQ ID NO: 20825 - DNA, 21 bp, Artificial Sequence
  Artificial sequence related to HLA knockouts in cell therapy
ctgcaagcagtgacagtgccc

SEQ ID NO: 20826 - DNA, 21 bp, Artificial Sequence
  Artificial sequence related to HLA knockouts in cell therapy
gcaagcagtgacagtgcccag

SEQ ID NO: 20827 - DNA, 21 bp, Artificial Sequence
  Artificial sequence related to HLA knockouts in cell therapy
caagcagtgacagtgcccagg

SEQ ID NO: 20828 - DNA, 21 bp, Artificial Sequence
  Artificial sequence related to HLA knockouts in cell therapy
aagcagtgacagtgcccaggg

SEQ ID NO: 20829 - DNA, 21 bp, Artificial Sequence
  Artificial sequence related to HLA knockouts in cell therapy
agcagtgacagtgcccagggc

SEQ ID NO: 20830 - DNA, 21 bp, Artificial Sequence
  Artificial sequence related to HLA knockouts in cell therapy
gcagtgacagtgcccagggct

SEQ ID NO: 20831 - DNA, 21 bp, Artificial Sequence
  Artificial sequence related to HLA knockouts in cell therapy
cagtgacagtgcccagggctc

SEQ ID NO: 20832 - DNA, 21 bp, Artificial Sequence
  Artificial sequence related to HLA knockouts in cell therapy
agtgacagtgcccagggctct

SEQ ID NO: 20833 - DNA, 21 bp, Artificial Sequence
  Artificial sequence related to HLA knockouts in cell therapy
gtgacagtgcccagggctctg

SEQ ID NO: 20834 - DNA, 21 bp, Artificial Sequence
  Artificial sequence related to HLA knockouts in cell therapy
tgacagtgcccagggctctga

SEQ ID NO: 20835 - DNA, 21 bp, Artificial Sequence
  Artificial sequence related to HLA knockouts in cell therapy
gacagtgcccagggctctgat

SEQ ID NO: 20836 - DNA, 21 bp, Artificial Sequence
  Artificial sequence related to HLA knockouts in cell therapy
acagtgcccagggctctgatg

SEQ ID NO: 20837 - DNA, 21 bp, Artificial Sequence
  Artificial sequence related to HLA knockouts in cell therapy
cagtgcccagggctctgatgt

SEQ ID NO: 20838 - DNA, 21 bp, Artificial Sequence
  Artificial sequence related to HLA knockouts in cell therapy
agtgcccagggctctgatgtg

SEQ ID NO: 20839 - DNA, 21 bp, Artificial Sequence
  Artificial sequence related to HLA knockouts in cell therapy
gtgcccagggctctgatgtgt

SEQ ID NO: 20840 - DNA, 21 bp, Artificial Sequence
  Artificial sequence related to HLA knockouts in cell therapy
tgcccagggctctgatgtgtc

SEQ ID NO: 20841 - DNA, 21 bp, Artificial Sequence
  Artificial sequence related to HLA knockouts in cell therapy
gcccagggctctgatgtgtct

SEQ ID NO: 20842 - DNA, 21 bp, Artificial Sequence
  Artificial sequence related to HLA knockouts in cell therapy
cccagggctctgatgtgtctc

SEQ ID NO: 20843 - DNA, 21 bp, Artificial Sequence
  Artificial sequence related to HLA knockouts in cell therapy
gagacagctgccttgtgtggg

SEQ ID NO: 20844 - DNA, 21 bp, Artificial Sequence
  Artificial sequence related to HLA knockouts in cell therapy
gacagctgccttgtgtgggac

SEQ ID NO: 20845 - DNA, 21 bp, Artificial Sequence
  Artificial sequence related to HLA knockouts in cell therapy
cagctgccttgtgtgggactg

SEQ ID NO: 20846 - DNA, 21 bp, Artificial Sequence
  Artificial sequence related to HLA knockouts in cell therapy
gctgccttgtgtgggactgag

SEQ ID NO: 20847 - DNA, 21 bp, Artificial Sequence
  Artificial sequence related to HLA knockouts in cell therapy
gccttgtgtgggactgagagg

SEQ ID NO: 20848 - DNA, 21 bp, Artificial Sequence
  Artificial sequence related to HLA knockouts in cell therapy
ccttgtgtgggactgagaggc

SEQ ID NO: 20849 - DNA, 21 bp, Artificial Sequence
  Artificial sequence related to HLA knockouts in cell therapy
atgtgaggaggtggggagacc

SEQ ID NO: 20850 - DNA, 21 bp, Artificial Sequence
  Artificial sequence related to HLA knockouts in cell therapy
tgtgaggaggtggggagacca

SEQ ID NO: 20851 - DNA, 21 bp, Artificial Sequence
  Artificial sequence related to HLA knockouts in cell therapy
gtgaggaggtggggagaccac

SEQ ID NO: 20852 - DNA, 21 bp, Artificial Sequence
  Artificial sequence related to HLA knockouts in cell therapy
tgaggaggtggggagaccacc

SEQ ID NO: 20853 - DNA, 21 bp, Artificial Sequence
  Artificial sequence related to HLA knockouts in cell therapy
gaggaggtggggagaccaccc

SEQ ID NO: 20854 - DNA, 21 bp, Artificial Sequence
  Artificial sequence related to HLA knockouts in cell therapy
aggaggtggggagaccacccc

SEQ ID NO: 20855 - DNA, 21 bp, Artificial Sequence
  Artificial sequence related to HLA knockouts in cell therapy
ggaggtggggagaccacccca

SEQ ID NO: 20856 - DNA, 21 bp, Artificial Sequence
  Artificial sequence related to HLA knockouts in cell therapy
gaggtggggagaccaccccac

SEQ ID NO: 20857 - DNA, 21 bp, Artificial Sequence
  Artificial sequence related to HLA knockouts in cell therapy
aggtggggagaccaccccacc

SEQ ID NO: 20858 - DNA, 21 bp, Artificial Sequence
  Artificial sequence related to HLA knockouts in cell therapy
ggtggggagaccaccccaccc

SEQ ID NO: 20859 - DNA, 21 bp, Artificial Sequence
  Artificial sequence related to HLA knockouts in cell therapy
gtggggagaccaccccacccc

SEQ ID NO: 20860 - DNA, 21 bp, Artificial Sequence
  Artificial sequence related to HLA knockouts in cell therapy
tggggagaccaccccaccccc

SEQ ID NO: 20861 - DNA, 21 bp, Artificial Sequence
  Artificial sequence related to HLA knockouts in cell therapy
ggggagaccaccccaccccca

SEQ ID NO: 20862 - DNA, 21 bp, Artificial Sequence
  Artificial sequence related to HLA knockouts in cell therapy
gggagaccaccccacccccat

SEQ ID NO: 20863 - DNA, 21 bp, Artificial Sequence
  Artificial sequence related to HLA knockouts in cell therapy
ggagaccaccccacccccatg

SEQ ID NO: 20864 - DNA, 21 bp, Artificial Sequence
  Artificial sequence related to HLA knockouts in cell therapy
gagaccaccccacccccatgt

SEQ ID NO: 20865 - DNA, 21 bp, Artificial Sequence
  Artificial sequence related to HLA knockouts in cell therapy
agaccaccccacccccatgtc

SEQ ID NO: 20866 - DNA, 21 bp, Artificial Sequence
  Artificial sequence related to HLA knockouts in cell therapy
gaccaccccacccccatgtcc

SEQ ID NO: 20867 - DNA, 21 bp, Artificial Sequence
  Artificial sequence related to HLA knockouts in cell therapy
accaccccacccccatgtcca

SEQ ID NO: 20868 - DNA, 21 bp, Artificial Sequence
  Artificial sequence related to HLA knockouts in cell therapy
ccaccccacccccatgtccac

SEQ ID NO: 20869 - DNA, 21 bp, Artificial Sequence
  Artificial sequence related to HLA knockouts in cell therapy
caccccacccccatgtccacc

SEQ ID NO: 20870 - DNA, 21 bp, Artificial Sequence
  Artificial sequence related to HLA knockouts in cell therapy
accccacccccatgtccacca

SEQ ID NO: 20871 - DNA, 21 bp, Artificial Sequence
  Artificial sequence related to HLA knockouts in cell therapy
ccccacccccatgtccaccat

SEQ ID NO: 20872 - DNA, 21 bp, Artificial Sequence
  Artificial sequence related to HLA knockouts in cell therapy
cccacccccatgtccaccatg

SEQ ID NO: 20873 - DNA, 21 bp, Artificial Sequence
  Artificial sequence related to HLA knockouts in cell therapy
ccacccccatgtccaccatga

SEQ ID NO: 20874 - DNA, 21 bp, Artificial Sequence
  Artificial sequence related to HLA knockouts in cell therapy
cacccccatgtccaccatgac

SEQ ID NO: 20875 - DNA, 21 bp, Artificial Sequence
  Artificial sequence related to HLA knockouts in cell therapy
acccccatgtccaccatgacc

SEQ ID NO: 20876 - DNA, 21 bp, Artificial Sequence
  Artificial sequence related to HLA knockouts in cell therapy
cccccatgtccaccatgaccc

SEQ ID NO: 20877 - DNA, 21 bp, Artificial Sequence
  Artificial sequence related to HLA knockouts in cell therapy
ccccatgtccaccatgaccct

SEQ ID NO: 20878 - DNA, 21 bp, Artificial Sequence
  Artificial sequence related to HLA knockouts in cell therapy
cccatgtccaccatgaccctc

SEQ ID NO: 20879 - DNA, 21 bp, Artificial Sequence
  Artificial sequence related to HLA knockouts in cell therapy
gtccaccatgaccctcttccc

SEQ ID NO: 20880 - DNA, 21 bp, Artificial Sequence
  Artificial sequence related to HLA knockouts in cell therapy
ccaccatgaccctcttcccac

SEQ ID NO: 20881 - DNA, 21 bp, Artificial Sequence
  Artificial sequence related to HLA knockouts in cell therapy
caccatgaccctcttcccacg

SEQ ID NO: 20882 - DNA, 21 bp, Artificial Sequence
  Artificial sequence related to HLA knockouts in cell therapy
accatgaccctcttcccacgc

SEQ ID NO: 20883 - DNA, 21 bp, Artificial Sequence
  Artificial sequence related to HLA knockouts in cell therapy
ccatgaccctcttcccacgct

SEQ ID NO: 20884 - DNA, 21 bp, Artificial Sequence
  Artificial sequence related to HLA knockouts in cell therapy
catgaccctcttcccacgctg

SEQ ID NO: 20885 - DNA, 21 bp, Artificial Sequence
  Artificial sequence related to HLA knockouts in cell therapy
tgaccctcttcccacgctgac

SEQ ID NO: 20886 - DNA, 21 bp, Artificial Sequence
  Artificial sequence related to HLA knockouts in cell therapy
gaccctcttcccacgctgacc

SEQ ID NO: 20887 - DNA, 21 bp, Artificial Sequence
  Artificial sequence related to HLA knockouts in cell therapy
accctcttcccacgctgacct

SEQ ID NO: 20888 - DNA, 21 bp, Artificial Sequence
  Artificial sequence related to HLA knockouts in cell therapy
ccctcttcccacgctgacctg

SEQ ID NO: 20889 - DNA, 21 bp, Artificial Sequence
  Artificial sequence related to HLA knockouts in cell therapy
cctcttcccacgctgacctgt

SEQ ID NO: 20890 - DNA, 21 bp, Artificial Sequence
  Artificial sequence related to HLA knockouts in cell therapy
ctcttcccacgctgacctgtg

SEQ ID NO: 20891 - DNA, 21 bp, Artificial Sequence
  Artificial sequence related to HLA knockouts in cell therapy
tcttcccacgctgacctgtgc

SEQ ID NO: 20892 - DNA, 21 bp, Artificial Sequence
  Artificial sequence related to HLA knockouts in cell therapy
cttcccacgctgacctgtgct

SEQ ID NO: 20893 - DNA, 21 bp, Artificial Sequence
  Artificial sequence related to HLA knockouts in cell therapy
ttcccacgctgacctgtgctc

SEQ ID NO: 20894 - DNA, 21 bp, Artificial Sequence
  Artificial sequence related to HLA knockouts in cell therapy
tcccacgctgacctgtgctcc

SEQ ID NO: 20895 - DNA, 21 bp, Artificial Sequence
  Artificial sequence related to HLA knockouts in cell therapy
cccacgctgacctgtgctccc

SEQ ID NO: 20896 - DNA, 21 bp, Artificial Sequence
  Artificial sequence related to HLA knockouts in cell therapy
ccacgctgacctgtgctccct

SEQ ID NO: 20897 - DNA, 21 bp, Artificial Sequence
  Artificial sequence related to HLA knockouts in cell therapy
cacgctgacctgtgctccctc

SEQ ID NO: 20898 - DNA, 21 bp, Artificial Sequence
  Artificial sequence related to HLA knockouts in cell therapy
acgctgacctgtgctccctcc

SEQ ID NO: 20899 - DNA, 21 bp, Artificial Sequence
  Artificial sequence related to HLA knockouts in cell therapy
cgctgacctgtgctccctccc

SEQ ID NO: 20900 - DNA, 21 bp, Artificial Sequence
  Artificial sequence related to HLA knockouts in cell therapy
gctgacctgtgctccctcccc

SEQ ID NO: 20901 - DNA, 21 bp, Artificial Sequence
  Artificial sequence related to HLA knockouts in cell therapy
ctgacctgtgctccctcccca

SEQ ID NO: 20902 - DNA, 21 bp, Artificial Sequence
  Artificial sequence related to HLA knockouts in cell therapy
tgacctgtgctccctccccaa

SEQ ID NO: 20903 - DNA, 21 bp, Artificial Sequence
  Artificial sequence related to HLA knockouts in cell therapy
gacctgtgctccctccccaat

SEQ ID NO: 20904 - DNA, 21 bp, Artificial Sequence
  Artificial sequence related to HLA knockouts in cell therapy
acctgtgctccctccccaatc

SEQ ID NO: 20905 - DNA, 21 bp, Artificial Sequence
  Artificial sequence related to HLA knockouts in cell therapy
cctgtgctccctccccaatca

SEQ ID NO: 20906 - DNA, 21 bp, Artificial Sequence
  Artificial sequence related to HLA knockouts in cell therapy
tcctgttccagagaggtgggg

SEQ ID NO: 20907 - DNA, 21 bp, Artificial Sequence
  Artificial sequence related to HLA knockouts in cell therapy
cctgttccagagaggtggggc

SEQ ID NO: 20908 - DNA, 21 bp, Artificial Sequence
  Artificial sequence related to HLA knockouts in cell therapy
ctgttccagagaggtggggct

SEQ ID NO: 20909 - DNA, 21 bp, Artificial Sequence
  Artificial sequence related to HLA knockouts in cell therapy
tgttccagagaggtggggctg

SEQ ID NO: 20910 - DNA, 21 bp, Artificial Sequence
  Artificial sequence related to HLA knockouts in cell therapy
gttccagagaggtggggctga

SEQ ID NO: 20911 - DNA, 21 bp, Artificial Sequence
  Artificial sequence related to HLA knockouts in cell therapy
ttccagagaggtggggctgag

SEQ ID NO: 20912 - DNA, 21 bp, Artificial Sequence
  Artificial sequence related to HLA knockouts in cell therapy
tccagagaggtggggctgagg

SEQ ID NO: 20913 - DNA, 21 bp, Artificial Sequence
  Artificial sequence related to HLA knockouts in cell therapy
ccagagaggtggggctgaggt

SEQ ID NO: 20914 - DNA, 21 bp, Artificial Sequence
  Artificial sequence related to HLA knockouts in cell therapy
cagagaggtggggctgaggtg

SEQ ID NO: 20915 - DNA, 21 bp, Artificial Sequence
  Artificial sequence related to HLA knockouts in cell therapy
agagaggtggggctgaggtgt

SEQ ID NO: 20916 - DNA, 21 bp, Artificial Sequence
  Artificial sequence related to HLA knockouts in cell therapy
gagaggtggggctgaggtgtc

SEQ ID NO: 20917 - DNA, 21 bp, Artificial Sequence
  Artificial sequence related to HLA knockouts in cell therapy
agaggtggggctgaggtgtct

SEQ ID NO: 20918 - DNA, 21 bp, Artificial Sequence
  Artificial sequence related to HLA knockouts in cell therapy
gaggtggggctgaggtgtctc

SEQ ID NO: 20919 - DNA, 21 bp, Artificial Sequence
  Artificial sequence related to HLA knockouts in cell therapy
aggtggggctgaggtgtctcc

SEQ ID NO: 20920 - DNA, 21 bp, Artificial Sequence
  Artificial sequence related to HLA knockouts in cell therapy
ggtggggctgaggtgtctcca

SEQ ID NO: 20921 - DNA, 21 bp, Artificial Sequence
  Artificial sequence related to HLA knockouts in cell therapy
gtggggctgaggtgtctccat

SEQ ID NO: 20922 - DNA, 21 bp, Artificial Sequence
  Artificial sequence related to HLA knockouts in cell therapy
tggggctgaggtgtctccatc

SEQ ID NO: 20923 - DNA, 21 bp, Artificial Sequence
  Artificial sequence related to HLA knockouts in cell therapy
ggggctgaggtgtctccatct

SEQ ID NO: 20924 - DNA, 21 bp, Artificial Sequence
  Artificial sequence related to HLA knockouts in cell therapy
gggctgaggtgtctccatctc

SEQ ID NO: 20925 - DNA, 22 bp, Artificial Sequence
  Artificial sequence related to HLA knockouts in cell therapy
cagaagcagaggggtcagggcg

SEQ ID NO: 20926 - DNA, 22 bp, Artificial Sequence
  Artificial sequence related to HLA knockouts in cell therapy
agaagcagaggggtcagggcga

SEQ ID NO: 20927 - DNA, 22 bp, Artificial Sequence
  Artificial sequence related to HLA knockouts in cell therapy
gaagcagaggggtcagggcgaa

SEQ ID NO: 20928 - DNA, 22 bp, Artificial Sequence
  Artificial sequence related to HLA knockouts in cell therapy
aagcagaggggtcagggcgaag

SEQ ID NO: 20929 - DNA, 22 bp, Artificial Sequence
  Artificial sequence related to HLA knockouts in cell therapy
agcagaggggtcagggcgaagt

SEQ ID NO: 20930 - DNA, 22 bp, Artificial Sequence
  Artificial sequence related to HLA knockouts in cell therapy
gcagaggggtcagggcgaagtc

SEQ ID NO: 20931 - DNA, 22 bp, Artificial Sequence
  Artificial sequence related to HLA knockouts in cell therapy
cagaggggtcagggcgaagtcc

SEQ ID NO: 20932 - DNA, 22 bp, Artificial Sequence
  Artificial sequence related to HLA knockouts in cell therapy
agaggggtcagggcgaagtccc

SEQ ID NO: 20933 - DNA, 22 bp, Artificial Sequence
  Artificial sequence related to HLA knockouts in cell therapy
gaggggtcagggcgaagtccca

SEQ ID NO: 20934 - DNA, 22 bp, Artificial Sequence
  Artificial sequence related to HLA knockouts in cell therapy
aggggtcagggcgaagtcccag

SEQ ID NO: 20935 - DNA, 22 bp, Artificial Sequence
  Artificial sequence related to HLA knockouts in cell therapy
ggggtcagggcgaagtcccagg

SEQ ID NO: 20936 - DNA, 22 bp, Artificial Sequence
  Artificial sequence related to HLA knockouts in cell therapy
gggtcagggcgaagtcccaggg

SEQ ID NO: 20937 - DNA, 22 bp, Artificial Sequence
  Artificial sequence related to HLA knockouts in cell therapy
ggtcagggcgaagtcccagggc

SEQ ID NO: 20938 - DNA, 22 bp, Artificial Sequence
  Artificial sequence related to HLA knockouts in cell therapy
gtcagggcgaagtcccagggcc

SEQ ID NO: 20939 - DNA, 22 bp, Artificial Sequence
  Artificial sequence related to HLA knockouts in cell therapy
tcagggcgaagtcccagggccc

SEQ ID NO: 20940 - DNA, 22 bp, Artificial Sequence
  Artificial sequence related to HLA knockouts in cell therapy
cagggcgaagtcccagggcccc

SEQ ID NO: 20941 - DNA, 22 bp, Artificial Sequence
  Artificial sequence related to HLA knockouts in cell therapy
agggcgaagtcccagggcccca

SEQ ID NO: 20942 - DNA, 22 bp, Artificial Sequence
  Artificial sequence related to HLA knockouts in cell therapy
gggcgaagtcccagggccccag

SEQ ID NO: 20943 - DNA, 22 bp, Artificial Sequence
  Artificial sequence related to HLA knockouts in cell therapy
ggcgaagtcccagggccccagg

SEQ ID NO: 20944 - DNA, 22 bp, Artificial Sequence
  Artificial sequence related to HLA knockouts in cell therapy
gcgaagtcccagggccccaggc

SEQ ID NO: 20945 - DNA, 22 bp, Artificial Sequence
  Artificial sequence related to HLA knockouts in cell therapy
cgaagtcccagggccccaggcg

SEQ ID NO: 20946 - DNA, 22 bp, Artificial Sequence
  Artificial sequence related to HLA knockouts in cell therapy
gaagtcccagggccccaggcgt

SEQ ID NO: 20947 - DNA, 22 bp, Artificial Sequence
  Artificial sequence related to HLA knockouts in cell therapy
aagtcccagggccccaggcgtg

SEQ ID NO: 20948 - DNA, 22 bp, Artificial Sequence
  Artificial sequence related to HLA knockouts in cell therapy
agtcccagggccccaggcgtgg

SEQ ID NO: 20949 - DNA, 22 bp, Artificial Sequence
  Artificial sequence related to HLA knockouts in cell therapy
gtcccagggccccaggcgtggc

SEQ ID NO: 20950 - DNA, 22 bp, Artificial Sequence
  Artificial sequence related to HLA knockouts in cell therapy
tcccagggccccaggcgtggct

SEQ ID NO: 20951 - DNA, 22 bp, Artificial Sequence
  Artificial sequence related to HLA knockouts in cell therapy
cccagggccccaggcgtggctc

SEQ ID NO: 20952 - DNA, 22 bp, Artificial Sequence
  Artificial sequence related to HLA knockouts in cell therapy
ccagggccccaggcgtggctct

SEQ ID NO: 20953 - DNA, 22 bp, Artificial Sequence
  Artificial sequence related to HLA knockouts in cell therapy
cagggccccaggcgtggctctc

SEQ ID NO: 20954 - DNA, 22 bp, Artificial Sequence
  Artificial sequence related to HLA knockouts in cell therapy
agggccccaggcgtggctctca

SEQ ID NO: 20955 - DNA, 22 bp, Artificial Sequence
  Artificial sequence related to HLA knockouts in cell therapy
gggccccaggcgtggctctcag

SEQ ID NO: 20956 - DNA, 22 bp, Artificial Sequence
  Artificial sequence related to HLA knockouts in cell therapy
ggccccaggcgtggctctcagg

SEQ ID NO: 20957 - DNA, 22 bp, Artificial Sequence
  Artificial sequence related to HLA knockouts in cell therapy
gccccaggcgtggctctcaggg

SEQ ID NO: 20958 - DNA, 22 bp, Artificial Sequence
  Artificial sequence related to HLA knockouts in cell therapy
ccccaggcgtggctctcagggt

SEQ ID NO: 20959 - DNA, 22 bp, Artificial Sequence
  Artificial sequence related to HLA knockouts in cell therapy
cccaggcgtggctctcagggtc

SEQ ID NO: 20960 - DNA, 22 bp, Artificial Sequence
  Artificial sequence related to HLA knockouts in cell therapy
ccaggcgtggctctcagggtct

SEQ ID NO: 20961 - DNA, 22 bp, Artificial Sequence
  Artificial sequence related to HLA knockouts in cell therapy
caggcgtggctctcagggtctc

SEQ ID NO: 20962 - DNA, 22 bp, Artificial Sequence
  Artificial sequence related to HLA knockouts in cell therapy
aggcgtggctctcagggtctca

SEQ ID NO: 20963 - DNA, 22 bp, Artificial Sequence
  Artificial sequence related to HLA knockouts in cell therapy
ggcgtggctctcagggtctcag

SEQ ID NO: 20964 - DNA, 22 bp, Artificial Sequence
  Artificial sequence related to HLA knockouts in cell therapy
gcgtggctctcagggtctcagg

SEQ ID NO: 20965 - DNA, 22 bp, Artificial Sequence
  Artificial sequence related to HLA knockouts in cell therapy
cgtggctctcagggtctcaggc

SEQ ID NO: 20966 - DNA, 22 bp, Artificial Sequence
  Artificial sequence related to HLA knockouts in cell therapy
gtggctctcagggtctcaggcc

SEQ ID NO: 20967 - DNA, 22 bp, Artificial Sequence
  Artificial sequence related to HLA knockouts in cell therapy
tggctctcagggtctcaggccc

SEQ ID NO: 20968 - DNA, 22 bp, Artificial Sequence
  Artificial sequence related to HLA knockouts in cell therapy
ggctctcagggtctcaggcccc

SEQ ID NO: 20969 - DNA, 22 bp, Artificial Sequence
  Artificial sequence related to HLA knockouts in cell therapy
gctctcagggtctcaggccccg

SEQ ID NO: 20970 - DNA, 22 bp, Artificial Sequence
  Artificial sequence related to HLA knockouts in cell therapy
ctctcagggtctcaggccccga

SEQ ID NO: 20971 - DNA, 22 bp, Artificial Sequence
  Artificial sequence related to HLA knockouts in cell therapy
tctcagggtctcaggccccgaa

SEQ ID NO: 20972 - DNA, 22 bp, Artificial Sequence
  Artificial sequence related to HLA knockouts in cell therapy
ctcagggtctcaggccccgaag

SEQ ID NO: 20973 - DNA, 22 bp, Artificial Sequence
  Artificial sequence related to HLA knockouts in cell therapy
tcagggtctcaggccccgaagg

SEQ ID NO: 20974 - DNA, 22 bp, Artificial Sequence
  Artificial sequence related to HLA knockouts in cell therapy
cagggtctcaggccccgaaggc

SEQ ID NO: 20975 - DNA, 22 bp, Artificial Sequence
  Artificial sequence related to HLA knockouts in cell therapy
agggtctcaggccccgaaggcg

SEQ ID NO: 20976 - DNA, 22 bp, Artificial Sequence
  Artificial sequence related to HLA knockouts in cell therapy
gggtctcaggccccgaaggcgg

SEQ ID NO: 20977 - DNA, 22 bp, Artificial Sequence
  Artificial sequence related to HLA knockouts in cell therapy
ggtctcaggccccgaaggcggt

SEQ ID NO: 20978 - DNA, 22 bp, Artificial Sequence
  Artificial sequence related to HLA knockouts in cell therapy
gtctcaggccccgaaggcggtg

SEQ ID NO: 20979 - DNA, 22 bp, Artificial Sequence
  Artificial sequence related to HLA knockouts in cell therapy
tctcaggccccgaaggcggtgt

SEQ ID NO: 20980 - DNA, 22 bp, Artificial Sequence
  Artificial sequence related to HLA knockouts in cell therapy
ctcaggccccgaaggcggtgta

SEQ ID NO: 20981 - DNA, 22 bp, Artificial Sequence
  Artificial sequence related to HLA knockouts in cell therapy
tcaggccccgaaggcggtgtat

SEQ ID NO: 20982 - DNA, 22 bp, Artificial Sequence
  Artificial sequence related to HLA knockouts in cell therapy
caggccccgaaggcggtgtatg

SEQ ID NO: 20983 - DNA, 22 bp, Artificial Sequence
  Artificial sequence related to HLA knockouts in cell therapy
aggccccgaaggcggtgtatgg

SEQ ID NO: 20984 - DNA, 22 bp, Artificial Sequence
  Artificial sequence related to HLA knockouts in cell therapy
ggccccgaaggcggtgtatgga

SEQ ID NO: 20985 - DNA, 22 bp, Artificial Sequence
  Artificial sequence related to HLA knockouts in cell therapy
gccccgaaggcggtgtatggat

SEQ ID NO: 20986 - DNA, 22 bp, Artificial Sequence
  Artificial sequence related to HLA knockouts in cell therapy
ggattggggagtcccagccttg

SEQ ID NO: 20987 - DNA, 22 bp, Artificial Sequence
  Artificial sequence related to HLA knockouts in cell therapy
gattggggagtcccagccttgg

SEQ ID NO: 20988 - DNA, 22 bp, Artificial Sequence
  Artificial sequence related to HLA knockouts in cell therapy
attggggagtcccagccttggg

SEQ ID NO: 20989 - DNA, 22 bp, Artificial Sequence
  Artificial sequence related to HLA knockouts in cell therapy
ttggggagtcccagccttgggg

SEQ ID NO: 20990 - DNA, 22 bp, Artificial Sequence
  Artificial sequence related to HLA knockouts in cell therapy
tggggagtcccagccttgggga

SEQ ID NO: 20991 - DNA, 22 bp, Artificial Sequence
  Artificial sequence related to HLA knockouts in cell therapy
ggggagtcccagccttggggat

SEQ ID NO: 20992 - DNA, 22 bp, Artificial Sequence
  Artificial sequence related to HLA knockouts in cell therapy
gggagtcccagccttggggatt

SEQ ID NO: 20993 - DNA, 22 bp, Artificial Sequence
  Artificial sequence related to HLA knockouts in cell therapy
ggagtcccagccttggggattc

SEQ ID NO: 20994 - DNA, 22 bp, Artificial Sequence
  Artificial sequence related to HLA knockouts in cell therapy
gagtcccagccttggggattcc

SEQ ID NO: 20995 - DNA, 22 bp, Artificial Sequence
  Artificial sequence related to HLA knockouts in cell therapy
agtcccagccttggggattccc

SEQ ID NO: 20996 - DNA, 22 bp, Artificial Sequence
  Artificial sequence related to HLA knockouts in cell therapy
gtcccagccttggggattcccc

SEQ ID NO: 20997 - DNA, 22 bp, Artificial Sequence
  Artificial sequence related to HLA knockouts in cell therapy
tcccagccttggggattcccca

SEQ ID NO: 20998 - DNA, 22 bp, Artificial Sequence
  Artificial sequence related to HLA knockouts in cell therapy
cccagccttggggattccccaa

SEQ ID NO: 20999 - DNA, 22 bp, Artificial Sequence
  Artificial sequence related to HLA knockouts in cell therapy
ccagccttggggattccccaac

SEQ ID NO: 21000 - DNA, 22 bp, Artificial Sequence
  Artificial sequence related to HLA knockouts in cell therapy
gccttggggattccccaactcc

SEQ ID NO: 21001 - DNA, 22 bp, Artificial Sequence
  Artificial sequence related to HLA knockouts in cell therapy
ccttggggattccccaactccg

SEQ ID NO: 21002 - DNA, 22 bp, Artificial Sequence
  Artificial sequence related to HLA knockouts in cell therapy
cttggggattccccaactccgc

SEQ ID NO: 21003 - DNA, 22 bp, Artificial Sequence
  Artificial sequence related to HLA knockouts in cell therapy
tggggattccccaactccgcag

SEQ ID NO: 21004 - DNA, 22 bp, Artificial Sequence
  Artificial sequence related to HLA knockouts in cell therapy
ggggattccccaactccgcagt

SEQ ID NO: 21005 - DNA, 22 bp, Artificial Sequence
  Artificial sequence related to HLA knockouts in cell therapy
cctggatactcacgacgcggac

SEQ ID NO: 21006 - DNA, 22 bp, Artificial Sequence
  Artificial sequence related to HLA knockouts in cell therapy
ctggatactcacgacgcggacc

SEQ ID NO: 21007 - DNA, 22 bp, Artificial Sequence
  Artificial sequence related to HLA knockouts in cell therapy
tggatactcacgacgcggaccc

SEQ ID NO: 21008 - DNA, 22 bp, Artificial Sequence
  Artificial sequence related to HLA knockouts in cell therapy
ggatactcacgacgcggaccca

SEQ ID NO: 21009 - DNA, 22 bp, Artificial Sequence
  Artificial sequence related to HLA knockouts in cell therapy
gatactcacgacgcggacccag

SEQ ID NO: 21010 - DNA, 22 bp, Artificial Sequence
  Artificial sequence related to HLA knockouts in cell therapy
actcacgacgcggacccagttc

SEQ ID NO: 21011 - DNA, 22 bp, Artificial Sequence
  Artificial sequence related to HLA knockouts in cell therapy
ctcacgacgcggacccagttct

SEQ ID NO: 21012 - DNA, 22 bp, Artificial Sequence
  Artificial sequence related to HLA knockouts in cell therapy
tcacgacgcggacccagttctc

SEQ ID NO: 21013 - DNA, 22 bp, Artificial Sequence
  Artificial sequence related to HLA knockouts in cell therapy
cacgacgcggacccagttctca

SEQ ID NO: 21014 - DNA, 22 bp, Artificial Sequence
  Artificial sequence related to HLA knockouts in cell therapy
acgacgcggacccagttctcac

SEQ ID NO: 21015 - DNA, 22 bp, Artificial Sequence
  Artificial sequence related to HLA knockouts in cell therapy
cgacgcggacccagttctcact

SEQ ID NO: 21016 - DNA, 22 bp, Artificial Sequence
  Artificial sequence related to HLA knockouts in cell therapy
gacgcggacccagttctcactc

SEQ ID NO: 21017 - DNA, 22 bp, Artificial Sequence
  Artificial sequence related to HLA knockouts in cell therapy
acgcggacccagttctcactcc

SEQ ID NO: 21018 - DNA, 22 bp, Artificial Sequence
  Artificial sequence related to HLA knockouts in cell therapy
cgcggacccagttctcactccc

SEQ ID NO: 21019 - DNA, 22 bp, Artificial Sequence
  Artificial sequence related to HLA knockouts in cell therapy
gcggacccagttctcactccca

SEQ ID NO: 21020 - DNA, 22 bp, Artificial Sequence
  Artificial sequence related to HLA knockouts in cell therapy
ctcactcccattgggtgtcggg

SEQ ID NO: 21021 - DNA, 22 bp, Artificial Sequence
  Artificial sequence related to HLA knockouts in cell therapy
gccaatcagtgtcgtcgcggtc

SEQ ID NO: 21022 - DNA, 22 bp, Artificial Sequence
  Artificial sequence related to HLA knockouts in cell therapy
ccaatcagtgtcgtcgcggtcg

SEQ ID NO: 21023 - DNA, 22 bp, Artificial Sequence
  Artificial sequence related to HLA knockouts in cell therapy
caatcagtgtcgtcgcggtcgc

SEQ ID NO: 21024 - DNA, 22 bp, Artificial Sequence
  Artificial sequence related to HLA knockouts in cell therapy
aatcagtgtcgtcgcggtcgcg

SEQ ID NO: 21025 - DNA, 22 bp, Artificial Sequence
  Artificial sequence related to HLA knockouts in cell therapy
atcagtgtcgtcgcggtcgcgg

SEQ ID NO: 21026 - DNA, 22 bp, Artificial Sequence
  Artificial sequence related to HLA knockouts in cell therapy
tcagtgtcgtcgcggtcgcggt

SEQ ID NO: 21027 - DNA, 22 bp, Artificial Sequence
  Artificial sequence related to HLA knockouts in cell therapy
cagtgtcgtcgcggtcgcggtt

SEQ ID NO: 21028 - DNA, 22 bp, Artificial Sequence
  Artificial sequence related to HLA knockouts in cell therapy
agtgtcgtcgcggtcgcggttc

SEQ ID NO: 21029 - DNA, 22 bp, Artificial Sequence
  Artificial sequence related to HLA knockouts in cell therapy
gtgtcgtcgcggtcgcggttct

SEQ ID NO: 21030 - DNA, 22 bp, Artificial Sequence
  Artificial sequence related to HLA knockouts in cell therapy
tgtcgtcgcggtcgcggttcta

SEQ ID NO: 21031 - DNA, 22 bp, Artificial Sequence
  Artificial sequence related to HLA knockouts in cell therapy
gtcgtcgcggtcgcggttctaa

SEQ ID NO: 21032 - DNA, 22 bp, Artificial Sequence
  Artificial sequence related to HLA knockouts in cell therapy
cgtcgcggtcgcggttctaaag

SEQ ID NO: 21033 - DNA, 22 bp, Artificial Sequence
  Artificial sequence related to HLA knockouts in cell therapy
cgcggtcgcggttctaaagtcc

SEQ ID NO: 21034 - DNA, 22 bp, Artificial Sequence
  Artificial sequence related to HLA knockouts in cell therapy
gcggtcgcggttctaaagtccg

SEQ ID NO: 21035 - DNA, 22 bp, Artificial Sequence
  Artificial sequence related to HLA knockouts in cell therapy
cggtcgcggttctaaagtccgc

SEQ ID NO: 21036 - DNA, 22 bp, Artificial Sequence
  Artificial sequence related to HLA knockouts in cell therapy
cgcggttctaaagtccgcacgc

SEQ ID NO: 21037 - DNA, 22 bp, Artificial Sequence
  Artificial sequence related to HLA knockouts in cell therapy
ctaaagtccgcacgcacccacc

SEQ ID NO: 21038 - DNA, 22 bp, Artificial Sequence
  Artificial sequence related to HLA knockouts in cell therapy
taaagtccgcacgcacccaccg

SEQ ID NO: 21039 - DNA, 22 bp, Artificial Sequence
  Artificial sequence related to HLA knockouts in cell therapy
aaagtccgcacgcacccaccgg

SEQ ID NO: 21040 - DNA, 22 bp, Artificial Sequence
  Artificial sequence related to HLA knockouts in cell therapy
aagtccgcacgcacccaccggg

SEQ ID NO: 21041 - DNA, 22 bp, Artificial Sequence
  Artificial sequence related to HLA knockouts in cell therapy
agtccgcacgcacccaccggga

SEQ ID NO: 21042 - DNA, 22 bp, Artificial Sequence
  Artificial sequence related to HLA knockouts in cell therapy
gtccgcacgcacccaccgggac

SEQ ID NO: 21043 - DNA, 22 bp, Artificial Sequence
  Artificial sequence related to HLA knockouts in cell therapy
tccgcacgcacccaccgggact

SEQ ID NO: 21044 - DNA, 22 bp, Artificial Sequence
  Artificial sequence related to HLA knockouts in cell therapy
ccgcacgcacccaccgggactc

SEQ ID NO: 21045 - DNA, 22 bp, Artificial Sequence
  Artificial sequence related to HLA knockouts in cell therapy
cgcacgcacccaccgggactca

SEQ ID NO: 21046 - DNA, 22 bp, Artificial Sequence
  Artificial sequence related to HLA knockouts in cell therapy
gcacgcacccaccgggactcag

SEQ ID NO: 21047 - DNA, 22 bp, Artificial Sequence
  Artificial sequence related to HLA knockouts in cell therapy
cacgcacccaccgggactcaga

SEQ ID NO: 21048 - DNA, 22 bp, Artificial Sequence
  Artificial sequence related to HLA knockouts in cell therapy
acgcacccaccgggactcagat

SEQ ID NO: 21049 - DNA, 22 bp, Artificial Sequence
  Artificial sequence related to HLA knockouts in cell therapy
cgcacccaccgggactcagatt

SEQ ID NO: 21050 - DNA, 22 bp, Artificial Sequence
  Artificial sequence related to HLA knockouts in cell therapy
gcacccaccgggactcagattc

SEQ ID NO: 21051 - DNA, 22 bp, Artificial Sequence
  Artificial sequence related to HLA knockouts in cell therapy
cccaccgggactcagattctcc

SEQ ID NO: 21052 - DNA, 22 bp, Artificial Sequence
  Artificial sequence related to HLA knockouts in cell therapy
ccaccgggactcagattctccc

SEQ ID NO: 21053 - DNA, 22 bp, Artificial Sequence
  Artificial sequence related to HLA knockouts in cell therapy
caccgggactcagattctcccc

SEQ ID NO: 21054 - DNA, 22 bp, Artificial Sequence
  Artificial sequence related to HLA knockouts in cell therapy
ccgggactcagattctccccag

SEQ ID NO: 21055 - DNA, 22 bp, Artificial Sequence
  Artificial sequence related to HLA knockouts in cell therapy
ctcagattctccccagacgccg

SEQ ID NO: 21056 - DNA, 22 bp, Artificial Sequence
  Artificial sequence related to HLA knockouts in cell therapy
cagattctccccagacgccgag

SEQ ID NO: 21057 - DNA, 22 bp, Artificial Sequence
  Artificial sequence related to HLA knockouts in cell therapy
agattctccccagacgccgagg

SEQ ID NO: 21058 - DNA, 22 bp, Artificial Sequence
  Artificial sequence related to HLA knockouts in cell therapy
gattctccccagacgccgagga

SEQ ID NO: 21059 - DNA, 22 bp, Artificial Sequence
  Artificial sequence related to HLA knockouts in cell therapy
ttctccccagacgccgaggatg

SEQ ID NO: 21060 - DNA, 22 bp, Artificial Sequence
  Artificial sequence related to HLA knockouts in cell therapy
tctccccagacgccgaggatgg

SEQ ID NO: 21061 - DNA, 22 bp, Artificial Sequence
  Artificial sequence related to HLA knockouts in cell therapy
ctccccagacgccgaggatggc

SEQ ID NO: 21062 - DNA, 22 bp, Artificial Sequence
  Artificial sequence related to HLA knockouts in cell therapy
tccccagacgccgaggatggcc

SEQ ID NO: 21063 - DNA, 22 bp, Artificial Sequence
  Artificial sequence related to HLA knockouts in cell therapy
ccccagacgccgaggatggccg

SEQ ID NO: 21064 - DNA, 22 bp, Artificial Sequence
  Artificial sequence related to HLA knockouts in cell therapy
cccagacgccgaggatggccgt

SEQ ID NO: 21065 - DNA, 22 bp, Artificial Sequence
  Artificial sequence related to HLA knockouts in cell therapy
ccagacgccgaggatggccgtc

SEQ ID NO: 21066 - DNA, 22 bp, Artificial Sequence
  Artificial sequence related to HLA knockouts in cell therapy
cagacgccgaggatggccgtca

SEQ ID NO: 21067 - DNA, 22 bp, Artificial Sequence
  Artificial sequence related to HLA knockouts in cell therapy
agacgccgaggatggccgtcat

SEQ ID NO: 21068 - DNA, 22 bp, Artificial Sequence
  Artificial sequence related to HLA knockouts in cell therapy
gacgccgaggatggccgtcatg

SEQ ID NO: 21069 - DNA, 22 bp, Artificial Sequence
  Artificial sequence related to HLA knockouts in cell therapy
acgccgaggatggccgtcatgg

SEQ ID NO: 21070 - DNA, 22 bp, Artificial Sequence
  Artificial sequence related to HLA knockouts in cell therapy
cgccgaggatggccgtcatggc

SEQ ID NO: 21071 - DNA, 22 bp, Artificial Sequence
  Artificial sequence related to HLA knockouts in cell therapy
gccgaggatggccgtcatggcg

SEQ ID NO: 21072 - DNA, 22 bp, Artificial Sequence
  Artificial sequence related to HLA knockouts in cell therapy
ccgaggatggccgtcatggcgc

SEQ ID NO: 21073 - DNA, 22 bp, Artificial Sequence
  Artificial sequence related to HLA knockouts in cell therapy
cgaggatggccgtcatggcgcc

SEQ ID NO: 21074 - DNA, 22 bp, Artificial Sequence
  Artificial sequence related to HLA knockouts in cell therapy
gaggatggccgtcatggcgccc

SEQ ID NO: 21075 - DNA, 22 bp, Artificial Sequence
  Artificial sequence related to HLA knockouts in cell therapy
aggatggccgtcatggcgcccc

SEQ ID NO: 21076 - DNA, 22 bp, Artificial Sequence
  Artificial sequence related to HLA knockouts in cell therapy
ggatggccgtcatggcgccccg

SEQ ID NO: 21077 - DNA, 22 bp, Artificial Sequence
  Artificial sequence related to HLA knockouts in cell therapy
gatggccgtcatggcgccccga

SEQ ID NO: 21078 - DNA, 22 bp, Artificial Sequence
  Artificial sequence related to HLA knockouts in cell therapy
atggccgtcatggcgccccgaa

SEQ ID NO: 21079 - DNA, 22 bp, Artificial Sequence
  Artificial sequence related to HLA knockouts in cell therapy
tggccgtcatggcgccccgaac

SEQ ID NO: 21080 - DNA, 22 bp, Artificial Sequence
  Artificial sequence related to HLA knockouts in cell therapy
ggccgtcatggcgccccgaacc

SEQ ID NO: 21081 - DNA, 22 bp, Artificial Sequence
  Artificial sequence related to HLA knockouts in cell therapy
gccgtcatggcgccccgaaccc

SEQ ID NO: 21082 - DNA, 22 bp, Artificial Sequence
  Artificial sequence related to HLA knockouts in cell therapy
ccgtcatggcgccccgaaccct

SEQ ID NO: 21083 - DNA, 22 bp, Artificial Sequence
  Artificial sequence related to HLA knockouts in cell therapy
cgtcatggcgccccgaaccctc

SEQ ID NO: 21084 - DNA, 22 bp, Artificial Sequence
  Artificial sequence related to HLA knockouts in cell therapy
gtcatggcgccccgaaccctcg

SEQ ID NO: 21085 - DNA, 22 bp, Artificial Sequence
  Artificial sequence related to HLA knockouts in cell therapy
tcatggcgccccgaaccctcgt

SEQ ID NO: 21086 - DNA, 22 bp, Artificial Sequence
  Artificial sequence related to HLA knockouts in cell therapy
catggcgccccgaaccctcgtc

SEQ ID NO: 21087 - DNA, 22 bp, Artificial Sequence
  Artificial sequence related to HLA knockouts in cell therapy
atggcgccccgaaccctcgtcc

SEQ ID NO: 21088 - DNA, 22 bp, Artificial Sequence
  Artificial sequence related to HLA knockouts in cell therapy
tggcgccccgaaccctcgtcct

SEQ ID NO: 21089 - DNA, 22 bp, Artificial Sequence
  Artificial sequence related to HLA knockouts in cell therapy
ggcgccccgaaccctcgtcctg

SEQ ID NO: 21090 - DNA, 22 bp, Artificial Sequence
  Artificial sequence related to HLA knockouts in cell therapy
gcgccccgaaccctcgtcctgc

SEQ ID NO: 21091 - DNA, 22 bp, Artificial Sequence
  Artificial sequence related to HLA knockouts in cell therapy
cgccccgaaccctcgtcctgct

SEQ ID NO: 21092 - DNA, 22 bp, Artificial Sequence
  Artificial sequence related to HLA knockouts in cell therapy
gccccgaaccctcgtcctgcta

SEQ ID NO: 21093 - DNA, 22 bp, Artificial Sequence
  Artificial sequence related to HLA knockouts in cell therapy
ccccgaaccctcgtcctgctac

SEQ ID NO: 21094 - DNA, 22 bp, Artificial Sequence
  Artificial sequence related to HLA knockouts in cell therapy
cccgaaccctcgtcctgctact

SEQ ID NO: 21095 - DNA, 22 bp, Artificial Sequence
  Artificial sequence related to HLA knockouts in cell therapy
ccgaaccctcgtcctgctactc

SEQ ID NO: 21096 - DNA, 22 bp, Artificial Sequence
  Artificial sequence related to HLA knockouts in cell therapy
accctcgtcctgctactctcgg

SEQ ID NO: 21097 - DNA, 22 bp, Artificial Sequence
  Artificial sequence related to HLA knockouts in cell therapy
ccctcgtcctgctactctcggg

SEQ ID NO: 21098 - DNA, 22 bp, Artificial Sequence
  Artificial sequence related to HLA knockouts in cell therapy
cctcgtcctgctactctcgggg

SEQ ID NO: 21099 - DNA, 22 bp, Artificial Sequence
  Artificial sequence related to HLA knockouts in cell therapy
ctcgtcctgctactctcggggg

SEQ ID NO: 21100 - DNA, 22 bp, Artificial Sequence
  Artificial sequence related to HLA knockouts in cell therapy
tcgtcctgctactctcgggggc

SEQ ID NO: 21101 - DNA, 22 bp, Artificial Sequence
  Artificial sequence related to HLA knockouts in cell therapy
cgtcctgctactctcgggggct

SEQ ID NO: 21102 - DNA, 22 bp, Artificial Sequence
  Artificial sequence related to HLA knockouts in cell therapy
gtcctgctactctcgggggctc

SEQ ID NO: 21103 - DNA, 22 bp, Artificial Sequence
  Artificial sequence related to HLA knockouts in cell therapy
tcctgctactctcgggggctct

SEQ ID NO: 21104 - DNA, 22 bp, Artificial Sequence
  Artificial sequence related to HLA knockouts in cell therapy
cctgctactctcgggggctctg

SEQ ID NO: 21105 - DNA, 22 bp, Artificial Sequence
  Artificial sequence related to HLA knockouts in cell therapy
ctgctactctcgggggctctgg

SEQ ID NO: 21106 - DNA, 22 bp, Artificial Sequence
  Artificial sequence related to HLA knockouts in cell therapy
tgctactctcgggggctctggc

SEQ ID NO: 21107 - DNA, 22 bp, Artificial Sequence
  Artificial sequence related to HLA knockouts in cell therapy
gctactctcgggggctctggcc

SEQ ID NO: 21108 - DNA, 22 bp, Artificial Sequence
  Artificial sequence related to HLA knockouts in cell therapy
ctactctcgggggctctggccc

SEQ ID NO: 21109 - DNA, 22 bp, Artificial Sequence
  Artificial sequence related to HLA knockouts in cell therapy
tactctcgggggctctggccct

SEQ ID NO: 21110 - DNA, 22 bp, Artificial Sequence
  Artificial sequence related to HLA knockouts in cell therapy
actctcgggggctctggccctg

SEQ ID NO: 21111 - DNA, 22 bp, Artificial Sequence
  Artificial sequence related to HLA knockouts in cell therapy
ctctcgggggctctggccctga

SEQ ID NO: 21112 - DNA, 22 bp, Artificial Sequence
  Artificial sequence related to HLA knockouts in cell therapy
tctcgggggctctggccctgac

SEQ ID NO: 21113 - DNA, 22 bp, Artificial Sequence
  Artificial sequence related to HLA knockouts in cell therapy
ctcgggggctctggccctgacc

SEQ ID NO: 21114 - DNA, 22 bp, Artificial Sequence
  Artificial sequence related to HLA knockouts in cell therapy
tcgggggctctggccctgaccc

SEQ ID NO: 21115 - DNA, 22 bp, Artificial Sequence
  Artificial sequence related to HLA knockouts in cell therapy
cgggggctctggccctgaccca

SEQ ID NO: 21116 - DNA, 22 bp, Artificial Sequence
  Artificial sequence related to HLA knockouts in cell therapy
gggggctctggccctgacccag

SEQ ID NO: 21117 - DNA, 22 bp, Artificial Sequence
  Artificial sequence related to HLA knockouts in cell therapy
ggggctctggccctgacccaga

SEQ ID NO: 21118 - DNA, 22 bp, Artificial Sequence
  Artificial sequence related to HLA knockouts in cell therapy
gggctctggccctgacccagac

SEQ ID NO: 21119 - DNA, 22 bp, Artificial Sequence
  Artificial sequence related to HLA knockouts in cell therapy
ggctctggccctgacccagacc

SEQ ID NO: 21120 - DNA, 22 bp, Artificial Sequence
  Artificial sequence related to HLA knockouts in cell therapy
gctctggccctgacccagacct

SEQ ID NO: 21121 - DNA, 22 bp, Artificial Sequence
  Artificial sequence related to HLA knockouts in cell therapy
ctctggccctgacccagacctg

SEQ ID NO: 21122 - DNA, 22 bp, Artificial Sequence
  Artificial sequence related to HLA knockouts in cell therapy
tctggccctgacccagacctgg

SEQ ID NO: 21123 - DNA, 22 bp, Artificial Sequence
  Artificial sequence related to HLA knockouts in cell therapy
ctggccctgacccagacctggg

SEQ ID NO: 21124 - DNA, 22 bp, Artificial Sequence
  Artificial sequence related to HLA knockouts in cell therapy
tggccctgacccagacctgggc

SEQ ID NO: 21125 - DNA, 22 bp, Artificial Sequence
  Artificial sequence related to HLA knockouts in cell therapy
ggccctgacccagacctgggcg

SEQ ID NO: 21126 - DNA, 22 bp, Artificial Sequence
  Artificial sequence related to HLA knockouts in cell therapy
gccctgacccagacctgggcgg

SEQ ID NO: 21127 - DNA, 22 bp, Artificial Sequence
  Artificial sequence related to HLA knockouts in cell therapy
ccctgacccagacctgggcggg

SEQ ID NO: 21128 - DNA, 22 bp, Artificial Sequence
  Artificial sequence related to HLA knockouts in cell therapy
cctgacccagacctgggcgggc

SEQ ID NO: 21129 - DNA, 22 bp, Artificial Sequence
  Artificial sequence related to HLA knockouts in cell therapy
ctgacccagacctgggcgggct

SEQ ID NO: 21130 - DNA, 22 bp, Artificial Sequence
  Artificial sequence related to HLA knockouts in cell therapy
tgacccagacctgggcgggctc

SEQ ID NO: 21131 - DNA, 22 bp, Artificial Sequence
  Artificial sequence related to HLA knockouts in cell therapy
gacccagacctgggcgggctct

SEQ ID NO: 21132 - DNA, 22 bp, Artificial Sequence
  Artificial sequence related to HLA knockouts in cell therapy
acccagacctgggcgggctctc

SEQ ID NO: 21133 - DNA, 22 bp, Artificial Sequence
  Artificial sequence related to HLA knockouts in cell therapy
cccagacctgggcgggctctca

SEQ ID NO: 21134 - DNA, 22 bp, Artificial Sequence
  Artificial sequence related to HLA knockouts in cell therapy
ccagacctgggcgggctctcac

SEQ ID NO: 21135 - DNA, 22 bp, Artificial Sequence
  Artificial sequence related to HLA knockouts in cell therapy
cagacctgggcgggctctcact

SEQ ID NO: 21136 - DNA, 22 bp, Artificial Sequence
  Artificial sequence related to HLA knockouts in cell therapy
agacctgggcgggctctcactc

SEQ ID NO: 21137 - DNA, 22 bp, Artificial Sequence
  Artificial sequence related to HLA knockouts in cell therapy
gacctgggcgggctctcactcc

SEQ ID NO: 21138 - DNA, 22 bp, Artificial Sequence
  Artificial sequence related to HLA knockouts in cell therapy
acctgggcgggctctcactcca

SEQ ID NO: 21139 - DNA, 22 bp, Artificial Sequence
  Artificial sequence related to HLA knockouts in cell therapy
cctgggcgggctctcactccat

SEQ ID NO: 21140 - DNA, 22 bp, Artificial Sequence
  Artificial sequence related to HLA knockouts in cell therapy
ctgggcgggctctcactccatg

SEQ ID NO: 21141 - DNA, 22 bp, Artificial Sequence
  Artificial sequence related to HLA knockouts in cell therapy
tgggcgggctctcactccatga

SEQ ID NO: 21142 - DNA, 22 bp, Artificial Sequence
  Artificial sequence related to HLA knockouts in cell therapy
gggcgggctctcactccatgag

SEQ ID NO: 21143 - DNA, 22 bp, Artificial Sequence
  Artificial sequence related to HLA knockouts in cell therapy
ggcgggctctcactccatgagg

SEQ ID NO: 21144 - DNA, 22 bp, Artificial Sequence
  Artificial sequence related to HLA knockouts in cell therapy
gcgggctctcactccatgaggt

SEQ ID NO: 21145 - DNA, 22 bp, Artificial Sequence
  Artificial sequence related to HLA knockouts in cell therapy
tcttcacatccgtgtcccggcc

SEQ ID NO: 21146 - DNA, 22 bp, Artificial Sequence
  Artificial sequence related to HLA knockouts in cell therapy
cttcacatccgtgtcccggccc

SEQ ID NO: 21147 - DNA, 22 bp, Artificial Sequence
  Artificial sequence related to HLA knockouts in cell therapy
ttcacatccgtgtcccggcccg

SEQ ID NO: 21148 - DNA, 22 bp, Artificial Sequence
  Artificial sequence related to HLA knockouts in cell therapy
tcacatccgtgtcccggcccgg

SEQ ID NO: 21149 - DNA, 22 bp, Artificial Sequence
  Artificial sequence related to HLA knockouts in cell therapy
cacatccgtgtcccggcccggc

SEQ ID NO: 21150 - DNA, 22 bp, Artificial Sequence
  Artificial sequence related to HLA knockouts in cell therapy
acatccgtgtcccggcccggcc

SEQ ID NO: 21151 - DNA, 22 bp, Artificial Sequence
  Artificial sequence related to HLA knockouts in cell therapy
catccgtgtcccggcccggccg

SEQ ID NO: 21152 - DNA, 22 bp, Artificial Sequence
  Artificial sequence related to HLA knockouts in cell therapy
atccgtgtcccggcccggccgc

SEQ ID NO: 21153 - DNA, 22 bp, Artificial Sequence
  Artificial sequence related to HLA knockouts in cell therapy
tccgtgtcccggcccggccgcg

SEQ ID NO: 21154 - DNA, 22 bp, Artificial Sequence
  Artificial sequence related to HLA knockouts in cell therapy
ccgtgtcccggcccggccgcgg

SEQ ID NO: 21155 - DNA, 22 bp, Artificial Sequence
  Artificial sequence related to HLA knockouts in cell therapy
cgtgtcccggcccggccgcggg

SEQ ID NO: 21156 - DNA, 22 bp, Artificial Sequence
  Artificial sequence related to HLA knockouts in cell therapy
gtgtcccggcccggccgcgggg

SEQ ID NO: 21157 - DNA, 22 bp, Artificial Sequence
  Artificial sequence related to HLA knockouts in cell therapy
tgtcccggcccggccgcgggga

SEQ ID NO: 21158 - DNA, 22 bp, Artificial Sequence
  Artificial sequence related to HLA knockouts in cell therapy
gtcccggcccggccgcggggag

SEQ ID NO: 21159 - DNA, 22 bp, Artificial Sequence
  Artificial sequence related to HLA knockouts in cell therapy
tcccggcccggccgcggggagc

SEQ ID NO: 21160 - DNA, 22 bp, Artificial Sequence
  Artificial sequence related to HLA knockouts in cell therapy
cccggcccggccgcggggagcc

SEQ ID NO: 21161 - DNA, 22 bp, Artificial Sequence
  Artificial sequence related to HLA knockouts in cell therapy
ccggcccggccgcggggagccc

SEQ ID NO: 21162 - DNA, 22 bp, Artificial Sequence
  Artificial sequence related to HLA knockouts in cell therapy
cggcccggccgcggggagcccc

SEQ ID NO: 21163 - DNA, 22 bp, Artificial Sequence
  Artificial sequence related to HLA knockouts in cell therapy
ggcccggccgcggggagccccg

SEQ ID NO: 21164 - DNA, 22 bp, Artificial Sequence
  Artificial sequence related to HLA knockouts in cell therapy
gcccggccgcggggagccccgc

SEQ ID NO: 21165 - DNA, 22 bp, Artificial Sequence
  Artificial sequence related to HLA knockouts in cell therapy
cccggccgcggggagccccgct

SEQ ID NO: 21166 - DNA, 22 bp, Artificial Sequence
  Artificial sequence related to HLA knockouts in cell therapy
ccggccgcggggagccccgctt

SEQ ID NO: 21167 - DNA, 22 bp, Artificial Sequence
  Artificial sequence related to HLA knockouts in cell therapy
cggccgcggggagccccgcttc

SEQ ID NO: 21168 - DNA, 22 bp, Artificial Sequence
  Artificial sequence related to HLA knockouts in cell therapy
ggccgcggggagccccgcttca

SEQ ID NO: 21169 - DNA, 22 bp, Artificial Sequence
  Artificial sequence related to HLA knockouts in cell therapy
gccgcggggagccccgcttcat

SEQ ID NO: 21170 - DNA, 22 bp, Artificial Sequence
  Artificial sequence related to HLA knockouts in cell therapy
ccgcggggagccccgcttcatc

SEQ ID NO: 21171 - DNA, 22 bp, Artificial Sequence
  Artificial sequence related to HLA knockouts in cell therapy
cgcggggagccccgcttcatcg

SEQ ID NO: 21172 - DNA, 22 bp, Artificial Sequence
  Artificial sequence related to HLA knockouts in cell therapy
gcggggagccccgcttcatcgc

SEQ ID NO: 21173 - DNA, 22 bp, Artificial Sequence
  Artificial sequence related to HLA knockouts in cell therapy
cggggagccccgcttcatcgca

SEQ ID NO: 21174 - DNA, 22 bp, Artificial Sequence
  Artificial sequence related to HLA knockouts in cell therapy
ggggagccccgcttcatcgcag

SEQ ID NO: 21175 - DNA, 22 bp, Artificial Sequence
  Artificial sequence related to HLA knockouts in cell therapy
gggagccccgcttcatcgcagt

SEQ ID NO: 21176 - DNA, 22 bp, Artificial Sequence
  Artificial sequence related to HLA knockouts in cell therapy
ggagccccgcttcatcgcagtg

SEQ ID NO: 21177 - DNA, 22 bp, Artificial Sequence
  Artificial sequence related to HLA knockouts in cell therapy
gagccccgcttcatcgcagtgg

SEQ ID NO: 21178 - DNA, 22 bp, Artificial Sequence
  Artificial sequence related to HLA knockouts in cell therapy
agccccgcttcatcgcagtggg

SEQ ID NO: 21179 - DNA, 22 bp, Artificial Sequence
  Artificial sequence related to HLA knockouts in cell therapy
gccccgcttcatcgcagtgggc

SEQ ID NO: 21180 - DNA, 22 bp, Artificial Sequence
  Artificial sequence related to HLA knockouts in cell therapy
ccccgcttcatcgcagtgggct

SEQ ID NO: 21181 - DNA, 22 bp, Artificial Sequence
  Artificial sequence related to HLA knockouts in cell therapy
cccgcttcatcgcagtgggcta

SEQ ID NO: 21182 - DNA, 22 bp, Artificial Sequence
  Artificial sequence related to HLA knockouts in cell therapy
ccgcttcatcgcagtgggctac

SEQ ID NO: 21183 - DNA, 22 bp, Artificial Sequence
  Artificial sequence related to HLA knockouts in cell therapy
cgcttcatcgcagtgggctacg

SEQ ID NO: 21184 - DNA, 22 bp, Artificial Sequence
  Artificial sequence related to HLA knockouts in cell therapy
catcgcagtgggctacgtggac

SEQ ID NO: 21185 - DNA, 22 bp, Artificial Sequence
  Artificial sequence related to HLA knockouts in cell therapy
atcgcagtgggctacgtggacg

SEQ ID NO: 21186 - DNA, 22 bp, Artificial Sequence
  Artificial sequence related to HLA knockouts in cell therapy
tcgcagtgggctacgtggacga

SEQ ID NO: 21187 - DNA, 22 bp, Artificial Sequence
  Artificial sequence related to HLA knockouts in cell therapy
cgcagtgggctacgtggacgac

SEQ ID NO: 21188 - DNA, 22 bp, Artificial Sequence
  Artificial sequence related to HLA knockouts in cell therapy
gcagtgggctacgtggacgaca

SEQ ID NO: 21189 - DNA, 22 bp, Artificial Sequence
  Artificial sequence related to HLA knockouts in cell therapy
cagtgggctacgtggacgacac

SEQ ID NO: 21190 - DNA, 22 bp, Artificial Sequence
  Artificial sequence related to HLA knockouts in cell therapy
agtgggctacgtggacgacacg

SEQ ID NO: 21191 - DNA, 22 bp, Artificial Sequence
  Artificial sequence related to HLA knockouts in cell therapy
gtgggctacgtggacgacacgc

SEQ ID NO: 21192 - DNA, 22 bp, Artificial Sequence
  Artificial sequence related to HLA knockouts in cell therapy
tgggctacgtggacgacacgca

SEQ ID NO: 21193 - DNA, 22 bp, Artificial Sequence
  Artificial sequence related to HLA knockouts in cell therapy
gggctacgtggacgacacgcag

SEQ ID NO: 21194 - DNA, 22 bp, Artificial Sequence
  Artificial sequence related to HLA knockouts in cell therapy
ggctacgtggacgacacgcagt

SEQ ID NO: 21195 - DNA, 22 bp, Artificial Sequence
  Artificial sequence related to HLA knockouts in cell therapy
cgtggacgacacgcagttcgtg

SEQ ID NO: 21196 - DNA, 22 bp, Artificial Sequence
  Artificial sequence related to HLA knockouts in cell therapy
gtggacgacacgcagttcgtgc

SEQ ID NO: 21197 - DNA, 22 bp, Artificial Sequence
  Artificial sequence related to HLA knockouts in cell therapy
tggacgacacgcagttcgtgcg

SEQ ID NO: 21198 - DNA, 22 bp, Artificial Sequence
  Artificial sequence related to HLA knockouts in cell therapy
ggacgacacgcagttcgtgcgg

SEQ ID NO: 21199 - DNA, 22 bp, Artificial Sequence
  Artificial sequence related to HLA knockouts in cell therapy
gacgacacgcagttcgtgcggt

SEQ ID NO: 21200 - DNA, 22 bp, Artificial Sequence
  Artificial sequence related to HLA knockouts in cell therapy
cgacacgcagttcgtgcggttc

SEQ ID NO: 21201 - DNA, 22 bp, Artificial Sequence
  Artificial sequence related to HLA knockouts in cell therapy
gacacgcagttcgtgcggttcg

SEQ ID NO: 21202 - DNA, 22 bp, Artificial Sequence
  Artificial sequence related to HLA knockouts in cell therapy
cacgcagttcgtgcggttcgac

SEQ ID NO: 21203 - DNA, 22 bp, Artificial Sequence
  Artificial sequence related to HLA knockouts in cell therapy
cgcagttcgtgcggttcgacag

SEQ ID NO: 21204 - DNA, 22 bp, Artificial Sequence
  Artificial sequence related to HLA knockouts in cell therapy
gcagttcgtgcggttcgacagc

SEQ ID NO: 21205 - DNA, 22 bp, Artificial Sequence
  Artificial sequence related to HLA knockouts in cell therapy
cagttcgtgcggttcgacagcg

SEQ ID NO: 21206 - DNA, 22 bp, Artificial Sequence
  Artificial sequence related to HLA knockouts in cell therapy
gttcgtgcggttcgacagcgac

SEQ ID NO: 21207 - DNA, 22 bp, Artificial Sequence
  Artificial sequence related to HLA knockouts in cell therapy
ttcgtgcggttcgacagcgacg

SEQ ID NO: 21208 - DNA, 22 bp, Artificial Sequence
  Artificial sequence related to HLA knockouts in cell therapy
tcgtgcggttcgacagcgacgc

SEQ ID NO: 21209 - DNA, 22 bp, Artificial Sequence
  Artificial sequence related to HLA knockouts in cell therapy
cgtgcggttcgacagcgacgcc

SEQ ID NO: 21210 - DNA, 22 bp, Artificial Sequence
  Artificial sequence related to HLA knockouts in cell therapy
gtgcggttcgacagcgacgccg

SEQ ID NO: 21211 - DNA, 22 bp, Artificial Sequence
  Artificial sequence related to HLA knockouts in cell therapy
tgcggttcgacagcgacgccgc

SEQ ID NO: 21212 - DNA, 22 bp, Artificial Sequence
  Artificial sequence related to HLA knockouts in cell therapy
gcggttcgacagcgacgccgcg

SEQ ID NO: 21213 - DNA, 22 bp, Artificial Sequence
  Artificial sequence related to HLA knockouts in cell therapy
cggttcgacagcgacgccgcga

SEQ ID NO: 21214 - DNA, 22 bp, Artificial Sequence
  Artificial sequence related to HLA knockouts in cell therapy
ggttcgacagcgacgccgcgag

SEQ ID NO: 21215 - DNA, 22 bp, Artificial Sequence
  Artificial sequence related to HLA knockouts in cell therapy
gttcgacagcgacgccgcgagc

SEQ ID NO: 21216 - DNA, 22 bp, Artificial Sequence
  Artificial sequence related to HLA knockouts in cell therapy
ttcgacagcgacgccgcgagcc

SEQ ID NO: 21217 - DNA, 22 bp, Artificial Sequence
  Artificial sequence related to HLA knockouts in cell therapy
tcgacagcgacgccgcgagcca

SEQ ID NO: 21218 - DNA, 22 bp, Artificial Sequence
  Artificial sequence related to HLA knockouts in cell therapy
cgacagcgacgccgcgagccag

SEQ ID NO: 21219 - DNA, 22 bp, Artificial Sequence
  Artificial sequence related to HLA knockouts in cell therapy
gacagcgacgccgcgagccaga

SEQ ID NO: 21220 - DNA, 22 bp, Artificial Sequence
  Artificial sequence related to HLA knockouts in cell therapy
acagcgacgccgcgagccagag

SEQ ID NO: 21221 - DNA, 22 bp, Artificial Sequence
  Artificial sequence related to HLA knockouts in cell therapy
cagcgacgccgcgagccagagg

SEQ ID NO: 21222 - DNA, 22 bp, Artificial Sequence
  Artificial sequence related to HLA knockouts in cell therapy
agcgacgccgcgagccagagga

SEQ ID NO: 21223 - DNA, 22 bp, Artificial Sequence
  Artificial sequence related to HLA knockouts in cell therapy
gcgacgccgcgagccagaggat

SEQ ID NO: 21224 - DNA, 22 bp, Artificial Sequence
  Artificial sequence related to HLA knockouts in cell therapy
cgacgccgcgagccagaggatg

SEQ ID NO: 21225 - DNA, 22 bp, Artificial Sequence
  Artificial sequence related to HLA knockouts in cell therapy
gacgccgcgagccagaggatgg

SEQ ID NO: 21226 - DNA, 22 bp, Artificial Sequence
  Artificial sequence related to HLA knockouts in cell therapy
acgccgcgagccagaggatgga

SEQ ID NO: 21227 - DNA, 22 bp, Artificial Sequence
  Artificial sequence related to HLA knockouts in cell therapy
cgccgcgagccagaggatggag

SEQ ID NO: 21228 - DNA, 22 bp, Artificial Sequence
  Artificial sequence related to HLA knockouts in cell therapy
gccgcgagccagaggatggagc

SEQ ID NO: 21229 - DNA, 22 bp, Artificial Sequence
  Artificial sequence related to HLA knockouts in cell therapy
ccgcgagccagaggatggagcc

SEQ ID NO: 21230 - DNA, 22 bp, Artificial Sequence
  Artificial sequence related to HLA knockouts in cell therapy
cgcgagccagaggatggagccg

SEQ ID NO: 21231 - DNA, 22 bp, Artificial Sequence
  Artificial sequence related to HLA knockouts in cell therapy
gcgagccagaggatggagccgc

SEQ ID NO: 21232 - DNA, 22 bp, Artificial Sequence
  Artificial sequence related to HLA knockouts in cell therapy
cgagccagaggatggagccgcg

SEQ ID NO: 21233 - DNA, 22 bp, Artificial Sequence
  Artificial sequence related to HLA knockouts in cell therapy
gagccagaggatggagccgcgg

SEQ ID NO: 21234 - DNA, 22 bp, Artificial Sequence
  Artificial sequence related to HLA knockouts in cell therapy
agccagaggatggagccgcggg

SEQ ID NO: 21235 - DNA, 22 bp, Artificial Sequence
  Artificial sequence related to HLA knockouts in cell therapy
gccagaggatggagccgcgggc

SEQ ID NO: 21236 - DNA, 22 bp, Artificial Sequence
  Artificial sequence related to HLA knockouts in cell therapy
ccagaggatggagccgcgggcg

SEQ ID NO: 21237 - DNA, 22 bp, Artificial Sequence
  Artificial sequence related to HLA knockouts in cell therapy
cagaggatggagccgcgggcgc

SEQ ID NO: 21238 - DNA, 22 bp, Artificial Sequence
  Artificial sequence related to HLA knockouts in cell therapy
agaggatggagccgcgggcgcc

SEQ ID NO: 21239 - DNA, 22 bp, Artificial Sequence
  Artificial sequence related to HLA knockouts in cell therapy
gaggatggagccgcgggcgccg

SEQ ID NO: 21240 - DNA, 22 bp, Artificial Sequence
  Artificial sequence related to HLA knockouts in cell therapy
aggatggagccgcgggcgccgt

SEQ ID NO: 21241 - DNA, 22 bp, Artificial Sequence
  Artificial sequence related to HLA knockouts in cell therapy
ggatggagccgcgggcgccgtg

SEQ ID NO: 21242 - DNA, 22 bp, Artificial Sequence
  Artificial sequence related to HLA knockouts in cell therapy
gatggagccgcgggcgccgtgg

SEQ ID NO: 21243 - DNA, 22 bp, Artificial Sequence
  Artificial sequence related to HLA knockouts in cell therapy
atggagccgcgggcgccgtgga

SEQ ID NO: 21244 - DNA, 22 bp, Artificial Sequence
  Artificial sequence related to HLA knockouts in cell therapy
tggagccgcgggcgccgtggat

SEQ ID NO: 21245 - DNA, 22 bp, Artificial Sequence
  Artificial sequence related to HLA knockouts in cell therapy
ggagccgcgggcgccgtggata

SEQ ID NO: 21246 - DNA, 22 bp, Artificial Sequence
  Artificial sequence related to HLA knockouts in cell therapy
gagccgcgggcgccgtggatag

SEQ ID NO: 21247 - DNA, 22 bp, Artificial Sequence
  Artificial sequence related to HLA knockouts in cell therapy
agccgcgggcgccgtggataga

SEQ ID NO: 21248 - DNA, 22 bp, Artificial Sequence
  Artificial sequence related to HLA knockouts in cell therapy
gccgcgggcgccgtggatagag

SEQ ID NO: 21249 - DNA, 22 bp, Artificial Sequence
  Artificial sequence related to HLA knockouts in cell therapy
ccgcgggcgccgtggatagagc

SEQ ID NO: 21250 - DNA, 22 bp, Artificial Sequence
  Artificial sequence related to HLA knockouts in cell therapy
cgcgggcgccgtggatagagca

SEQ ID NO: 21251 - DNA, 22 bp, Artificial Sequence
  Artificial sequence related to HLA knockouts in cell therapy
gcgggcgccgtggatagagcag

SEQ ID NO: 21252 - DNA, 22 bp, Artificial Sequence
  Artificial sequence related to HLA knockouts in cell therapy
cgggcgccgtggatagagcagg

SEQ ID NO: 21253 - DNA, 22 bp, Artificial Sequence
  Artificial sequence related to HLA knockouts in cell therapy
gggcgccgtggatagagcagga

SEQ ID NO: 21254 - DNA, 22 bp, Artificial Sequence
  Artificial sequence related to HLA knockouts in cell therapy
ggcgccgtggatagagcaggag

SEQ ID NO: 21255 - DNA, 22 bp, Artificial Sequence
  Artificial sequence related to HLA knockouts in cell therapy
gcgccgtggatagagcaggagg

SEQ ID NO: 21256 - DNA, 22 bp, Artificial Sequence
  Artificial sequence related to HLA knockouts in cell therapy
cgccgtggatagagcaggaggg

SEQ ID NO: 21257 - DNA, 22 bp, Artificial Sequence
  Artificial sequence related to HLA knockouts in cell therapy
gccgtggatagagcaggagggt

SEQ ID NO: 21258 - DNA, 22 bp, Artificial Sequence
  Artificial sequence related to HLA knockouts in cell therapy
ccgtggatagagcaggagggtc

SEQ ID NO: 21259 - DNA, 22 bp, Artificial Sequence
  Artificial sequence related to HLA knockouts in cell therapy
cgtggatagagcaggagggtcc

SEQ ID NO: 21260 - DNA, 22 bp, Artificial Sequence
  Artificial sequence related to HLA knockouts in cell therapy
gtggatagagcaggagggtccg

SEQ ID NO: 21261 - DNA, 22 bp, Artificial Sequence
  Artificial sequence related to HLA knockouts in cell therapy
tggatagagcaggagggtccgg

SEQ ID NO: 21262 - DNA, 22 bp, Artificial Sequence
  Artificial sequence related to HLA knockouts in cell therapy
ggatagagcaggagggtccgga

SEQ ID NO: 21263 - DNA, 22 bp, Artificial Sequence
  Artificial sequence related to HLA knockouts in cell therapy
gatagagcaggagggtccggag

SEQ ID NO: 21264 - DNA, 22 bp, Artificial Sequence
  Artificial sequence related to HLA knockouts in cell therapy
gcaggagggtccggagtattgg

SEQ ID NO: 21265 - DNA, 22 bp, Artificial Sequence
  Artificial sequence related to HLA knockouts in cell therapy
caggagggtccggagtattggg

SEQ ID NO: 21266 - DNA, 22 bp, Artificial Sequence
  Artificial sequence related to HLA knockouts in cell therapy
ggagggtccggagtattgggac

SEQ ID NO: 21267 - DNA, 22 bp, Artificial Sequence
  Artificial sequence related to HLA knockouts in cell therapy
gagggtccggagtattgggacg

SEQ ID NO: 21268 - DNA, 22 bp, Artificial Sequence
  Artificial sequence related to HLA knockouts in cell therapy
agggtccggagtattgggacgg

SEQ ID NO: 21269 - DNA, 22 bp, Artificial Sequence
  Artificial sequence related to HLA knockouts in cell therapy
gggtccggagtattgggacggg

SEQ ID NO: 21270 - DNA, 22 bp, Artificial Sequence
  Artificial sequence related to HLA knockouts in cell therapy
ggtccggagtattgggacgggg

SEQ ID NO: 21271 - DNA, 22 bp, Artificial Sequence
  Artificial sequence related to HLA knockouts in cell therapy
gtccggagtattgggacgggga

SEQ ID NO: 21272 - DNA, 22 bp, Artificial Sequence
  Artificial sequence related to HLA knockouts in cell therapy
tccggagtattgggacggggag

SEQ ID NO: 21273 - DNA, 22 bp, Artificial Sequence
  Artificial sequence related to HLA knockouts in cell therapy
ccggagtattgggacggggaga

SEQ ID NO: 21274 - DNA, 22 bp, Artificial Sequence
  Artificial sequence related to HLA knockouts in cell therapy
cggagtattgggacggggagac

SEQ ID NO: 21275 - DNA, 22 bp, Artificial Sequence
  Artificial sequence related to HLA knockouts in cell therapy
gtattgggacggggagacacgg

SEQ ID NO: 21276 - DNA, 22 bp, Artificial Sequence
  Artificial sequence related to HLA knockouts in cell therapy
tgggacggggagacacggaaag

SEQ ID NO: 21277 - DNA, 22 bp, Artificial Sequence
  Artificial sequence related to HLA knockouts in cell therapy
gggacggggagacacggaaagt

SEQ ID NO: 21278 - DNA, 22 bp, Artificial Sequence
  Artificial sequence related to HLA knockouts in cell therapy
ggacggggagacacggaaagtg

SEQ ID NO: 21279 - DNA, 22 bp, Artificial Sequence
  Artificial sequence related to HLA knockouts in cell therapy
aggcccactcacagactcaccg

SEQ ID NO: 21280 - DNA, 22 bp, Artificial Sequence
  Artificial sequence related to HLA knockouts in cell therapy
ggcccactcacagactcaccga

SEQ ID NO: 21281 - DNA, 22 bp, Artificial Sequence
  Artificial sequence related to HLA knockouts in cell therapy
gcccactcacagactcaccgag

SEQ ID NO: 21282 - DNA, 22 bp, Artificial Sequence
  Artificial sequence related to HLA knockouts in cell therapy
cagactcaccgagtggacctgg

SEQ ID NO: 21283 - DNA, 22 bp, Artificial Sequence
  Artificial sequence related to HLA knockouts in cell therapy
agactcaccgagtggacctggg

SEQ ID NO: 21284 - DNA, 22 bp, Artificial Sequence
  Artificial sequence related to HLA knockouts in cell therapy
gactcaccgagtggacctgggg

SEQ ID NO: 21285 - DNA, 22 bp, Artificial Sequence
  Artificial sequence related to HLA knockouts in cell therapy
actcaccgagtggacctgggga

SEQ ID NO: 21286 - DNA, 22 bp, Artificial Sequence
  Artificial sequence related to HLA knockouts in cell therapy
ctcaccgagtggacctggggac

SEQ ID NO: 21287 - DNA, 22 bp, Artificial Sequence
  Artificial sequence related to HLA knockouts in cell therapy
tcaccgagtggacctggggacc

SEQ ID NO: 21288 - DNA, 22 bp, Artificial Sequence
  Artificial sequence related to HLA knockouts in cell therapy
caccgagtggacctggggaccc

SEQ ID NO: 21289 - DNA, 22 bp, Artificial Sequence
  Artificial sequence related to HLA knockouts in cell therapy
accgagtggacctggggaccct

SEQ ID NO: 21290 - DNA, 22 bp, Artificial Sequence
  Artificial sequence related to HLA knockouts in cell therapy
ccgagtggacctggggaccctg

SEQ ID NO: 21291 - DNA, 22 bp, Artificial Sequence
  Artificial sequence related to HLA knockouts in cell therapy
cgagtggacctggggaccctgc

SEQ ID NO: 21292 - DNA, 22 bp, Artificial Sequence
  Artificial sequence related to HLA knockouts in cell therapy
gagtggacctggggaccctgcg

SEQ ID NO: 21293 - DNA, 22 bp, Artificial Sequence
  Artificial sequence related to HLA knockouts in cell therapy
agtggacctggggaccctgcgc

SEQ ID NO: 21294 - DNA, 22 bp, Artificial Sequence
  Artificial sequence related to HLA knockouts in cell therapy
gtggacctggggaccctgcgcg

SEQ ID NO: 21295 - DNA, 22 bp, Artificial Sequence
  Artificial sequence related to HLA knockouts in cell therapy
tggacctggggaccctgcgcgg

SEQ ID NO: 21296 - DNA, 22 bp, Artificial Sequence
  Artificial sequence related to HLA knockouts in cell therapy
ggacctggggaccctgcgcggc

SEQ ID NO: 21297 - DNA, 22 bp, Artificial Sequence
  Artificial sequence related to HLA knockouts in cell therapy
gacctggggaccctgcgcggct

SEQ ID NO: 21298 - DNA, 22 bp, Artificial Sequence
  Artificial sequence related to HLA knockouts in cell therapy
acctggggaccctgcgcggcta

SEQ ID NO: 21299 - DNA, 22 bp, Artificial Sequence
  Artificial sequence related to HLA knockouts in cell therapy
cctggggaccctgcgcggctac

SEQ ID NO: 21300 - DNA, 22 bp, Artificial Sequence
  Artificial sequence related to HLA knockouts in cell therapy
ctggggaccctgcgcggctact

SEQ ID NO: 21301 - DNA, 22 bp, Artificial Sequence
  Artificial sequence related to HLA knockouts in cell therapy
tggggaccctgcgcggctacta

SEQ ID NO: 21302 - DNA, 22 bp, Artificial Sequence
  Artificial sequence related to HLA knockouts in cell therapy
ggggaccctgcgcggctactac

SEQ ID NO: 21303 - DNA, 22 bp, Artificial Sequence
  Artificial sequence related to HLA knockouts in cell therapy
gggaccctgcgcggctactaca

SEQ ID NO: 21304 - DNA, 22 bp, Artificial Sequence
  Artificial sequence related to HLA knockouts in cell therapy
ggaccctgcgcggctactacaa

SEQ ID NO: 21305 - DNA, 22 bp, Artificial Sequence
  Artificial sequence related to HLA knockouts in cell therapy
gaccctgcgcggctactacaac

SEQ ID NO: 21306 - DNA, 22 bp, Artificial Sequence
  Artificial sequence related to HLA knockouts in cell therapy
accctgcgcggctactacaacc

SEQ ID NO: 21307 - DNA, 22 bp, Artificial Sequence
  Artificial sequence related to HLA knockouts in cell therapy
ccctgcgcggctactacaacca

SEQ ID NO: 21308 - DNA, 22 bp, Artificial Sequence
  Artificial sequence related to HLA knockouts in cell therapy
cctgcgcggctactacaaccag

SEQ ID NO: 21309 - DNA, 22 bp, Artificial Sequence
  Artificial sequence related to HLA knockouts in cell therapy
gcgcggctactacaaccagagc

SEQ ID NO: 21310 - DNA, 22 bp, Artificial Sequence
  Artificial sequence related to HLA knockouts in cell therapy
cgcggctactacaaccagagcg

SEQ ID NO: 21311 - DNA, 22 bp, Artificial Sequence
  Artificial sequence related to HLA knockouts in cell therapy
actacaaccagagcgaggccgg

SEQ ID NO: 21312 - DNA, 22 bp, Artificial Sequence
  Artificial sequence related to HLA knockouts in cell therapy
ctacaaccagagcgaggccggt

SEQ ID NO: 21313 - DNA, 22 bp, Artificial Sequence
  Artificial sequence related to HLA knockouts in cell therapy
acaaccagagcgaggccggttc

SEQ ID NO: 21314 - DNA, 22 bp, Artificial Sequence
  Artificial sequence related to HLA knockouts in cell therapy
caaccagagcgaggccggttct

SEQ ID NO: 21315 - DNA, 22 bp, Artificial Sequence
  Artificial sequence related to HLA knockouts in cell therapy
aaccagagcgaggccggttctc

SEQ ID NO: 21316 - DNA, 22 bp, Artificial Sequence
  Artificial sequence related to HLA knockouts in cell therapy
accagagcgaggccggttctca

SEQ ID NO: 21317 - DNA, 22 bp, Artificial Sequence
  Artificial sequence related to HLA knockouts in cell therapy
ccagagcgaggccggttctcac

SEQ ID NO: 21318 - DNA, 22 bp, Artificial Sequence
  Artificial sequence related to HLA knockouts in cell therapy
cagagcgaggccggttctcaca

SEQ ID NO: 21319 - DNA, 22 bp, Artificial Sequence
  Artificial sequence related to HLA knockouts in cell therapy
agagcgaggccggttctcacac

SEQ ID NO: 21320 - DNA, 22 bp, Artificial Sequence
  Artificial sequence related to HLA knockouts in cell therapy
gagcgaggccggttctcacacc

SEQ ID NO: 21321 - DNA, 22 bp, Artificial Sequence
  Artificial sequence related to HLA knockouts in cell therapy
agcgaggccggttctcacaccg

SEQ ID NO: 21322 - DNA, 22 bp, Artificial Sequence
  Artificial sequence related to HLA knockouts in cell therapy
gcgaggccggttctcacaccgt

SEQ ID NO: 21323 - DNA, 22 bp, Artificial Sequence
  Artificial sequence related to HLA knockouts in cell therapy
cgaggccggttctcacaccgtc

SEQ ID NO: 21324 - DNA, 22 bp, Artificial Sequence
  Artificial sequence related to HLA knockouts in cell therapy
gaggccggttctcacaccgtcc

SEQ ID NO: 21325 - DNA, 22 bp, Artificial Sequence
  Artificial sequence related to HLA knockouts in cell therapy
aggccggttctcacaccgtcca

SEQ ID NO: 21326 - DNA, 22 bp, Artificial Sequence
  Artificial sequence related to HLA knockouts in cell therapy
ggccggttctcacaccgtccag

SEQ ID NO: 21327 - DNA, 22 bp, Artificial Sequence
  Artificial sequence related to HLA knockouts in cell therapy
gccggttctcacaccgtccaga

SEQ ID NO: 21328 - DNA, 22 bp, Artificial Sequence
  Artificial sequence related to HLA knockouts in cell therapy
ccggttctcacaccgtccagag

SEQ ID NO: 21329 - DNA, 22 bp, Artificial Sequence
  Artificial sequence related to HLA knockouts in cell therapy
cggttctcacaccgtccagagg

SEQ ID NO: 21330 - DNA, 22 bp, Artificial Sequence
  Artificial sequence related to HLA knockouts in cell therapy
ggatgtatggctgcgacgtggg

SEQ ID NO: 21331 - DNA, 22 bp, Artificial Sequence
  Artificial sequence related to HLA knockouts in cell therapy
gatgtatggctgcgacgtgggg

SEQ ID NO: 21332 - DNA, 22 bp, Artificial Sequence
  Artificial sequence related to HLA knockouts in cell therapy
tgtatggctgcgacgtggggtc

SEQ ID NO: 21333 - DNA, 22 bp, Artificial Sequence
  Artificial sequence related to HLA knockouts in cell therapy
gtatggctgcgacgtggggtcg

SEQ ID NO: 21334 - DNA, 22 bp, Artificial Sequence
  Artificial sequence related to HLA knockouts in cell therapy
tatggctgcgacgtggggtcgg

SEQ ID NO: 21335 - DNA, 22 bp, Artificial Sequence
  Artificial sequence related to HLA knockouts in cell therapy
atggctgcgacgtggggtcgga

SEQ ID NO: 21336 - DNA, 22 bp, Artificial Sequence
  Artificial sequence related to HLA knockouts in cell therapy
tggctgcgacgtggggtcggac

SEQ ID NO: 21337 - DNA, 22 bp, Artificial Sequence
  Artificial sequence related to HLA knockouts in cell therapy
ggctgcgacgtggggtcggact

SEQ ID NO: 21338 - DNA, 22 bp, Artificial Sequence
  Artificial sequence related to HLA knockouts in cell therapy
gctgcgacgtggggtcggactg

SEQ ID NO: 21339 - DNA, 22 bp, Artificial Sequence
  Artificial sequence related to HLA knockouts in cell therapy
ctgcgacgtggggtcggactgg

SEQ ID NO: 21340 - DNA, 22 bp, Artificial Sequence
  Artificial sequence related to HLA knockouts in cell therapy
tgcgacgtggggtcggactggc

SEQ ID NO: 21341 - DNA, 22 bp, Artificial Sequence
  Artificial sequence related to HLA knockouts in cell therapy
gcgacgtggggtcggactggcg

SEQ ID NO: 21342 - DNA, 22 bp, Artificial Sequence
  Artificial sequence related to HLA knockouts in cell therapy
cgacgtggggtcggactggcgc

SEQ ID NO: 21343 - DNA, 22 bp, Artificial Sequence
  Artificial sequence related to HLA knockouts in cell therapy
gacgtggggtcggactggcgct

SEQ ID NO: 21344 - DNA, 22 bp, Artificial Sequence
  Artificial sequence related to HLA knockouts in cell therapy
acgtggggtcggactggcgctt

SEQ ID NO: 21345 - DNA, 22 bp, Artificial Sequence
  Artificial sequence related to HLA knockouts in cell therapy
cgtggggtcggactggcgcttc

SEQ ID NO: 21346 - DNA, 22 bp, Artificial Sequence
  Artificial sequence related to HLA knockouts in cell therapy
gtggggtcggactggcgcttcc

SEQ ID NO: 21347 - DNA, 22 bp, Artificial Sequence
  Artificial sequence related to HLA knockouts in cell therapy
tggggtcggactggcgcttcct

SEQ ID NO: 21348 - DNA, 22 bp, Artificial Sequence
  Artificial sequence related to HLA knockouts in cell therapy
ggggtcggactggcgcttcctc

SEQ ID NO: 21349 - DNA, 22 bp, Artificial Sequence
  Artificial sequence related to HLA knockouts in cell therapy
gggtcggactggcgcttcctcc

SEQ ID NO: 21350 - DNA, 22 bp, Artificial Sequence
  Artificial sequence related to HLA knockouts in cell therapy
ggtcggactggcgcttcctccg

SEQ ID NO: 21351 - DNA, 22 bp, Artificial Sequence
  Artificial sequence related to HLA knockouts in cell therapy
gtcggactggcgcttcctccgc

SEQ ID NO: 21352 - DNA, 22 bp, Artificial Sequence
  Artificial sequence related to HLA knockouts in cell therapy
tcggactggcgcttcctccgcg

SEQ ID NO: 21353 - DNA, 22 bp, Artificial Sequence
  Artificial sequence related to HLA knockouts in cell therapy
cggactggcgcttcctccgcgg

SEQ ID NO: 21354 - DNA, 22 bp, Artificial Sequence
  Artificial sequence related to HLA knockouts in cell therapy
ggactggcgcttcctccgcggg

SEQ ID NO: 21355 - DNA, 22 bp, Artificial Sequence
  Artificial sequence related to HLA knockouts in cell therapy
gactggcgcttcctccgcgggt

SEQ ID NO: 21356 - DNA, 22 bp, Artificial Sequence
  Artificial sequence related to HLA knockouts in cell therapy
actggcgcttcctccgcgggta

SEQ ID NO: 21357 - DNA, 22 bp, Artificial Sequence
  Artificial sequence related to HLA knockouts in cell therapy
ctggcgcttcctccgcgggtac

SEQ ID NO: 21358 - DNA, 22 bp, Artificial Sequence
  Artificial sequence related to HLA knockouts in cell therapy
tggcgcttcctccgcgggtacc

SEQ ID NO: 21359 - DNA, 22 bp, Artificial Sequence
  Artificial sequence related to HLA knockouts in cell therapy
ggcgcttcctccgcgggtacca

SEQ ID NO: 21360 - DNA, 22 bp, Artificial Sequence
  Artificial sequence related to HLA knockouts in cell therapy
gcgcttcctccgcgggtaccac

SEQ ID NO: 21361 - DNA, 22 bp, Artificial Sequence
  Artificial sequence related to HLA knockouts in cell therapy
cgcttcctccgcgggtaccacc

SEQ ID NO: 21362 - DNA, 22 bp, Artificial Sequence
  Artificial sequence related to HLA knockouts in cell therapy
gcttcctccgcgggtaccacca

SEQ ID NO: 21363 - DNA, 22 bp, Artificial Sequence
  Artificial sequence related to HLA knockouts in cell therapy
cttcctccgcgggtaccaccag

SEQ ID NO: 21364 - DNA, 22 bp, Artificial Sequence
  Artificial sequence related to HLA knockouts in cell therapy
ttcctccgcgggtaccaccagt

SEQ ID NO: 21365 - DNA, 22 bp, Artificial Sequence
  Artificial sequence related to HLA knockouts in cell therapy
tcctccgcgggtaccaccagta

SEQ ID NO: 21366 - DNA, 22 bp, Artificial Sequence
  Artificial sequence related to HLA knockouts in cell therapy
cctccgcgggtaccaccagtac

SEQ ID NO: 21367 - DNA, 22 bp, Artificial Sequence
  Artificial sequence related to HLA knockouts in cell therapy
ctccgcgggtaccaccagtacg

SEQ ID NO: 21368 - DNA, 22 bp, Artificial Sequence
  Artificial sequence related to HLA knockouts in cell therapy
tccgcgggtaccaccagtacgc

SEQ ID NO: 21369 - DNA, 22 bp, Artificial Sequence
  Artificial sequence related to HLA knockouts in cell therapy
ccgcgggtaccaccagtacgcc

SEQ ID NO: 21370 - DNA, 22 bp, Artificial Sequence
  Artificial sequence related to HLA knockouts in cell therapy
cgcgggtaccaccagtacgcct

SEQ ID NO: 21371 - DNA, 22 bp, Artificial Sequence
  Artificial sequence related to HLA knockouts in cell therapy
gcgggtaccaccagtacgccta

SEQ ID NO: 21372 - DNA, 22 bp, Artificial Sequence
  Artificial sequence related to HLA knockouts in cell therapy
cgggtaccaccagtacgcctac

SEQ ID NO: 21373 - DNA, 22 bp, Artificial Sequence
  Artificial sequence related to HLA knockouts in cell therapy
gggtaccaccagtacgcctacg

SEQ ID NO: 21374 - DNA, 22 bp, Artificial Sequence
  Artificial sequence related to HLA knockouts in cell therapy
accaccagtacgcctacgacgg

SEQ ID NO: 21375 - DNA, 22 bp, Artificial Sequence
  Artificial sequence related to HLA knockouts in cell therapy
ccaccagtacgcctacgacggc

SEQ ID NO: 21376 - DNA, 22 bp, Artificial Sequence
  Artificial sequence related to HLA knockouts in cell therapy
caccagtacgcctacgacggca

SEQ ID NO: 21377 - DNA, 22 bp, Artificial Sequence
  Artificial sequence related to HLA knockouts in cell therapy
ccagtacgcctacgacggcaag

SEQ ID NO: 21378 - DNA, 22 bp, Artificial Sequence
  Artificial sequence related to HLA knockouts in cell therapy
cagtacgcctacgacggcaagg

SEQ ID NO: 21379 - DNA, 22 bp, Artificial Sequence
  Artificial sequence related to HLA knockouts in cell therapy
tcgccctgaaagaggacctgcg

SEQ ID NO: 21380 - DNA, 22 bp, Artificial Sequence
  Artificial sequence related to HLA knockouts in cell therapy
cgccctgaaagaggacctgcgc

SEQ ID NO: 21381 - DNA, 22 bp, Artificial Sequence
  Artificial sequence related to HLA knockouts in cell therapy
gccctgaaagaggacctgcgct

SEQ ID NO: 21382 - DNA, 22 bp, Artificial Sequence
  Artificial sequence related to HLA knockouts in cell therapy
ccctgaaagaggacctgcgctc

SEQ ID NO: 21383 - DNA, 22 bp, Artificial Sequence
  Artificial sequence related to HLA knockouts in cell therapy
agaggacctgcgctcttggacc

SEQ ID NO: 21384 - DNA, 22 bp, Artificial Sequence
  Artificial sequence related to HLA knockouts in cell therapy
gaggacctgcgctcttggaccg

SEQ ID NO: 21385 - DNA, 22 bp, Artificial Sequence
  Artificial sequence related to HLA knockouts in cell therapy
aggacctgcgctcttggaccgc

SEQ ID NO: 21386 - DNA, 22 bp, Artificial Sequence
  Artificial sequence related to HLA knockouts in cell therapy
ggacctgcgctcttggaccgcg

SEQ ID NO: 21387 - DNA, 22 bp, Artificial Sequence
  Artificial sequence related to HLA knockouts in cell therapy
gacctgcgctcttggaccgcgg

SEQ ID NO: 21388 - DNA, 22 bp, Artificial Sequence
  Artificial sequence related to HLA knockouts in cell therapy
acctgcgctcttggaccgcggc

SEQ ID NO: 21389 - DNA, 22 bp, Artificial Sequence
  Artificial sequence related to HLA knockouts in cell therapy
cctgcgctcttggaccgcggcg

SEQ ID NO: 21390 - DNA, 22 bp, Artificial Sequence
  Artificial sequence related to HLA knockouts in cell therapy
ctgcgctcttggaccgcggcgg

SEQ ID NO: 21391 - DNA, 22 bp, Artificial Sequence
  Artificial sequence related to HLA knockouts in cell therapy
tgcgctcttggaccgcggcgga

SEQ ID NO: 21392 - DNA, 22 bp, Artificial Sequence
  Artificial sequence related to HLA knockouts in cell therapy
gcgctcttggaccgcggcggac

SEQ ID NO: 21393 - DNA, 22 bp, Artificial Sequence
  Artificial sequence related to HLA knockouts in cell therapy
cgctcttggaccgcggcggaca

SEQ ID NO: 21394 - DNA, 22 bp, Artificial Sequence
  Artificial sequence related to HLA knockouts in cell therapy
gctcttggaccgcggcggacat

SEQ ID NO: 21395 - DNA, 22 bp, Artificial Sequence
  Artificial sequence related to HLA knockouts in cell therapy
ctcttggaccgcggcggacatg

SEQ ID NO: 21396 - DNA, 22 bp, Artificial Sequence
  Artificial sequence related to HLA knockouts in cell therapy
tcttggaccgcggcggacatgg

SEQ ID NO: 21397 - DNA, 22 bp, Artificial Sequence
  Artificial sequence related to HLA knockouts in cell therapy
cttggaccgcggcggacatggc

SEQ ID NO: 21398 - DNA, 22 bp, Artificial Sequence
  Artificial sequence related to HLA knockouts in cell therapy
ttggaccgcggcggacatggca

SEQ ID NO: 21399 - DNA, 22 bp, Artificial Sequence
  Artificial sequence related to HLA knockouts in cell therapy
tggaccgcggcggacatggcag

SEQ ID NO: 21400 - DNA, 22 bp, Artificial Sequence
  Artificial sequence related to HLA knockouts in cell therapy
ggaccgcggcggacatggcagc

SEQ ID NO: 21401 - DNA, 22 bp, Artificial Sequence
  Artificial sequence related to HLA knockouts in cell therapy
gaccgcggcggacatggcagct

SEQ ID NO: 21402 - DNA, 22 bp, Artificial Sequence
  Artificial sequence related to HLA knockouts in cell therapy
accgcggcggacatggcagctc

SEQ ID NO: 21403 - DNA, 22 bp, Artificial Sequence
  Artificial sequence related to HLA knockouts in cell therapy
ccgcggcggacatggcagctca

SEQ ID NO: 21404 - DNA, 22 bp, Artificial Sequence
  Artificial sequence related to HLA knockouts in cell therapy
cgcggcggacatggcagctcag

SEQ ID NO: 21405 - DNA, 22 bp, Artificial Sequence
  Artificial sequence related to HLA knockouts in cell therapy
gcggcggacatggcagctcaga

SEQ ID NO: 21406 - DNA, 22 bp, Artificial Sequence
  Artificial sequence related to HLA knockouts in cell therapy
cggcggacatggcagctcagac

SEQ ID NO: 21407 - DNA, 22 bp, Artificial Sequence
  Artificial sequence related to HLA knockouts in cell therapy
ggcggacatggcagctcagacc

SEQ ID NO: 21408 - DNA, 22 bp, Artificial Sequence
  Artificial sequence related to HLA knockouts in cell therapy
gcggacatggcagctcagacca

SEQ ID NO: 21409 - DNA, 22 bp, Artificial Sequence
  Artificial sequence related to HLA knockouts in cell therapy
cggacatggcagctcagaccac

SEQ ID NO: 21410 - DNA, 22 bp, Artificial Sequence
  Artificial sequence related to HLA knockouts in cell therapy
ggacatggcagctcagaccacc

SEQ ID NO: 21411 - DNA, 22 bp, Artificial Sequence
  Artificial sequence related to HLA knockouts in cell therapy
ggcagctcagaccaccaagcac

SEQ ID NO: 21412 - DNA, 22 bp, Artificial Sequence
  Artificial sequence related to HLA knockouts in cell therapy
ccaccaagcacaagtgggaggc

SEQ ID NO: 21413 - DNA, 22 bp, Artificial Sequence
  Artificial sequence related to HLA knockouts in cell therapy
caccaagcacaagtgggaggcg

SEQ ID NO: 21414 - DNA, 22 bp, Artificial Sequence
  Artificial sequence related to HLA knockouts in cell therapy
accaagcacaagtgggaggcgg

SEQ ID NO: 21415 - DNA, 22 bp, Artificial Sequence
  Artificial sequence related to HLA knockouts in cell therapy
ccaagcacaagtgggaggcggc

SEQ ID NO: 21416 - DNA, 22 bp, Artificial Sequence
  Artificial sequence related to HLA knockouts in cell therapy
caagcacaagtgggaggcggcc

SEQ ID NO: 21417 - DNA, 22 bp, Artificial Sequence
  Artificial sequence related to HLA knockouts in cell therapy
aagcacaagtgggaggcggccc

SEQ ID NO: 21418 - DNA, 22 bp, Artificial Sequence
  Artificial sequence related to HLA knockouts in cell therapy
agcacaagtgggaggcggccca

SEQ ID NO: 21419 - DNA, 22 bp, Artificial Sequence
  Artificial sequence related to HLA knockouts in cell therapy
gcacaagtgggaggcggcccat

SEQ ID NO: 21420 - DNA, 22 bp, Artificial Sequence
  Artificial sequence related to HLA knockouts in cell therapy
cacaagtgggaggcggcccatg

SEQ ID NO: 21421 - DNA, 22 bp, Artificial Sequence
  Artificial sequence related to HLA knockouts in cell therapy
acaagtgggaggcggcccatgt

SEQ ID NO: 21422 - DNA, 22 bp, Artificial Sequence
  Artificial sequence related to HLA knockouts in cell therapy
caagtgggaggcggcccatgtg

SEQ ID NO: 21423 - DNA, 22 bp, Artificial Sequence
  Artificial sequence related to HLA knockouts in cell therapy
aagtgggaggcggcccatgtgg

SEQ ID NO: 21424 - DNA, 22 bp, Artificial Sequence
  Artificial sequence related to HLA knockouts in cell therapy
agtgggaggcggcccatgtggc

SEQ ID NO: 21425 - DNA, 22 bp, Artificial Sequence
  Artificial sequence related to HLA knockouts in cell therapy
gtgggaggcggcccatgtggcg

SEQ ID NO: 21426 - DNA, 22 bp, Artificial Sequence
  Artificial sequence related to HLA knockouts in cell therapy
tgggaggcggcccatgtggcgg

SEQ ID NO: 21427 - DNA, 22 bp, Artificial Sequence
  Artificial sequence related to HLA knockouts in cell therapy
gggaggcggcccatgtggcgga

SEQ ID NO: 21428 - DNA, 22 bp, Artificial Sequence
  Artificial sequence related to HLA knockouts in cell therapy
ggaggcggcccatgtggcggag

SEQ ID NO: 21429 - DNA, 22 bp, Artificial Sequence
  Artificial sequence related to HLA knockouts in cell therapy
gaggcggcccatgtggcggagc

SEQ ID NO: 21430 - DNA, 22 bp, Artificial Sequence
  Artificial sequence related to HLA knockouts in cell therapy
aggcggcccatgtggcggagca

SEQ ID NO: 21431 - DNA, 22 bp, Artificial Sequence
  Artificial sequence related to HLA knockouts in cell therapy
ggcggcccatgtggcggagcag

SEQ ID NO: 21432 - DNA, 22 bp, Artificial Sequence
  Artificial sequence related to HLA knockouts in cell therapy
gcggcccatgtggcggagcagt

SEQ ID NO: 21433 - DNA, 22 bp, Artificial Sequence
  Artificial sequence related to HLA knockouts in cell therapy
cggcccatgtggcggagcagtt

SEQ ID NO: 21434 - DNA, 22 bp, Artificial Sequence
  Artificial sequence related to HLA knockouts in cell therapy
ggcccatgtggcggagcagttg

SEQ ID NO: 21435 - DNA, 22 bp, Artificial Sequence
  Artificial sequence related to HLA knockouts in cell therapy
gcccatgtggcggagcagttga

SEQ ID NO: 21436 - DNA, 22 bp, Artificial Sequence
  Artificial sequence related to HLA knockouts in cell therapy
cccatgtggcggagcagttgag

SEQ ID NO: 21437 - DNA, 22 bp, Artificial Sequence
  Artificial sequence related to HLA knockouts in cell therapy
tgtggcggagcagttgagagcc

SEQ ID NO: 21438 - DNA, 22 bp, Artificial Sequence
  Artificial sequence related to HLA knockouts in cell therapy
gtggcggagcagttgagagcct

SEQ ID NO: 21439 - DNA, 22 bp, Artificial Sequence
  Artificial sequence related to HLA knockouts in cell therapy
ggcggagcagttgagagcctac

SEQ ID NO: 21440 - DNA, 22 bp, Artificial Sequence
  Artificial sequence related to HLA knockouts in cell therapy
gcggagcagttgagagcctacc

SEQ ID NO: 21441 - DNA, 22 bp, Artificial Sequence
  Artificial sequence related to HLA knockouts in cell therapy
gttgagagcctacctggagggc

SEQ ID NO: 21442 - DNA, 22 bp, Artificial Sequence
  Artificial sequence related to HLA knockouts in cell therapy
tgagagcctacctggagggcac

SEQ ID NO: 21443 - DNA, 22 bp, Artificial Sequence
  Artificial sequence related to HLA knockouts in cell therapy
gagagcctacctggagggcacg

SEQ ID NO: 21444 - DNA, 22 bp, Artificial Sequence
  Artificial sequence related to HLA knockouts in cell therapy
agagcctacctggagggcacgt

SEQ ID NO: 21445 - DNA, 22 bp, Artificial Sequence
  Artificial sequence related to HLA knockouts in cell therapy
gagcctacctggagggcacgtg

SEQ ID NO: 21446 - DNA, 22 bp, Artificial Sequence
  Artificial sequence related to HLA knockouts in cell therapy
agcctacctggagggcacgtgc

SEQ ID NO: 21447 - DNA, 22 bp, Artificial Sequence
  Artificial sequence related to HLA knockouts in cell therapy
gcctacctggagggcacgtgcg

SEQ ID NO: 21448 - DNA, 22 bp, Artificial Sequence
  Artificial sequence related to HLA knockouts in cell therapy
cctacctggagggcacgtgcgt

SEQ ID NO: 21449 - DNA, 22 bp, Artificial Sequence
  Artificial sequence related to HLA knockouts in cell therapy
ctacctggagggcacgtgcgtg

SEQ ID NO: 21450 - DNA, 22 bp, Artificial Sequence
  Artificial sequence related to HLA knockouts in cell therapy
tacctggagggcacgtgcgtgg

SEQ ID NO: 21451 - DNA, 22 bp, Artificial Sequence
  Artificial sequence related to HLA knockouts in cell therapy
acctggagggcacgtgcgtgga

SEQ ID NO: 21452 - DNA, 22 bp, Artificial Sequence
  Artificial sequence related to HLA knockouts in cell therapy
cctggagggcacgtgcgtggag

SEQ ID NO: 21453 - DNA, 22 bp, Artificial Sequence
  Artificial sequence related to HLA knockouts in cell therapy
ctggagggcacgtgcgtggagt

SEQ ID NO: 21454 - DNA, 22 bp, Artificial Sequence
  Artificial sequence related to HLA knockouts in cell therapy
tggagggcacgtgcgtggagtg

SEQ ID NO: 21455 - DNA, 22 bp, Artificial Sequence
  Artificial sequence related to HLA knockouts in cell therapy
ggagggcacgtgcgtggagtgg

SEQ ID NO: 21456 - DNA, 22 bp, Artificial Sequence
  Artificial sequence related to HLA knockouts in cell therapy
gagggcacgtgcgtggagtggc

SEQ ID NO: 21457 - DNA, 22 bp, Artificial Sequence
  Artificial sequence related to HLA knockouts in cell therapy
agggcacgtgcgtggagtggct

SEQ ID NO: 21458 - DNA, 22 bp, Artificial Sequence
  Artificial sequence related to HLA knockouts in cell therapy
gggcacgtgcgtggagtggctc

SEQ ID NO: 21459 - DNA, 22 bp, Artificial Sequence
  Artificial sequence related to HLA knockouts in cell therapy
ggcacgtgcgtggagtggctcc

SEQ ID NO: 21460 - DNA, 22 bp, Artificial Sequence
  Artificial sequence related to HLA knockouts in cell therapy
gcacgtgcgtggagtggctccg

SEQ ID NO: 21461 - DNA, 22 bp, Artificial Sequence
  Artificial sequence related to HLA knockouts in cell therapy
cacgtgcgtggagtggctccgc

SEQ ID NO: 21462 - DNA, 22 bp, Artificial Sequence
  Artificial sequence related to HLA knockouts in cell therapy
acgtgcgtggagtggctccgca

SEQ ID NO: 21463 - DNA, 22 bp, Artificial Sequence
  Artificial sequence related to HLA knockouts in cell therapy
cgtgcgtggagtggctccgcag

SEQ ID NO: 21464 - DNA, 22 bp, Artificial Sequence
  Artificial sequence related to HLA knockouts in cell therapy
gtgcgtggagtggctccgcaga

SEQ ID NO: 21465 - DNA, 22 bp, Artificial Sequence
  Artificial sequence related to HLA knockouts in cell therapy
tgcgtggagtggctccgcagat

SEQ ID NO: 21466 - DNA, 22 bp, Artificial Sequence
  Artificial sequence related to HLA knockouts in cell therapy
gcgtggagtggctccgcagata

SEQ ID NO: 21467 - DNA, 22 bp, Artificial Sequence
  Artificial sequence related to HLA knockouts in cell therapy
cgtggagtggctccgcagatac

SEQ ID NO: 21468 - DNA, 22 bp, Artificial Sequence
  Artificial sequence related to HLA knockouts in cell therapy
gtggagtggctccgcagatacc

SEQ ID NO: 21469 - DNA, 22 bp, Artificial Sequence
  Artificial sequence related to HLA knockouts in cell therapy
ggagtggctccgcagatacctg

SEQ ID NO: 21470 - DNA, 22 bp, Artificial Sequence
  Artificial sequence related to HLA knockouts in cell therapy
gagtggctccgcagatacctgg

SEQ ID NO: 21471 - DNA, 22 bp, Artificial Sequence
  Artificial sequence related to HLA knockouts in cell therapy
gtggctccgcagatacctggag

SEQ ID NO: 21472 - DNA, 22 bp, Artificial Sequence
  Artificial sequence related to HLA knockouts in cell therapy
ccgcagatacctggagaacggg

SEQ ID NO: 21473 - DNA, 22 bp, Artificial Sequence
  Artificial sequence related to HLA knockouts in cell therapy
cctggagaacgggaaggagacg

SEQ ID NO: 21474 - DNA, 22 bp, Artificial Sequence
  Artificial sequence related to HLA knockouts in cell therapy
ctggagaacgggaaggagacgc

SEQ ID NO: 21475 - DNA, 22 bp, Artificial Sequence
  Artificial sequence related to HLA knockouts in cell therapy
ggagaacgggaaggagacgctg

SEQ ID NO: 21476 - DNA, 22 bp, Artificial Sequence
  Artificial sequence related to HLA knockouts in cell therapy
gagaacgggaaggagacgctgc

SEQ ID NO: 21477 - DNA, 22 bp, Artificial Sequence
  Artificial sequence related to HLA knockouts in cell therapy
gaacgggaaggagacgctgcag

SEQ ID NO: 21478 - DNA, 22 bp, Artificial Sequence
  Artificial sequence related to HLA knockouts in cell therapy
aacgggaaggagacgctgcagc

SEQ ID NO: 21479 - DNA, 22 bp, Artificial Sequence
  Artificial sequence related to HLA knockouts in cell therapy
acgggaaggagacgctgcagcg

SEQ ID NO: 21480 - DNA, 22 bp, Artificial Sequence
  Artificial sequence related to HLA knockouts in cell therapy
cgggaaggagacgctgcagcgc

SEQ ID NO: 21481 - DNA, 22 bp, Artificial Sequence
  Artificial sequence related to HLA knockouts in cell therapy
gggaaggagacgctgcagcgca

SEQ ID NO: 21482 - DNA, 22 bp, Artificial Sequence
  Artificial sequence related to HLA knockouts in cell therapy
ggaaggagacgctgcagcgcac

SEQ ID NO: 21483 - DNA, 22 bp, Artificial Sequence
  Artificial sequence related to HLA knockouts in cell therapy
gaaggagacgctgcagcgcacg

SEQ ID NO: 21484 - DNA, 22 bp, Artificial Sequence
  Artificial sequence related to HLA knockouts in cell therapy
aaggagacgctgcagcgcacgg

SEQ ID NO: 21485 - DNA, 22 bp, Artificial Sequence
  Artificial sequence related to HLA knockouts in cell therapy
aggagacgctgcagcgcacgga

SEQ ID NO: 21486 - DNA, 22 bp, Artificial Sequence
  Artificial sequence related to HLA knockouts in cell therapy
ggagacgctgcagcgcacggac

SEQ ID NO: 21487 - DNA, 22 bp, Artificial Sequence
  Artificial sequence related to HLA knockouts in cell therapy
gagacgctgcagcgcacggacg

SEQ ID NO: 21488 - DNA, 22 bp, Artificial Sequence
  Artificial sequence related to HLA knockouts in cell therapy
agacgctgcagcgcacggacgc

SEQ ID NO: 21489 - DNA, 22 bp, Artificial Sequence
  Artificial sequence related to HLA knockouts in cell therapy
gacgctgcagcgcacggacgcc

SEQ ID NO: 21490 - DNA, 22 bp, Artificial Sequence
  Artificial sequence related to HLA knockouts in cell therapy
acgctgcagcgcacggacgccc

SEQ ID NO: 21491 - DNA, 22 bp, Artificial Sequence
  Artificial sequence related to HLA knockouts in cell therapy
cgctgcagcgcacggacgcccc

SEQ ID NO: 21492 - DNA, 22 bp, Artificial Sequence
  Artificial sequence related to HLA knockouts in cell therapy
gctgcagcgcacggacgccccc

SEQ ID NO: 21493 - DNA, 22 bp, Artificial Sequence
  Artificial sequence related to HLA knockouts in cell therapy
ctgcagcgcacggacgccccca

SEQ ID NO: 21494 - DNA, 22 bp, Artificial Sequence
  Artificial sequence related to HLA knockouts in cell therapy
tgcagcgcacggacgcccccaa

SEQ ID NO: 21495 - DNA, 22 bp, Artificial Sequence
  Artificial sequence related to HLA knockouts in cell therapy
gcagcgcacggacgcccccaaa

SEQ ID NO: 21496 - DNA, 22 bp, Artificial Sequence
  Artificial sequence related to HLA knockouts in cell therapy
cagcgcacggacgcccccaaaa

SEQ ID NO: 21497 - DNA, 22 bp, Artificial Sequence
  Artificial sequence related to HLA knockouts in cell therapy
agcgcacggacgcccccaaaac

SEQ ID NO: 21498 - DNA, 22 bp, Artificial Sequence
  Artificial sequence related to HLA knockouts in cell therapy
gcgcacggacgcccccaaaacg

SEQ ID NO: 21499 - DNA, 22 bp, Artificial Sequence
  Artificial sequence related to HLA knockouts in cell therapy
cgcacggacgcccccaaaacgc

SEQ ID NO: 21500 - DNA, 22 bp, Artificial Sequence
  Artificial sequence related to HLA knockouts in cell therapy
gcacggacgcccccaaaacgca

SEQ ID NO: 21501 - DNA, 22 bp, Artificial Sequence
  Artificial sequence related to HLA knockouts in cell therapy
cacggacgcccccaaaacgcat

SEQ ID NO: 21502 - DNA, 22 bp, Artificial Sequence
  Artificial sequence related to HLA knockouts in cell therapy
ccatgaagccaccctgaggtgc

SEQ ID NO: 21503 - DNA, 22 bp, Artificial Sequence
  Artificial sequence related to HLA knockouts in cell therapy
tgaagccaccctgaggtgctgg

SEQ ID NO: 21504 - DNA, 22 bp, Artificial Sequence
  Artificial sequence related to HLA knockouts in cell therapy
gaagccaccctgaggtgctggg

SEQ ID NO: 21505 - DNA, 22 bp, Artificial Sequence
  Artificial sequence related to HLA knockouts in cell therapy
aagccaccctgaggtgctgggc

SEQ ID NO: 21506 - DNA, 22 bp, Artificial Sequence
  Artificial sequence related to HLA knockouts in cell therapy
agccaccctgaggtgctgggcc

SEQ ID NO: 21507 - DNA, 22 bp, Artificial Sequence
  Artificial sequence related to HLA knockouts in cell therapy
gccaccctgaggtgctgggccc

SEQ ID NO: 21508 - DNA, 22 bp, Artificial Sequence
  Artificial sequence related to HLA knockouts in cell therapy
ccaccctgaggtgctgggccct

SEQ ID NO: 21509 - DNA, 22 bp, Artificial Sequence
  Artificial sequence related to HLA knockouts in cell therapy
caccctgaggtgctgggccctg

SEQ ID NO: 21510 - DNA, 22 bp, Artificial Sequence
  Artificial sequence related to HLA knockouts in cell therapy
accctgaggtgctgggccctga

SEQ ID NO: 21511 - DNA, 22 bp, Artificial Sequence
  Artificial sequence related to HLA knockouts in cell therapy
ccctgaggtgctgggccctgag

SEQ ID NO: 21512 - DNA, 22 bp, Artificial Sequence
  Artificial sequence related to HLA knockouts in cell therapy
cctgaggtgctgggccctgagc

SEQ ID NO: 21513 - DNA, 22 bp, Artificial Sequence
  Artificial sequence related to HLA knockouts in cell therapy
ctgaggtgctgggccctgagct

SEQ ID NO: 21514 - DNA, 22 bp, Artificial Sequence
  Artificial sequence related to HLA knockouts in cell therapy
tgaggtgctgggccctgagctt

SEQ ID NO: 21515 - DNA, 22 bp, Artificial Sequence
  Artificial sequence related to HLA knockouts in cell therapy
gaggtgctgggccctgagcttc

SEQ ID NO: 21516 - DNA, 22 bp, Artificial Sequence
  Artificial sequence related to HLA knockouts in cell therapy
aggtgctgggccctgagcttct

SEQ ID NO: 21517 - DNA, 22 bp, Artificial Sequence
  Artificial sequence related to HLA knockouts in cell therapy
ggtgctgggccctgagcttcta

SEQ ID NO: 21518 - DNA, 22 bp, Artificial Sequence
  Artificial sequence related to HLA knockouts in cell therapy
gtgctgggccctgagcttctac

SEQ ID NO: 21519 - DNA, 22 bp, Artificial Sequence
  Artificial sequence related to HLA knockouts in cell therapy
tgctgggccctgagcttctacc

SEQ ID NO: 21520 - DNA, 22 bp, Artificial Sequence
  Artificial sequence related to HLA knockouts in cell therapy
gctgggccctgagcttctaccc

SEQ ID NO: 21521 - DNA, 22 bp, Artificial Sequence
  Artificial sequence related to HLA knockouts in cell therapy
ctgggccctgagcttctaccct

SEQ ID NO: 21522 - DNA, 22 bp, Artificial Sequence
  Artificial sequence related to HLA knockouts in cell therapy
tgggccctgagcttctaccctg

SEQ ID NO: 21523 - DNA, 22 bp, Artificial Sequence
  Artificial sequence related to HLA knockouts in cell therapy
gggccctgagcttctaccctgc

SEQ ID NO: 21524 - DNA, 22 bp, Artificial Sequence
  Artificial sequence related to HLA knockouts in cell therapy
ggccctgagcttctaccctgcg

SEQ ID NO: 21525 - DNA, 22 bp, Artificial Sequence
  Artificial sequence related to HLA knockouts in cell therapy
gccctgagcttctaccctgcgg

SEQ ID NO: 21526 - DNA, 22 bp, Artificial Sequence
  Artificial sequence related to HLA knockouts in cell therapy
ccctgagcttctaccctgcgga

SEQ ID NO: 21527 - DNA, 22 bp, Artificial Sequence
  Artificial sequence related to HLA knockouts in cell therapy
cctgagcttctaccctgcggag

SEQ ID NO: 21528 - DNA, 22 bp, Artificial Sequence
  Artificial sequence related to HLA knockouts in cell therapy
ccctgcggagatcacactgacc

SEQ ID NO: 21529 - DNA, 22 bp, Artificial Sequence
  Artificial sequence related to HLA knockouts in cell therapy
gcggagatcacactgacctggc

SEQ ID NO: 21530 - DNA, 22 bp, Artificial Sequence
  Artificial sequence related to HLA knockouts in cell therapy
gatcacactgacctggcagcgg

SEQ ID NO: 21531 - DNA, 22 bp, Artificial Sequence
  Artificial sequence related to HLA knockouts in cell therapy
atcacactgacctggcagcggg

SEQ ID NO: 21532 - DNA, 22 bp, Artificial Sequence
  Artificial sequence related to HLA knockouts in cell therapy
tcacactgacctggcagcggga

SEQ ID NO: 21533 - DNA, 22 bp, Artificial Sequence
  Artificial sequence related to HLA knockouts in cell therapy
cacactgacctggcagcgggat

SEQ ID NO: 21534 - DNA, 22 bp, Artificial Sequence
  Artificial sequence related to HLA knockouts in cell therapy
acactgacctggcagcgggatg

SEQ ID NO: 21535 - DNA, 22 bp, Artificial Sequence
  Artificial sequence related to HLA knockouts in cell therapy
cactgacctggcagcgggatgg

SEQ ID NO: 21536 - DNA, 22 bp, Artificial Sequence
  Artificial sequence related to HLA knockouts in cell therapy
actgacctggcagcgggatggg

SEQ ID NO: 21537 - DNA, 22 bp, Artificial Sequence
  Artificial sequence related to HLA knockouts in cell therapy
ctgacctggcagcgggatgggg

SEQ ID NO: 21538 - DNA, 22 bp, Artificial Sequence
  Artificial sequence related to HLA knockouts in cell therapy
tgacctggcagcgggatgggga

SEQ ID NO: 21539 - DNA, 22 bp, Artificial Sequence
  Artificial sequence related to HLA knockouts in cell therapy
gacctggcagcgggatggggag

SEQ ID NO: 21540 - DNA, 22 bp, Artificial Sequence
  Artificial sequence related to HLA knockouts in cell therapy
acctggcagcgggatggggagg

SEQ ID NO: 21541 - DNA, 22 bp, Artificial Sequence
  Artificial sequence related to HLA knockouts in cell therapy
cctggcagcgggatggggagga

SEQ ID NO: 21542 - DNA, 22 bp, Artificial Sequence
  Artificial sequence related to HLA knockouts in cell therapy
ctggcagcgggatggggaggac

SEQ ID NO: 21543 - DNA, 22 bp, Artificial Sequence
  Artificial sequence related to HLA knockouts in cell therapy
tggcagcgggatggggaggacc

SEQ ID NO: 21544 - DNA, 22 bp, Artificial Sequence
  Artificial sequence related to HLA knockouts in cell therapy
ggcagcgggatggggaggacca

SEQ ID NO: 21545 - DNA, 22 bp, Artificial Sequence
  Artificial sequence related to HLA knockouts in cell therapy
gcagcgggatggggaggaccag

SEQ ID NO: 21546 - DNA, 22 bp, Artificial Sequence
  Artificial sequence related to HLA knockouts in cell therapy
cagcgggatggggaggaccaga

SEQ ID NO: 21547 - DNA, 22 bp, Artificial Sequence
  Artificial sequence related to HLA knockouts in cell therapy
agcgggatggggaggaccagac

SEQ ID NO: 21548 - DNA, 22 bp, Artificial Sequence
  Artificial sequence related to HLA knockouts in cell therapy
gcgggatggggaggaccagacc

SEQ ID NO: 21549 - DNA, 22 bp, Artificial Sequence
  Artificial sequence related to HLA knockouts in cell therapy
cgggatggggaggaccagaccc

SEQ ID NO: 21550 - DNA, 22 bp, Artificial Sequence
  Artificial sequence related to HLA knockouts in cell therapy
gggatggggaggaccagaccca

SEQ ID NO: 21551 - DNA, 22 bp, Artificial Sequence
  Artificial sequence related to HLA knockouts in cell therapy
ggatggggaggaccagacccag

SEQ ID NO: 21552 - DNA, 22 bp, Artificial Sequence
  Artificial sequence related to HLA knockouts in cell therapy
gatggggaggaccagacccagg

SEQ ID NO: 21553 - DNA, 22 bp, Artificial Sequence
  Artificial sequence related to HLA knockouts in cell therapy
atggggaggaccagacccagga

SEQ ID NO: 21554 - DNA, 22 bp, Artificial Sequence
  Artificial sequence related to HLA knockouts in cell therapy
tggggaggaccagacccaggac

SEQ ID NO: 21555 - DNA, 22 bp, Artificial Sequence
  Artificial sequence related to HLA knockouts in cell therapy
ggggaggaccagacccaggaca

SEQ ID NO: 21556 - DNA, 22 bp, Artificial Sequence
  Artificial sequence related to HLA knockouts in cell therapy
gggaggaccagacccaggacac

SEQ ID NO: 21557 - DNA, 22 bp, Artificial Sequence
  Artificial sequence related to HLA knockouts in cell therapy
ggaggaccagacccaggacacg

SEQ ID NO: 21558 - DNA, 22 bp, Artificial Sequence
  Artificial sequence related to HLA knockouts in cell therapy
gaggaccagacccaggacacgg

SEQ ID NO: 21559 - DNA, 22 bp, Artificial Sequence
  Artificial sequence related to HLA knockouts in cell therapy
aggaccagacccaggacacgga

SEQ ID NO: 21560 - DNA, 22 bp, Artificial Sequence
  Artificial sequence related to HLA knockouts in cell therapy
ggaccagacccaggacacggag

SEQ ID NO: 21561 - DNA, 22 bp, Artificial Sequence
  Artificial sequence related to HLA knockouts in cell therapy
gaccagacccaggacacggagc

SEQ ID NO: 21562 - DNA, 22 bp, Artificial Sequence
  Artificial sequence related to HLA knockouts in cell therapy
accagacccaggacacggagct

SEQ ID NO: 21563 - DNA, 22 bp, Artificial Sequence
  Artificial sequence related to HLA knockouts in cell therapy
ccagacccaggacacggagctc

SEQ ID NO: 21564 - DNA, 22 bp, Artificial Sequence
  Artificial sequence related to HLA knockouts in cell therapy
cagacccaggacacggagctcg

SEQ ID NO: 21565 - DNA, 22 bp, Artificial Sequence
  Artificial sequence related to HLA knockouts in cell therapy
agacccaggacacggagctcgt

SEQ ID NO: 21566 - DNA, 22 bp, Artificial Sequence
  Artificial sequence related to HLA knockouts in cell therapy
gacccaggacacggagctcgtg

SEQ ID NO: 21567 - DNA, 22 bp, Artificial Sequence
  Artificial sequence related to HLA knockouts in cell therapy
acccaggacacggagctcgtgg

SEQ ID NO: 21568 - DNA, 22 bp, Artificial Sequence
  Artificial sequence related to HLA knockouts in cell therapy
cccaggacacggagctcgtgga

SEQ ID NO: 21569 - DNA, 22 bp, Artificial Sequence
  Artificial sequence related to HLA knockouts in cell therapy
ccaggacacggagctcgtggag

SEQ ID NO: 21570 - DNA, 22 bp, Artificial Sequence
  Artificial sequence related to HLA knockouts in cell therapy
caggacacggagctcgtggaga

SEQ ID NO: 21571 - DNA, 22 bp, Artificial Sequence
  Artificial sequence related to HLA knockouts in cell therapy
aggacacggagctcgtggagac

SEQ ID NO: 21572 - DNA, 22 bp, Artificial Sequence
  Artificial sequence related to HLA knockouts in cell therapy
ggacacggagctcgtggagacc

SEQ ID NO: 21573 - DNA, 22 bp, Artificial Sequence
  Artificial sequence related to HLA knockouts in cell therapy
gacacggagctcgtggagacca

SEQ ID NO: 21574 - DNA, 22 bp, Artificial Sequence
  Artificial sequence related to HLA knockouts in cell therapy
acacggagctcgtggagaccag

SEQ ID NO: 21575 - DNA, 22 bp, Artificial Sequence
  Artificial sequence related to HLA knockouts in cell therapy
cacggagctcgtggagaccagg

SEQ ID NO: 21576 - DNA, 22 bp, Artificial Sequence
  Artificial sequence related to HLA knockouts in cell therapy
acggagctcgtggagaccaggc

SEQ ID NO: 21577 - DNA, 22 bp, Artificial Sequence
  Artificial sequence related to HLA knockouts in cell therapy
cggagctcgtggagaccaggcc

SEQ ID NO: 21578 - DNA, 22 bp, Artificial Sequence
  Artificial sequence related to HLA knockouts in cell therapy
ggagctcgtggagaccaggcct

SEQ ID NO: 21579 - DNA, 22 bp, Artificial Sequence
  Artificial sequence related to HLA knockouts in cell therapy
gagctcgtggagaccaggcctg

SEQ ID NO: 21580 - DNA, 22 bp, Artificial Sequence
  Artificial sequence related to HLA knockouts in cell therapy
agctcgtggagaccaggcctgc

SEQ ID NO: 21581 - DNA, 22 bp, Artificial Sequence
  Artificial sequence related to HLA knockouts in cell therapy
gctcgtggagaccaggcctgca

SEQ ID NO: 21582 - DNA, 22 bp, Artificial Sequence
  Artificial sequence related to HLA knockouts in cell therapy
ctcgtggagaccaggcctgcag

SEQ ID NO: 21583 - DNA, 22 bp, Artificial Sequence
  Artificial sequence related to HLA knockouts in cell therapy
tcgtggagaccaggcctgcagg

SEQ ID NO: 21584 - DNA, 22 bp, Artificial Sequence
  Artificial sequence related to HLA knockouts in cell therapy
cgtggagaccaggcctgcaggg

SEQ ID NO: 21585 - DNA, 22 bp, Artificial Sequence
  Artificial sequence related to HLA knockouts in cell therapy
gtggagaccaggcctgcagggg

SEQ ID NO: 21586 - DNA, 22 bp, Artificial Sequence
  Artificial sequence related to HLA knockouts in cell therapy
tggagaccaggcctgcagggga

SEQ ID NO: 21587 - DNA, 22 bp, Artificial Sequence
  Artificial sequence related to HLA knockouts in cell therapy
ggagaccaggcctgcaggggat

SEQ ID NO: 21588 - DNA, 22 bp, Artificial Sequence
  Artificial sequence related to HLA knockouts in cell therapy
gagaccaggcctgcaggggatg

SEQ ID NO: 21589 - DNA, 22 bp, Artificial Sequence
  Artificial sequence related to HLA knockouts in cell therapy
agaccaggcctgcaggggatgg

SEQ ID NO: 21590 - DNA, 22 bp, Artificial Sequence
  Artificial sequence related to HLA knockouts in cell therapy
gaccaggcctgcaggggatgga

SEQ ID NO: 21591 - DNA, 22 bp, Artificial Sequence
  Artificial sequence related to HLA knockouts in cell therapy
accaggcctgcaggggatggaa

SEQ ID NO: 21592 - DNA, 22 bp, Artificial Sequence
  Artificial sequence related to HLA knockouts in cell therapy
ccaggcctgcaggggatggaac

SEQ ID NO: 21593 - DNA, 22 bp, Artificial Sequence
  Artificial sequence related to HLA knockouts in cell therapy
caggcctgcaggggatggaacc

SEQ ID NO: 21594 - DNA, 22 bp, Artificial Sequence
  Artificial sequence related to HLA knockouts in cell therapy
aggcctgcaggggatggaacct

SEQ ID NO: 21595 - DNA, 22 bp, Artificial Sequence
  Artificial sequence related to HLA knockouts in cell therapy
ggcctgcaggggatggaacctt

SEQ ID NO: 21596 - DNA, 22 bp, Artificial Sequence
  Artificial sequence related to HLA knockouts in cell therapy
gcctgcaggggatggaaccttc

SEQ ID NO: 21597 - DNA, 22 bp, Artificial Sequence
  Artificial sequence related to HLA knockouts in cell therapy
cctgcaggggatggaaccttcc

SEQ ID NO: 21598 - DNA, 22 bp, Artificial Sequence
  Artificial sequence related to HLA knockouts in cell therapy
ggaaccttccagaagtgggcgg

SEQ ID NO: 21599 - DNA, 22 bp, Artificial Sequence
  Artificial sequence related to HLA knockouts in cell therapy
gaaccttccagaagtgggcggc

SEQ ID NO: 21600 - DNA, 22 bp, Artificial Sequence
  Artificial sequence related to HLA knockouts in cell therapy
accttccagaagtgggcggctg

SEQ ID NO: 21601 - DNA, 22 bp, Artificial Sequence
  Artificial sequence related to HLA knockouts in cell therapy
ccttccagaagtgggcggctgt

SEQ ID NO: 21602 - DNA, 22 bp, Artificial Sequence
  Artificial sequence related to HLA knockouts in cell therapy
cttccagaagtgggcggctgtg

SEQ ID NO: 21603 - DNA, 22 bp, Artificial Sequence
  Artificial sequence related to HLA knockouts in cell therapy
ttccagaagtgggcggctgtgg

SEQ ID NO: 21604 - DNA, 22 bp, Artificial Sequence
  Artificial sequence related to HLA knockouts in cell therapy
tccagaagtgggcggctgtggt

SEQ ID NO: 21605 - DNA, 22 bp, Artificial Sequence
  Artificial sequence related to HLA knockouts in cell therapy
ccagaagtgggcggctgtggtg

SEQ ID NO: 21606 - DNA, 22 bp, Artificial Sequence
  Artificial sequence related to HLA knockouts in cell therapy
cagaagtgggcggctgtggtgg

SEQ ID NO: 21607 - DNA, 22 bp, Artificial Sequence
  Artificial sequence related to HLA knockouts in cell therapy
agaagtgggcggctgtggtggt

SEQ ID NO: 21608 - DNA, 22 bp, Artificial Sequence
  Artificial sequence related to HLA knockouts in cell therapy
gaagtgggcggctgtggtggtg

SEQ ID NO: 21609 - DNA, 22 bp, Artificial Sequence
  Artificial sequence related to HLA knockouts in cell therapy
aagtgggcggctgtggtggtgc

SEQ ID NO: 21610 - DNA, 22 bp, Artificial Sequence
  Artificial sequence related to HLA knockouts in cell therapy
agtgggcggctgtggtggtgcc

SEQ ID NO: 21611 - DNA, 22 bp, Artificial Sequence
  Artificial sequence related to HLA knockouts in cell therapy
gtgggcggctgtggtggtgcct

SEQ ID NO: 21612 - DNA, 22 bp, Artificial Sequence
  Artificial sequence related to HLA knockouts in cell therapy
tgggcggctgtggtggtgcctt

SEQ ID NO: 21613 - DNA, 22 bp, Artificial Sequence
  Artificial sequence related to HLA knockouts in cell therapy
gggcggctgtggtggtgccttc

SEQ ID NO: 21614 - DNA, 22 bp, Artificial Sequence
  Artificial sequence related to HLA knockouts in cell therapy
ggcggctgtggtggtgccttct

SEQ ID NO: 21615 - DNA, 22 bp, Artificial Sequence
  Artificial sequence related to HLA knockouts in cell therapy
gcggctgtggtggtgccttctg

SEQ ID NO: 21616 - DNA, 22 bp, Artificial Sequence
  Artificial sequence related to HLA knockouts in cell therapy
cggctgtggtggtgccttctgg

SEQ ID NO: 21617 - DNA, 22 bp, Artificial Sequence
  Artificial sequence related to HLA knockouts in cell therapy
ggctgtggtggtgccttctgga

SEQ ID NO: 21618 - DNA, 22 bp, Artificial Sequence
  Artificial sequence related to HLA knockouts in cell therapy
gctgtggtggtgccttctggac

SEQ ID NO: 21619 - DNA, 22 bp, Artificial Sequence
  Artificial sequence related to HLA knockouts in cell therapy
gtggtggtgccttctggacagg

SEQ ID NO: 21620 - DNA, 22 bp, Artificial Sequence
  Artificial sequence related to HLA knockouts in cell therapy
ggtggtgccttctggacaggag

SEQ ID NO: 21621 - DNA, 22 bp, Artificial Sequence
  Artificial sequence related to HLA knockouts in cell therapy
gtggtgccttctggacaggagc

SEQ ID NO: 21622 - DNA, 22 bp, Artificial Sequence
  Artificial sequence related to HLA knockouts in cell therapy
ggtgccttctggacaggagcag

SEQ ID NO: 21623 - DNA, 22 bp, Artificial Sequence
  Artificial sequence related to HLA knockouts in cell therapy
cctgccatgtgcagcatgaggg

SEQ ID NO: 21624 - DNA, 22 bp, Artificial Sequence
  Artificial sequence related to HLA knockouts in cell therapy
gcatgagggtttgcccaagccc

SEQ ID NO: 21625 - DNA, 22 bp, Artificial Sequence
  Artificial sequence related to HLA knockouts in cell therapy
catgagggtttgcccaagcccc

SEQ ID NO: 21626 - DNA, 22 bp, Artificial Sequence
  Artificial sequence related to HLA knockouts in cell therapy
tgagggtttgcccaagcccctc

SEQ ID NO: 21627 - DNA, 22 bp, Artificial Sequence
  Artificial sequence related to HLA knockouts in cell therapy
gagggtttgcccaagcccctca

SEQ ID NO: 21628 - DNA, 22 bp, Artificial Sequence
  Artificial sequence related to HLA knockouts in cell therapy
agggtttgcccaagcccctcac

SEQ ID NO: 21629 - DNA, 22 bp, Artificial Sequence
  Artificial sequence related to HLA knockouts in cell therapy
gggtttgcccaagcccctcacc

SEQ ID NO: 21630 - DNA, 22 bp, Artificial Sequence
  Artificial sequence related to HLA knockouts in cell therapy
ggtttgcccaagcccctcaccc

SEQ ID NO: 21631 - DNA, 22 bp, Artificial Sequence
  Artificial sequence related to HLA knockouts in cell therapy
gtttgcccaagcccctcaccct

SEQ ID NO: 21632 - DNA, 22 bp, Artificial Sequence
  Artificial sequence related to HLA knockouts in cell therapy
tttgcccaagcccctcaccctg

SEQ ID NO: 21633 - DNA, 22 bp, Artificial Sequence
  Artificial sequence related to HLA knockouts in cell therapy
ttgcccaagcccctcaccctga

SEQ ID NO: 21634 - DNA, 22 bp, Artificial Sequence
  Artificial sequence related to HLA knockouts in cell therapy
tgcccaagcccctcaccctgag

SEQ ID NO: 21635 - DNA, 22 bp, Artificial Sequence
  Artificial sequence related to HLA knockouts in cell therapy
gcccaagcccctcaccctgaga

SEQ ID NO: 21636 - DNA, 22 bp, Artificial Sequence
  Artificial sequence related to HLA knockouts in cell therapy
cccaagcccctcaccctgagat

SEQ ID NO: 21637 - DNA, 22 bp, Artificial Sequence
  Artificial sequence related to HLA knockouts in cell therapy
ccaagcccctcaccctgagatg

SEQ ID NO: 21638 - DNA, 22 bp, Artificial Sequence
  Artificial sequence related to HLA knockouts in cell therapy
caagcccctcaccctgagatgg

SEQ ID NO: 21639 - DNA, 22 bp, Artificial Sequence
  Artificial sequence related to HLA knockouts in cell therapy
aagcccctcaccctgagatggg

SEQ ID NO: 21640 - DNA, 22 bp, Artificial Sequence
  Artificial sequence related to HLA knockouts in cell therapy
agcccctcaccctgagatggga

SEQ ID NO: 21641 - DNA, 22 bp, Artificial Sequence
  Artificial sequence related to HLA knockouts in cell therapy
gcccctcaccctgagatgggag

SEQ ID NO: 21642 - DNA, 22 bp, Artificial Sequence
  Artificial sequence related to HLA knockouts in cell therapy
cccctcaccctgagatgggagc

SEQ ID NO: 21643 - DNA, 22 bp, Artificial Sequence
  Artificial sequence related to HLA knockouts in cell therapy
ccctcaccctgagatgggagcc

SEQ ID NO: 21644 - DNA, 22 bp, Artificial Sequence
  Artificial sequence related to HLA knockouts in cell therapy
cctcaccctgagatgggagccg

SEQ ID NO: 21645 - DNA, 22 bp, Artificial Sequence
  Artificial sequence related to HLA knockouts in cell therapy
ctcaccctgagatgggagccgt

SEQ ID NO: 21646 - DNA, 22 bp, Artificial Sequence
  Artificial sequence related to HLA knockouts in cell therapy
tcaccctgagatgggagccgtc

SEQ ID NO: 21647 - DNA, 22 bp, Artificial Sequence
  Artificial sequence related to HLA knockouts in cell therapy
caccctgagatgggagccgtct

SEQ ID NO: 21648 - DNA, 22 bp, Artificial Sequence
  Artificial sequence related to HLA knockouts in cell therapy
ccctgagatgggagccgtcttc

SEQ ID NO: 21649 - DNA, 22 bp, Artificial Sequence
  Artificial sequence related to HLA knockouts in cell therapy
cctgagatgggagccgtcttcc

SEQ ID NO: 21650 - DNA, 22 bp, Artificial Sequence
  Artificial sequence related to HLA knockouts in cell therapy
ctgagatgggagccgtcttccc

SEQ ID NO: 21651 - DNA, 22 bp, Artificial Sequence
  Artificial sequence related to HLA knockouts in cell therapy
gagatgggagccgtcttcccag

SEQ ID NO: 21652 - DNA, 22 bp, Artificial Sequence
  Artificial sequence related to HLA knockouts in cell therapy
agatgggagccgtcttcccagc

SEQ ID NO: 21653 - DNA, 22 bp, Artificial Sequence
  Artificial sequence related to HLA knockouts in cell therapy
gatgggagccgtcttcccagcc

SEQ ID NO: 21654 - DNA, 22 bp, Artificial Sequence
  Artificial sequence related to HLA knockouts in cell therapy
atgggagccgtcttcccagccc

SEQ ID NO: 21655 - DNA, 22 bp, Artificial Sequence
  Artificial sequence related to HLA knockouts in cell therapy
tgggagccgtcttcccagccca

SEQ ID NO: 21656 - DNA, 22 bp, Artificial Sequence
  Artificial sequence related to HLA knockouts in cell therapy
gggagccgtcttcccagcccac

SEQ ID NO: 21657 - DNA, 22 bp, Artificial Sequence
  Artificial sequence related to HLA knockouts in cell therapy
ggagccgtcttcccagcccacc

SEQ ID NO: 21658 - DNA, 22 bp, Artificial Sequence
  Artificial sequence related to HLA knockouts in cell therapy
gagccgtcttcccagcccacca

SEQ ID NO: 21659 - DNA, 22 bp, Artificial Sequence
  Artificial sequence related to HLA knockouts in cell therapy
agccgtcttcccagcccaccat

SEQ ID NO: 21660 - DNA, 22 bp, Artificial Sequence
  Artificial sequence related to HLA knockouts in cell therapy
gccgtcttcccagcccaccatc

SEQ ID NO: 21661 - DNA, 22 bp, Artificial Sequence
  Artificial sequence related to HLA knockouts in cell therapy
ccgtcttcccagcccaccatcc

SEQ ID NO: 21662 - DNA, 22 bp, Artificial Sequence
  Artificial sequence related to HLA knockouts in cell therapy
cgtcttcccagcccaccatccc

SEQ ID NO: 21663 - DNA, 22 bp, Artificial Sequence
  Artificial sequence related to HLA knockouts in cell therapy
gtcttcccagcccaccatcccc

SEQ ID NO: 21664 - DNA, 22 bp, Artificial Sequence
  Artificial sequence related to HLA knockouts in cell therapy
tcttcccagcccaccatcccca

SEQ ID NO: 21665 - DNA, 22 bp, Artificial Sequence
  Artificial sequence related to HLA knockouts in cell therapy
cttcccagcccaccatccccat

SEQ ID NO: 21666 - DNA, 22 bp, Artificial Sequence
  Artificial sequence related to HLA knockouts in cell therapy
ttcccagcccaccatccccatc

SEQ ID NO: 21667 - DNA, 22 bp, Artificial Sequence
  Artificial sequence related to HLA knockouts in cell therapy
tcccagcccaccatccccatcg

SEQ ID NO: 21668 - DNA, 22 bp, Artificial Sequence
  Artificial sequence related to HLA knockouts in cell therapy
cccagcccaccatccccatcgt

SEQ ID NO: 21669 - DNA, 22 bp, Artificial Sequence
  Artificial sequence related to HLA knockouts in cell therapy
ccagcccaccatccccatcgtg

SEQ ID NO: 21670 - DNA, 22 bp, Artificial Sequence
  Artificial sequence related to HLA knockouts in cell therapy
cagcccaccatccccatcgtgg

SEQ ID NO: 21671 - DNA, 22 bp, Artificial Sequence
  Artificial sequence related to HLA knockouts in cell therapy
agcccaccatccccatcgtggg

SEQ ID NO: 21672 - DNA, 22 bp, Artificial Sequence
  Artificial sequence related to HLA knockouts in cell therapy
gcccaccatccccatcgtgggc

SEQ ID NO: 21673 - DNA, 22 bp, Artificial Sequence
  Artificial sequence related to HLA knockouts in cell therapy
cccaccatccccatcgtgggca

SEQ ID NO: 21674 - DNA, 22 bp, Artificial Sequence
  Artificial sequence related to HLA knockouts in cell therapy
ccaccatccccatcgtgggcat

SEQ ID NO: 21675 - DNA, 22 bp, Artificial Sequence
  Artificial sequence related to HLA knockouts in cell therapy
caccatccccatcgtgggcatc

SEQ ID NO: 21676 - DNA, 22 bp, Artificial Sequence
  Artificial sequence related to HLA knockouts in cell therapy
cgtgggcatcattgctggcctg

SEQ ID NO: 21677 - DNA, 22 bp, Artificial Sequence
  Artificial sequence related to HLA knockouts in cell therapy
gtgggcatcattgctggcctgg

SEQ ID NO: 21678 - DNA, 22 bp, Artificial Sequence
  Artificial sequence related to HLA knockouts in cell therapy
tcactggagctgtggtcgctgc

SEQ ID NO: 21679 - DNA, 22 bp, Artificial Sequence
  Artificial sequence related to HLA knockouts in cell therapy
cactggagctgtggtcgctgct

SEQ ID NO: 21680 - DNA, 22 bp, Artificial Sequence
  Artificial sequence related to HLA knockouts in cell therapy
actggagctgtggtcgctgctg

SEQ ID NO: 21681 - DNA, 22 bp, Artificial Sequence
  Artificial sequence related to HLA knockouts in cell therapy
ctggagctgtggtcgctgctgt

SEQ ID NO: 21682 - DNA, 22 bp, Artificial Sequence
  Artificial sequence related to HLA knockouts in cell therapy
tggagctgtggtcgctgctgtg

SEQ ID NO: 21683 - DNA, 22 bp, Artificial Sequence
  Artificial sequence related to HLA knockouts in cell therapy
ggagctgtggtcgctgctgtga

SEQ ID NO: 21684 - DNA, 22 bp, Artificial Sequence
  Artificial sequence related to HLA knockouts in cell therapy
ggtcgctgctgtgatgtggagg

SEQ ID NO: 21685 - DNA, 22 bp, Artificial Sequence
  Artificial sequence related to HLA knockouts in cell therapy
cgctgctgtgatgtggaggagg

SEQ ID NO: 21686 - DNA, 22 bp, Artificial Sequence
  Artificial sequence related to HLA knockouts in cell therapy
ggagggagctactctcaggctg

SEQ ID NO: 21687 - DNA, 22 bp, Artificial Sequence
  Artificial sequence related to HLA knockouts in cell therapy
gagggagctactctcaggctgc

SEQ ID NO: 21688 - DNA, 22 bp, Artificial Sequence
  Artificial sequence related to HLA knockouts in cell therapy
ggctgcaagcagtgacagtgcc

SEQ ID NO: 21689 - DNA, 22 bp, Artificial Sequence
  Artificial sequence related to HLA knockouts in cell therapy
gctgcaagcagtgacagtgccc

SEQ ID NO: 21690 - DNA, 22 bp, Artificial Sequence
  Artificial sequence related to HLA knockouts in cell therapy
gcaagcagtgacagtgcccagg

SEQ ID NO: 21691 - DNA, 22 bp, Artificial Sequence
  Artificial sequence related to HLA knockouts in cell therapy
caagcagtgacagtgcccaggg

SEQ ID NO: 21692 - DNA, 22 bp, Artificial Sequence
  Artificial sequence related to HLA knockouts in cell therapy
aagcagtgacagtgcccagggc

SEQ ID NO: 21693 - DNA, 22 bp, Artificial Sequence
  Artificial sequence related to HLA knockouts in cell therapy
agcagtgacagtgcccagggct

SEQ ID NO: 21694 - DNA, 22 bp, Artificial Sequence
  Artificial sequence related to HLA knockouts in cell therapy
gcagtgacagtgcccagggctc

SEQ ID NO: 21695 - DNA, 22 bp, Artificial Sequence
  Artificial sequence related to HLA knockouts in cell therapy
cagtgacagtgcccagggctct

SEQ ID NO: 21696 - DNA, 22 bp, Artificial Sequence
  Artificial sequence related to HLA knockouts in cell therapy
agtgacagtgcccagggctctg

SEQ ID NO: 21697 - DNA, 22 bp, Artificial Sequence
  Artificial sequence related to HLA knockouts in cell therapy
gtgacagtgcccagggctctga

SEQ ID NO: 21698 - DNA, 22 bp, Artificial Sequence
  Artificial sequence related to HLA knockouts in cell therapy
gacagtgcccagggctctgatg

SEQ ID NO: 21699 - DNA, 22 bp, Artificial Sequence
  Artificial sequence related to HLA knockouts in cell therapy
cagtgcccagggctctgatgtg

SEQ ID NO: 21700 - DNA, 22 bp, Artificial Sequence
  Artificial sequence related to HLA knockouts in cell therapy
gtgcccagggctctgatgtgtc

SEQ ID NO: 21701 - DNA, 22 bp, Artificial Sequence
  Artificial sequence related to HLA knockouts in cell therapy
gcccagggctctgatgtgtctc

SEQ ID NO: 21702 - DNA, 22 bp, Artificial Sequence
  Artificial sequence related to HLA knockouts in cell therapy
gccttgtgtgggactgagaggc

SEQ ID NO: 21703 - DNA, 22 bp, Artificial Sequence
  Artificial sequence related to HLA knockouts in cell therapy
tgtgaggaggtggggagaccac

SEQ ID NO: 21704 - DNA, 22 bp, Artificial Sequence
  Artificial sequence related to HLA knockouts in cell therapy
gtgaggaggtggggagaccacc

SEQ ID NO: 21705 - DNA, 22 bp, Artificial Sequence
  Artificial sequence related to HLA knockouts in cell therapy
tgaggaggtggggagaccaccc

SEQ ID NO: 21706 - DNA, 22 bp, Artificial Sequence
  Artificial sequence related to HLA knockouts in cell therapy
gaggaggtggggagaccacccc

SEQ ID NO: 21707 - DNA, 22 bp, Artificial Sequence
  Artificial sequence related to HLA knockouts in cell therapy
aggaggtggggagaccacccca

SEQ ID NO: 21708 - DNA, 22 bp, Artificial Sequence
  Artificial sequence related to HLA knockouts in cell therapy
ggaggtggggagaccaccccac

SEQ ID NO: 21709 - DNA, 22 bp, Artificial Sequence
  Artificial sequence related to HLA knockouts in cell therapy
gaggtggggagaccaccccacc

SEQ ID NO: 21710 - DNA, 22 bp, Artificial Sequence
  Artificial sequence related to HLA knockouts in cell therapy
aggtggggagaccaccccaccc

SEQ ID NO: 21711 - DNA, 22 bp, Artificial Sequence
  Artificial sequence related to HLA knockouts in cell therapy
ggtggggagaccaccccacccc

SEQ ID NO: 21712 - DNA, 22 bp, Artificial Sequence
  Artificial sequence related to HLA knockouts in cell therapy
gtggggagaccaccccaccccc

SEQ ID NO: 21713 - DNA, 22 bp, Artificial Sequence
  Artificial sequence related to HLA knockouts in cell therapy
tggggagaccaccccaccccca

SEQ ID NO: 21714 - DNA, 22 bp, Artificial Sequence
  Artificial sequence related to HLA knockouts in cell therapy
ggggagaccaccccacccccat

SEQ ID NO: 21715 - DNA, 22 bp, Artificial Sequence
  Artificial sequence related to HLA knockouts in cell therapy
gggagaccaccccacccccatg

SEQ ID NO: 21716 - DNA, 22 bp, Artificial Sequence
  Artificial sequence related to HLA knockouts in cell therapy
ggagaccaccccacccccatgt

SEQ ID NO: 21717 - DNA, 22 bp, Artificial Sequence
  Artificial sequence related to HLA knockouts in cell therapy
gagaccaccccacccccatgtc

SEQ ID NO: 21718 - DNA, 22 bp, Artificial Sequence
  Artificial sequence related to HLA knockouts in cell therapy
agaccaccccacccccatgtcc

SEQ ID NO: 21719 - DNA, 22 bp, Artificial Sequence
  Artificial sequence related to HLA knockouts in cell therapy
gaccaccccacccccatgtcca

SEQ ID NO: 21720 - DNA, 22 bp, Artificial Sequence
  Artificial sequence related to HLA knockouts in cell therapy
accaccccacccccatgtccac

SEQ ID NO: 21721 - DNA, 22 bp, Artificial Sequence
  Artificial sequence related to HLA knockouts in cell therapy
ccaccccacccccatgtccacc

SEQ ID NO: 21722 - DNA, 22 bp, Artificial Sequence
  Artificial sequence related to HLA knockouts in cell therapy
caccccacccccatgtccacca

SEQ ID NO: 21723 - DNA, 22 bp, Artificial Sequence
  Artificial sequence related to HLA knockouts in cell therapy
accccacccccatgtccaccat

SEQ ID NO: 21724 - DNA, 22 bp, Artificial Sequence
  Artificial sequence related to HLA knockouts in cell therapy
ccccacccccatgtccaccatg

SEQ ID NO: 21725 - DNA, 22 bp, Artificial Sequence
  Artificial sequence related to HLA knockouts in cell therapy
cccacccccatgtccaccatga

SEQ ID NO: 21726 - DNA, 22 bp, Artificial Sequence
  Artificial sequence related to HLA knockouts in cell therapy
ccacccccatgtccaccatgac

SEQ ID NO: 21727 - DNA, 22 bp, Artificial Sequence
  Artificial sequence related to HLA knockouts in cell therapy
cacccccatgtccaccatgacc

SEQ ID NO: 21728 - DNA, 22 bp, Artificial Sequence
  Artificial sequence related to HLA knockouts in cell therapy
acccccatgtccaccatgaccc

SEQ ID NO: 21729 - DNA, 22 bp, Artificial Sequence
  Artificial sequence related to HLA knockouts in cell therapy
cccccatgtccaccatgaccct

SEQ ID NO: 21730 - DNA, 22 bp, Artificial Sequence
  Artificial sequence related to HLA knockouts in cell therapy
ccccatgtccaccatgaccctc

SEQ ID NO: 21731 - DNA, 22 bp, Artificial Sequence
  Artificial sequence related to HLA knockouts in cell therapy
ccaccatgaccctcttcccacg

SEQ ID NO: 21732 - DNA, 22 bp, Artificial Sequence
  Artificial sequence related to HLA knockouts in cell therapy
caccatgaccctcttcccacgc

SEQ ID NO: 21733 - DNA, 22 bp, Artificial Sequence
  Artificial sequence related to HLA knockouts in cell therapy
ccatgaccctcttcccacgctg

SEQ ID NO: 21734 - DNA, 22 bp, Artificial Sequence
  Artificial sequence related to HLA knockouts in cell therapy
tgaccctcttcccacgctgacc

SEQ ID NO: 21735 - DNA, 22 bp, Artificial Sequence
  Artificial sequence related to HLA knockouts in cell therapy
gaccctcttcccacgctgacct

SEQ ID NO: 21736 - DNA, 22 bp, Artificial Sequence
  Artificial sequence related to HLA knockouts in cell therapy
accctcttcccacgctgacctg

SEQ ID NO: 21737 - DNA, 22 bp, Artificial Sequence
  Artificial sequence related to HLA knockouts in cell therapy
ccctcttcccacgctgacctgt

SEQ ID NO: 21738 - DNA, 22 bp, Artificial Sequence
  Artificial sequence related to HLA knockouts in cell therapy
cctcttcccacgctgacctgtg

SEQ ID NO: 21739 - DNA, 22 bp, Artificial Sequence
  Artificial sequence related to HLA knockouts in cell therapy
ctcttcccacgctgacctgtgc

SEQ ID NO: 21740 - DNA, 22 bp, Artificial Sequence
  Artificial sequence related to HLA knockouts in cell therapy
cttcccacgctgacctgtgctc

SEQ ID NO: 21741 - DNA, 22 bp, Artificial Sequence
  Artificial sequence related to HLA knockouts in cell therapy
ttcccacgctgacctgtgctcc

SEQ ID NO: 21742 - DNA, 22 bp, Artificial Sequence
  Artificial sequence related to HLA knockouts in cell therapy
tcccacgctgacctgtgctccc

SEQ ID NO: 21743 - DNA, 22 bp, Artificial Sequence
  Artificial sequence related to HLA knockouts in cell therapy
cccacgctgacctgtgctccct

SEQ ID NO: 21744 - DNA, 22 bp, Artificial Sequence
  Artificial sequence related to HLA knockouts in cell therapy
ccacgctgacctgtgctccctc

SEQ ID NO: 21745 - DNA, 22 bp, Artificial Sequence
  Artificial sequence related to HLA knockouts in cell therapy
cacgctgacctgtgctccctcc

SEQ ID NO: 21746 - DNA, 22 bp, Artificial Sequence
  Artificial sequence related to HLA knockouts in cell therapy
acgctgacctgtgctccctccc

SEQ ID NO: 21747 - DNA, 22 bp, Artificial Sequence
  Artificial sequence related to HLA knockouts in cell therapy
cgctgacctgtgctccctcccc

SEQ ID NO: 21748 - DNA, 22 bp, Artificial Sequence
  Artificial sequence related to HLA knockouts in cell therapy
gctgacctgtgctccctcccca

SEQ ID NO: 21749 - DNA, 22 bp, Artificial Sequence
  Artificial sequence related to HLA knockouts in cell therapy
ctgacctgtgctccctccccaa

SEQ ID NO: 21750 - DNA, 22 bp, Artificial Sequence
  Artificial sequence related to HLA knockouts in cell therapy
gacctgtgctccctccccaatc

SEQ ID NO: 21751 - DNA, 22 bp, Artificial Sequence
  Artificial sequence related to HLA knockouts in cell therapy
tcctgttccagagaggtggggc

SEQ ID NO: 21752 - DNA, 22 bp, Artificial Sequence
  Artificial sequence related to HLA knockouts in cell therapy
cctgttccagagaggtggggct

SEQ ID NO: 21753 - DNA, 22 bp, Artificial Sequence
  Artificial sequence related to HLA knockouts in cell therapy
ctgttccagagaggtggggctg

SEQ ID NO: 21754 - DNA, 22 bp, Artificial Sequence
  Artificial sequence related to HLA knockouts in cell therapy
gttccagagaggtggggctgag

SEQ ID NO: 21755 - DNA, 22 bp, Artificial Sequence
  Artificial sequence related to HLA knockouts in cell therapy
ttccagagaggtggggctgagg

SEQ ID NO: 21756 - DNA, 22 bp, Artificial Sequence
  Artificial sequence related to HLA knockouts in cell therapy
tccagagaggtggggctgaggt

SEQ ID NO: 21757 - DNA, 22 bp, Artificial Sequence
  Artificial sequence related to HLA knockouts in cell therapy
ccagagaggtggggctgaggtg

SEQ ID NO: 21758 - DNA, 22 bp, Artificial Sequence
  Artificial sequence related to HLA knockouts in cell therapy
cagagaggtggggctgaggtgt

SEQ ID NO: 21759 - DNA, 22 bp, Artificial Sequence
  Artificial sequence related to HLA knockouts in cell therapy
agagaggtggggctgaggtgtc

SEQ ID NO: 21760 - DNA, 22 bp, Artificial Sequence
  Artificial sequence related to HLA knockouts in cell therapy
gagaggtggggctgaggtgtct

SEQ ID NO: 21761 - DNA, 22 bp, Artificial Sequence
  Artificial sequence related to HLA knockouts in cell therapy
agaggtggggctgaggtgtctc

SEQ ID NO: 21762 - DNA, 22 bp, Artificial Sequence
  Artificial sequence related to HLA knockouts in cell therapy
gaggtggggctgaggtgtctcc

SEQ ID NO: 21763 - DNA, 22 bp, Artificial Sequence
  Artificial sequence related to HLA knockouts in cell therapy
aggtggggctgaggtgtctcca

SEQ ID NO: 21764 - DNA, 22 bp, Artificial Sequence
  Artificial sequence related to HLA knockouts in cell therapy
ggtggggctgaggtgtctccat

SEQ ID NO: 21765 - DNA, 22 bp, Artificial Sequence
  Artificial sequence related to HLA knockouts in cell therapy
gtggggctgaggtgtctccatc

SEQ ID NO: 21766 - DNA, 22 bp, Artificial Sequence
  Artificial sequence related to HLA knockouts in cell therapy
ggggctgaggtgtctccatctc

SEQ ID NO: 21767 - DNA, 18 bp, Artificial Sequence
  Artificial sequence related to HLA knockouts in cell therapy
agaagcagaggggtcagg

SEQ ID NO: 21768 - DNA, 18 bp, Artificial Sequence
  Artificial sequence related to HLA knockouts in cell therapy
gaagcagaggggtcaggg

SEQ ID NO: 21769 - DNA, 18 bp, Artificial Sequence
  Artificial sequence related to HLA knockouts in cell therapy
gcggtgtatggattgggg

SEQ ID NO: 21770 - DNA, 18 bp, Artificial Sequence
  Artificial sequence related to HLA knockouts in cell therapy
tggattggggagtcccag

SEQ ID NO: 21771 - DNA, 18 bp, Artificial Sequence
  Artificial sequence related to HLA knockouts in cell therapy
ggattggggagtcccagc

SEQ ID NO: 21772 - DNA, 18 bp, Artificial Sequence
  Artificial sequence related to HLA knockouts in cell therapy
gattggggagtcccagcc

SEQ ID NO: 21773 - DNA, 18 bp, Artificial Sequence
  Artificial sequence related to HLA knockouts in cell therapy
tggggagtcccagccttg

SEQ ID NO: 21774 - DNA, 18 bp, Artificial Sequence
  Artificial sequence related to HLA knockouts in cell therapy
ggggagtcccagccttgg

SEQ ID NO: 21775 - DNA, 18 bp, Artificial Sequence
  Artificial sequence related to HLA knockouts in cell therapy
gggagtcccagccttggg

SEQ ID NO: 21776 - DNA, 18 bp, Artificial Sequence
  Artificial sequence related to HLA knockouts in cell therapy
ggagtcccagccttgggg

SEQ ID NO: 21777 - DNA, 18 bp, Artificial Sequence
  Artificial sequence related to HLA knockouts in cell therapy
gagtcccagccttgggga

SEQ ID NO: 21778 - DNA, 18 bp, Artificial Sequence
  Artificial sequence related to HLA knockouts in cell therapy
agtcccagccttggggat

SEQ ID NO: 21779 - DNA, 18 bp, Artificial Sequence
  Artificial sequence related to HLA knockouts in cell therapy
gtcccagccttggggatt

SEQ ID NO: 21780 - RNA, 2 nt, Artificial Sequence
  5' Flank Sequence
gg

SEQ ID NO: 21781 - RNA, 23 nt, Artificial Sequence
  5' Flank Sequence
acaccauguugccagucucuagg

SEQ ID NO: 21782 - RNA, 23 nt, Artificial Sequence
  5' Flank Sequence
ugauagcaaugucagcagugccu

SEQ ID NO: 21783 - RNA, 23 nt, Artificial Sequence
  5' Flank Sequence
uauugcuguugacagugagcgac

SEQ ID NO: 21784 - RNA, 21 nt, Artificial Sequence
  3' Flank Sequence
uggcgucuggcccaaccacac

SEQ ID NO: 21785 - RNA, 21 nt, Artificial Sequence
  3' Flank Sequence
guaagguugaccauacucuac

SEQ ID NO: 21786 - RNA, 4 nt, Artificial Sequence
  Loop Sequence
cgaa

SEQ ID NO: 21787 - RNA, 7 nt, Artificial Sequence
  Loop Sequence
uucaaga

SEQ ID NO: 21788 - RNA, 7 nt, Artificial Sequence
  Loop Sequence
auauuca

SEQ ID NO: 21789 - RNA, 9 nt, Artificial Sequence
  Loop Sequence
ugugcuguc

SEQ ID NO: 21790 - RNA, 6 nt, Artificial Sequence
  Loop Sequence
cucgag

SEQ ID NO: 21791 - RNA, 12 nt, Artificial Sequence
  Loop Sequence
cuuccugucaga

SEQ ID NO: 21792 - RNA, 15 nt, Artificial Sequence
  Loop Sequence
cuucccuuugucaga

SEQ ID NO: 21793 - RNA, 12 nt, Artificial Sequence
  Loop Sequence
guguuauucuug

SEQ ID NO: 21794 - RNA, 12 nt, Artificial Sequence
  Loop Sequence
gugucuuaauug

SEQ ID NO: 21795 - RNA, 12 nt, Artificial Sequence
  Loop Sequence
guguuagucuug

SEQ ID NO: 21796 - RNA, 7 nt, Artificial Sequence
  Loop Sequence
ucaagag

SEQ ID NO: 21797 - RNA, 12 nt, Artificial Sequence
  Loop Sequence
ggacauccaggg

SEQ ID NO: 21798 - RNA, 15 nt, Artificial Sequence
  Loop Sequence
gugaagccacagaug

SEQ ID NO: 21799 - RNA, 10 nt, Artificial Sequence
  Loop Sequence
gauucuaaaa

SEQ ID NO: 21800 - DNA, 255 bp, Artificial Sequence
  U6 Promoter
aaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaagga

SEQ ID NO: 21801 - DNA, 223 bp, Artificial Sequence
  H1 Promoter
gaacgctgacgtcatcaacccgctccaaggaatcgcgggcccagtgtcactaggcgggaacacccagcgcgcgtgcgccctggcaggaagatggctgtgagggacaggggagtggcgccctgcaatatttgcatgtcgctatgtgttctgggaaatcaccataaacgtgaaatgtctttggatttgggaatcttataagttctgtatgagaccactctttccc

SEQ ID NO: 21802 - DNA, 369 bp, Artificial; identical to SEQ ID NO: 559
  Codon-optimized CT292 VH

SEQ ID NO: 21803 - DNA, 807 bp, Artificial
  Codon-optimized CT292 VH-VL
atggattttcaggtgcagattttcagcttcctgctaatcagtgcctcagtcataatgtccagaggagatatccagatgacccagtccccgagctccctgtccgcctctgtgggcgatagggtcaccatcacctgccgtgccagtcaggatgtgaatactgctgtagcctggtatcaacagaaaccaggaaaagctccgaaactactgatttactcggcatccttcctttattctggagtcccttctcgcttctctggatctagatctgggacggatttcactctgaccatcagcagtctgcagccggaagacttcgcaacttattactgtcagcaacattatactactcctcccacgttcggacagggtaccaaggtggagatcaaacgcactgggtctacatctggatctgggaagccgggttctggtgagggttctgaggttcagctggtggagtctggcggtggcctggtgcagccagggggctcactccgtttgtcctgtgcagcttctggcttcaacattaaagacacctatatacactgggtgcgtcaggccccgggtaagggcctggaatgggttgcaaggatttatcctacgaatggttatactagatatgccgatagcgtcaagggccgtttcactataagcgcagacacatccaaaaacacagcctacctgcagatgaacagcctgcgtgctgaggacactgccgtctattattgttctagatggggaggggacggcttctatgctatggacgtgtggggtcaaggaaccctggtcaccgtttcctcggcggccgca

SEQ ID NO: 21804 - DNA, 603 bp, Artificial
  Codon-optimized CT292 intracellullar
aggagtaagaggagcaggctcctgcacagtgactacatgaacatgactccccgccgccccgggcccacccgcaagcattaccagccctatgccccaccacgcgacttcgcagcctatcgctcccgtttctctgttgttaaacggggcagaaagaagctcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctag

SEQ ID NO: 21805 - DNA, 1566 bp, Artificial
  Codon-optimized C2162 CAR
atggatatgagagtgcctgcccagctgctcggactgctccttctgtggttgagaggagctcggtgccaggtgcagctggtgcagtctggggctgaggtgaagaagcctgggtcctcagtgaaggtttcctgcaaggcttctggatacaccttcactagctatcatatacattgggtgcgccaggcccccggacaagggcttgagtggatcggatggatctaccctggcaatgttaacacagaatataatgagaagttcaagggcaaagccaccattaccgcggacgaatccacgaacacagcctacatggagctgagcagcctgagatctgaagacacggctgtgtattactgtgcgagggaggaaattacctacgctatggactactggggccagggaaccctggtcaccgtgtcctcaggaggtggcggctctggaggcggaggtagcggaggtggaggctctggtggcgacattcaaatgacccagagcccatccaccctgagcgcatctgtaggtgaccgggtcaccatcacttgtagatccagtcagagtattgtacacagtaatgggaacacctatttggaatggtatcagcagaaaccaggtaaagccccaaaattgctcatctacaaagtctctaacagatttagtggtgtaccagccaggttcagcggttccggaagtggtactgaattcaccctcacgatctcctctctccagccagatgatttcgccacttattactgttttcaaggttcacatgtgccgcgcacattcggtcagggtactaaagtagaagtcaaatacggctcacagagctccaaaccctacctgctgactcaccctagtgatcctctggagctcgtggtctcaggaccgtctggaggcccaagctctccgacaacaggccccacctccacatctggccctgaggaccagcccctcacacccaccgggtcggatcctcagagtggtctgggaagacacctgggagttgtgatcggcatcttggtggccgtcatcctactgctcctcctcctgctcctgctcttcctcatcctccgacatcgacgtcagggcaaacactggacatcgacccagagaaaggctgatttccaacatcctgcaggggctgtggggccagagcccacagacagaggcctgcagtggaggtccagcccagctgccgatgcccaggaagaaaacctctatgctgccgtgaagcacacacagcctgaggatggggtggagatggatactcggagcccacacgatgaagatccacaggcagtgacgtatgccgaggtgaaacactccagacctagaagggaaatggcctctcctccttccccactgtctggagagttcctggacacaaaggacagacaggcggaagaggacaggcagatggacactgaggctgctgcatctgaagctcctcaggatgtgacctacgcccagctgcacagcttgaccctcagacgggaggcaactgagcctcctccatcccaggaagggccctctccagctgtgcccagcatctacgccactctggccatccac

SEQ ID NO: 21806 - protein, 243 aa, Artificial
  BB7.1 scFv
VQLQESGPDLVKPSQSLSLTCTVTGYSITSGYSWHWIRQFPRNKLEWMGYIHFSGSTHYHPSLKSRISITRDTSKNQFFLQLNSVTTEDTATYYCARGGVVSHYAMDCWGQGTSVTVSSGGGGSGGGGSGGGGSGGDIQMTQSPASLSVSVGETVTITCRASENIYSNLAWYQQKQGKSPHLLVYAATYLPDGVPSRFSGSGSGTQYSLKINSLQSEDFGSYYCQHFWVTPYTFGGGTKVEIK

What is claimed is:

1. An immune cell responsive to loss of heterozygosity at an HLA-A*02 allele in a cancer cell, comprising:
   (a) an activator receptor comprising an extracellular ligand binding domain specific to an erb-b2 receptor tyrosine kinase 2 (HER2) antigen, wherein the activator receptor comprises a polypeptide sequence at least 95% identical to SEQ ID NO: 291, wherein the extracellular ligand binding domain of the activator receptor comprises an scFv comprising
      (i) a heavy chain variable (VH) region comprising complement determining regions (CDRs) CDR-H1 of SEQ ID NO: 36, CDR-H2 of SEQ ID NO: 38, and CDR-H3 of SEQ ID NO: 41; and
      (ii) a light chain variable region (VL) comprising CDRs CDR-L1 of SEQ ID NO: 30, CDR-L2 of SEQ ID NO: 32, and CDR-L3 of SEQ ID NO: 34,
   (b) an inhibitory receptor comprising an extracellular ligand binding domain specific to an HLA-A*02 allele of HLA-A, wherein the inhibitory receptor comprises a polypeptide sequence at least 95% identical to SEQ ID NO: 305, wherein the extracellular ligand binding domain of the inhibitory receptor comprises an scFv comprising:
      (i) VH region comprising CDRs CDR-H1 of SEQ ID NO: 95, CDR-H2 of SEQ ID NO: 98, and CDR-H3 of SEQ ID NO: 101; and
      (ii) a VL region comprising CDRs CDR-L1 of SEQ ID NO: 87, CDR-L2 of SEQ ID NO: 90 or SEQ ID NO: 91, and CDR-L3 of SEQ ID NO: 92.

2. The immune cell of claim 1, wherein the activator receptor and the inhibitory receptor together specifically activate the immune cell in the presence of the cancer cell.

3. The immune cell of claim 1, wherein the immune cell is a T cell.

4. The immune cell of claim 3, wherein the T cell is a CD8+ CD4− T cell.

5. The immune cell of claim 1, wherein the scFv comprises a sequence having at least 97% identity to a sequence selected from the group consisting of SEQ ID NO: 51.

6. The immune cell of claim 1, wherein the activator receptor is a chimeric antigen receptor (CAR) and wherein the CAR comprises a CD8 hinge.

7. The immune cell of claim 6, wherein the CAR comprises a transmembrane domain isolated or derived from CD8 or CD28.

8. The immune cell of claim 7, wherein the CAR comprises CD28, 4-1BB and CD3z intracellular domains.

9. The immune cell of claim 1, wherein the inhibitory receptor comprises LILRB1 hinge and transmembrane domain.

10. The immune cell of claim 1, wherein the immune cell is modified to inactivate, or reduce or eliminate expression or function of an endogenous gene encoding an allele of an endogenous WIC class I polypeptide.

11. The immune cell of claim 10, wherein the immune cell is modified to reduce or eliminate expression of the B2M gene product.

12. A pharmaceutical composition, comprising a therapeutically effective amount of the immune cells of claim 1.

13. The immune cell of claim 3, wherein the T cell is a CD8− CD4+ T cell.

14. A polynucleotide system, comprising one or more polynucleotides comprising polynucleotide sequences encoding:
   (a) an activator receptor comprising an extracellular ligand binding domain specific to an erb-b2 receptor tyrosine kinase 2 (HER2) antigen, wherein the activator receptor comprises a polypeptide sequence at least 95% identical to SEQ ID NO: 291, wherein the extracellular ligand binding domain of the activator receptor comprises an scFv comprising
      (i) a heavy chain variable (VH) region comprising complement determining regions (CDRs) CDR-H1 of SEQ ID NO: 36, CDR-H2 of SEQ ID NO: 38, and CDR-H3 of SEQ ID NO: 41; and
      (ii) a light chain variable region (VL) comprising CDRs CDR-L1 of SEQ ID NO: 30, CDR-L2 of SEQ ID NO: 32, and CDR-L3 of SEQ ID NO: 34; and
   (b) an inhibitory receptor comprising an extracellular ligand binding domain specific to an HLA-A*02 allele of HLA-A, wherein the inhibitory receptor comprises a polypeptide sequence at least 95% identical to SEQ ID NO: 305, wherein the extracellular ligand binding domain of the inhibitory receptor comprises an scFv comprising:
      (i) VH region comprising CDRs CDR-H1 of SEQ ID NO: 95, CDR-H2 of SEQ ID NO: 98, and CDR-H3 of SEQ ID NO: 101; and
      (ii) a VL region comprising CDRs CDR-L1 of SEQ ID NO: 87, CDR-L2 of SEQ ID NO: 90 or SEQ ID NO: 91, and CDR-L3 of SEQ ID NO: 92.

15. A vector, comprising the polynucleotide system of claim 14.

16. A method of treating a HER2+ cancer in a subject identified as having or suspected of having a loss of heterozygosity at an HLA-A*02 allele of HLA-A in the HER2-positive cancer, comprising administering to the subject the immune cells of claim 1.

17. A method of selectively killing HER2-positive tumor cells having loss of heterozygosity at an HLA-A*02 allele of HLA-A in the HER2-positive cancer, comprising contacting the HER2-positive tumor cells with the immune cells of claim 1.

18. An immune cell responsive to loss of heterozygosity at an HLA-A*02 allele in a cancer cell, comprising:
   (a) a polynucleotide comprising a polynucleotide sequence at least 90% identical to SEQ ID NO: 292, or encoding an activator receptor comprising an extracellular ligand binding domain specific to an erb-b2 receptor tyrosine kinase 2 (HER2) antigen, wherein the activator receptor comprises a polypeptide sequence at least 95% identical to SEQ ID NO: 291, wherein the extracellular ligand binding domain of the activator receptor comprises an scFv comprising
      (i) a heavy chain variable (VH) region comprising complement determining regions (CDRs) CDR-H1 of SEQ ID NO: 36, CDR-H2 of SEQ ID NO: 38, and CDR-H3 of SEQ ID NO: 41; and
      (ii) a light chain variable region (VL) comprising CDRs CDR-L1 of SEQ ID NO: 30, CDR-L2 of SEQ ID NO: 32, and CDR-L3 of SEQ ID NO: 34; and
   (b) a polynucleotide comprising a polynucleotide sequence at least 90% identical to SEQ ID NO: 306, or encoding an inhibitory receptor comprising an extracellular ligand binding domain specific to an HLA-A*02 allele of HLA-A, wherein the inhibitory receptor comprises a polypeptide sequence at least 95% identical to SEQ ID NO: 305, wherein the extracellular ligand binding domain of the inhibitory receptor comprises an scFv comprising:
      (i) VH region comprising CDRs CDR-H1 of SEQ ID NO: 95, CDR-H2 of SEQ ID NO: 98, and CDR-H3 of SEQ ID NO: 101; and (ii) a VL region comprising CDRs CDR-L1 of SEQ ID NO: 87, CDR-L2 of SEQ ID NO: 90 or SEQ ID NO: 91, and CDR-L3 of SEQ ID NO: 92.

19. The immune cell of claim 18, wherein the activator receptor and the inhibitory receptor together specifically activate the immune cell in the presence of the cancer cell.

20. The immune cell of claim 18, wherein the immune cell is a T cell.

21. The immune cell of claim 18, wherein the T cell is a CD8+ CD4− T cell.

22. The immune cell of claim 18, wherein the T cell is a CD8− CD4− T cell.

* * * * *

UNITED STATES PATENT AND TRADEMARK OFFICE
CERTIFICATE OF CORRECTION

PATENT NO. : 11,730,764 B2
APPLICATION NO. : 17/809409
DATED : August 22, 2023
INVENTOR(S) : Yuta Ando et al.

It is certified that error appears in the above-identified patent and that said Letters Patent is hereby corrected as shown below:

In the Claims

At Column 195, Claim number 10, Line number 4, delete "WIC" and replace with --MHC--

Signed and Sealed this
Twenty-third Day of January, 2024

*Katherine Kelly Vidal*

Katherine Kelly Vidal
*Director of the United States Patent and Trademark Office*